United States Patent 11,098,302 (IDENTIFICATION OF POLYNUCLEOTIDES ASSOCIATED WITH A SAMPLE) - sequence listing, part 8

SEQ ID NO: 24182 - DNA, 587 bp, Homo sapiens
  misc_feature: GYAE6OF01DWPWN.21.22.B11.1.454.CMB.1.raw
  modified_base (462)..(462): a, c, t, g, unknown or other
  misc_feature (462)..(462): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgtctggagcaactcaacatacggaagtaattatgtattctggtatcagcaactcccgaggaactcggaccccctaaactcctacatccagacggaataactcacgccggccctcgacggggtccctgaccgtattcctcgtcggcctccaaggtctcggcaccctcacgtccctccctcgaccatcgaggtcggcctccggtacgaggatggacggtctagtacttattactgtnacatccgacgggtacgactaaagtgggatagaactaatccgtaggacggtcgggttgggttcggttcggggacgggaacgggaacccctaaacgtacggtacccgtacccgtagggtccaaccgg

SEQ ID NO: 24183 - DNA, 302 bp, Homo sapiens
  misc_feature: GYAE6OF01BUSAY.21.22.B11.1.454.CMB.1.raw
  modified_base (293)..(293): a, c, t, g, unknown or other
  misc_feature (293)..(293): n is a, c, g, or t
  modified_base (299)..(302): a, c, t, g, unknown or other
  misc_feature (299)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctcgttcccacctcctcctcgtctctactgagcggctggcaaggcncatagnnnn

SEQ ID NO: 24184 - DNA, 575 bp, Homo sapiens
  misc_feature: GYAE6OF01A6NMZ.21.22.B11.1.454.CMB.1.raw
  modified_base (210)..(210): a, c, t, g, unknown or other
  misc_feature (210)..(210): n is a, c, g, or t
  modified_base (440)..(440): a, c, t, g, unknown or other
  misc_feature (440)..(440): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgtctggaggcaactccaacatcggaagtaattatgtattctgtatcagcaactcccaggaatcggacccccaaactcctcatccagagaatatcagcggccctgacgggtccctgaccgattcctctcggcctccgaagtccgtggccaccgtcacgccctcctgacccatcaggtcggcctccggacgaggatcgaggctgacttattacngtagctagtccgaacggggaccacaacgagtgggaatggaaccaagttccgtagggagttcggggtttggggtcgttaccggggacggtaacgggtaaccctaacggtcggtaacccggttccgtaagggtcccg

SEQ ID NO: 24185 - DNA, 692 bp, Homo sapiens
  misc_feature: GYAE6OF01CAMOM.21.22.B11.1.454.CMB.1.raw
  modified_base (56)..(56): a, c, t, g, unknown or other
  misc_feature (56)..(56): n is a, c, g, or t
  modified_base (208)..(208): a, c, t, g, unknown or other
  misc_feature (208)..(208): n is a, c, g, or t
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagtcgtcgctcgcacgaccggtgctcgatttagacgacagctcagggggggaanctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccggnagacggtcaccatctcttgtcnggagcaactccaacntacggaagtaattatgtattctggtatcagtcaactccgaaggtaactcggacccccaaactcctacactccgagaacggaaataatcacgccggaccctcgacggggtccctgaccgtattctcgtggcctaccgtaagttcctggcctaaccgtcacgtcccctccgtacgacagtcgacggtcgggccctcccgggtaccgagggtactacgggtaacggccgttagaacccgtttaagttaacccgttggttaccgacctaacgttcccggaaaccgggggtaaccaccgaaaccgtagggttacgggaatttacggaaacttaaacgttccggtagggtaacgggttcggggtttagggggttccggttaccgggggtaaccgggaacggtaaacccgttaaccgaccggggtaaccccttaccgggttaacggtaacccgg

SEQ ID NO: 24186 - DNA, 655 bp, Homo sapiens
  misc_feature: GYAE6OF01BI4TV.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagccgtctcggggacccccggnaggagggtccaccatctcttgttctggagcaactccaacatcggaattaattatgtattctggtatcagcaactccaggactcgccccaactcctcatccagagaatactcgacggccgccctacggacgggggttccccaggacccgtatttcctagtccggtacctaccgtaagttccgtcggacctaacccctcgaaccgtcccctacccgttgaacccctagttaccgagggttcccgggcctttcccggggtaccgaggtactagggacgtccgttaggtaccttaacgtttcctggcgaacctgtacccggaacgggtaccactaaccgaggtacgggactagaccttaagtccgtagggacggttgggtttgggtcggttacggggaacggaacgggtaacccctaacgttcgggaacccttccgggaaggtacccg

SEQ ID NO: 24187 - DNA, 300 bp, Homo sapiens
  misc_feature: GYAE6OF01BHYX9.21.22.B11.1.454.CMB.1.raw
  modified_base (295)..(300): a, c, t, g, unknown or other
  misc_feature (295)..(300): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagccaaggctcgcccctcggtcactctcgttcccgcctcctcctcgtctctactgagcggctggcagcgcatgnnnnnn

SEQ ID NO: 24188 - DNA, 691 bp, Homo sapiens
  misc_feature: GYAE6OF01AVG3W.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnagagggtcaccatctcttgttctggaggcaactccaacatcggaagtaattatgtattctggtatcagcaactcccaggaactcggacccccaaactcctacatccagagaataatcagcgcctcgacgggtccctgaccgtattcctcgtcggcctaccgaacgttccgtcggaccaccctcgacgtccccttccctagaccctagtcgacgggttcgggcccttacccgggtcggaaggtatcgggaacggtccttacggtaaccttacgtttacgtggttacgaccgtacgttacccggaaccggggtaccgtacaaacgttagggtagggtaacttacggaaaccgttaaagtttccggtaagggtacggggttcgggggtttacggggtttcgggttacccgggggacggggtaaacccgggtaaacccgtaacgttacccggggtacccccggttaaggtaccgggtaacccgg

SEQ ID NO: 24189 - DNA, 699 bp, Homo sapiens
  misc_feature: GYAE6OF01AJ60V.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccgggnagagggtcaccatctcttgttctggagcaactccaacatcggaagtaattatgttattctggtatcagcaactccaggaactcggacccccaaatcctacactacccagaacggaattaactcgaaggccggccctcggacgggggttcccctaggacccgtatttccgtcgtcggcccttaccgaagtcgtcggacctaccctcgacgtccctcccgtgaccctatccgaggttcgggaccttcccgggtaccgaagggacttcggacggccttaggtaacctttagtttactcggttcgacctagtacccggaaccggggtaccacgtaaaccgtaggttacggggaattcgggtaaaccgtaagttcccggtagggtaaccggggttccgggggttttacggggttccgggtttaccgggggaccgggttaaacggggaaccccgttaacggtaccggtaccccggttacccggtacgggtacccgg

SEQ ID NO: 24190 - DNA, 688 bp, Homo sapiens
  misc_feature: GYAE6OF01A1G18.21.22.B11.1.454.CMB.1.raw
  modified_base (209)..(209): a, c, t, g, unknown or other
  misc_feature (209)..(209): n is a, c, g, or t
  modified_base (361)..(361): a, c, t, g, unknown or other
  misc_feature (361)..(361): n is a, c, g, or t
  modified_base (413)..(413): a, c, t, g, unknown or other
  misc_feature (413)..(413): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagagggtcaccatctcttgttctggagcaactccaacatcggaagtattatgtattctggtatcagcaactcccaggaactcggaccccctaactcctcactccagaggaatactcagccggtccctcgacggggtccctcgaccgtattcncgtcggacctaccgaagtcctacggctacctcacgtccctccctacgacctntaccgaggttcggccttccgggtccgaaggtctcggacggtcctacggtaccttagtttacgtcggtcgaccgtaacttacccgggaaccggggtaccaccgtaaacgtagggtacggggtaacttacggaaaccgttaaacgttcccggttaagggtacggggtttccgggggttttacggggttccggtttaccgggggaaccggggtaaaccggggtaaaccctaaaccggttaccgggaacccccggtttaccggttaacgggtaacccgg

SEQ ID NO: 24191 - DNA, 310 bp, Homo sapiens
  misc_feature: GYAE6OF01A70NF.21.22.B11.1.454.CMB.1.raw
  modified_base (155)..(155): a, c, t, g, unknown or other
  misc_feature (155)..(155): n is a, c, g, or t
  modified_base (300)..(310): a, c, t, g, unknown or other
  misc_feature (300)..(310): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacncaacatgggatgacaatctgagcggttggtgttcggcggagggaccaaactgaccgtctaggtcagccaaggctgccccctggtcacgtctcgttcccgccctctcctctactctactgacgcggctgggccaaggcgcagtagnnnnnnnnnnn

SEQ ID NO: 24192 - DNA, 681 bp, Homo sapiens
  misc_feature: GYAE6OF01BYV3F.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccggnagacggtcaccatctcttgttctggagcaactcaacatcggaagtaattatgtattctgtatcagcactccaggactcggaccccaaactcctacatccaggagtaatatcagccgccctcgacggggtcccagaccgtattcgtcgtcggtcctccgaagtcgtacggcctaacctcgacgtcccttacccctgaccccatccgaaggttcgggccgttacccggtccggaaggactttagggaccggtcctaacgtacctttatttacgtcggtcgactaacggtaccggaaccggggtaccacgtaaaccgtaggtacggggtaatacggaaaccttaggtaccgtagggtaacgggtttccggggtttaggggttacgggttcccggggggtaagggaaaccccggggtaaacccttaaaccgggttacccggaaccccggtttcgggttaaacccgggtaacccggg

SEQ ID NO: 24193 - DNA, 643 bp, Homo sapiens
  misc_feature: GYAE6OF01D1JV0.21.22.B11.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggaccccaaactcctcactccagagaataatcagccgcctgacggggtccctgaccgtattcctctcggtctccaagtcgtcggccacccttcgacgtccctcccgtcgacccatccgaggtcgggccgttccgggtaccgaggtactggacggtcgtacggtacttacgtttaccgtcgactacgtaccgaccggggacgaccgaaacgtacgtaggggtactcggaaaccgtaaacgttccgtaagggtacgggttcgggggtttaggggttcgggttccggggacggggaaccgggtaaaccctaaacgggtacgtaaccccggttcccgtaagggtccgtaacccggg

SEQ ID NO: 24194 - DNA, 662 bp, Homo sapiens
  misc_feature: GYAE6OF01CX3MC.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccgggcaggacgggtccaccgatctcttgttctggagccaactccaacagtacggaagttaattatgttattctggtaatcagcctaactcccaaggaactccggacccccaaactcctacactccgagaaggaatatcgagccgccctggacgggtccctagaccgtattccgtcgtcggcctacctaaggtcctacgggcctacctcgacgtccccttacccgtacgaaccctagttccgaacgggtcgggtacccttaccgggtaccggaggtacgtggacggtctcgtaacttacttacgtgtcgacctagtaccggaccgggacgtacaacgaggtgggtaactacggaacaggttccgagggtacggttcggggtttagggttcggttaccggggacgggtacgggtaaacccctaaagttccgggtaaccctcggttacgggtacccg

SEQ ID NO: 24195 - DNA, 601 bp, Homo sapiens
  misc_feature: GYAE6OF01E3VPF.21.22.B11.1.454.CMB.1.raw
  modified_base (208)..(208): a, c, t, g, unknown or other
  misc_feature (208)..(208): n is a, c, g, or t
  modified_base (397)..(397): a, c, t, g, unknown or other
  misc_feature (397)..(397): n is a, c, g, or t
  modified_base (457)..(457): a, c, t, g, unknown or other
  misc_feature (457)..(457): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagaggtcaccatctcttgtctggagcaactccaacatcggaagtaattatgtattctggtatcagcaactcccaggatcggacccccaaactcctcactccagagaataatcacgccggccctcgacggggtccctggaccgtattctcgtcggcctaccaagttcctggccacctcacgtccctcccngacccagtcgaggtcgggcctccgggtaccgaggactgacggtctagtacttatttacgngtacgctacgtccgaacggggtacacgaaactgtacggggatacgaacaagttcgtaggtacgggttcgggtttggggtcgttcccggggacgggtaacgggtaaaccctaaacggtcggtaaccccgttcgtacgggtacccg

SEQ ID NO: 24196 - DNA, 749 bp, Homo sapiens
  misc_feature: GYAE6OF01BE8PP.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccgggnagagggtccaccatctcttgttctggagcaactccaacatcggaagtaattatgtattctggtatcagcaactcccgaggaactcggacccccaaactcctacactaccaggaaggaaataactcacggccggaccctcgacgggggtccctaggacccgtattcctcgtcggcctaccgaagttccgtcggacctacctccgacgtcccctcccgtagaccctacttacgacggttccggggtccttcccggggtaccgaagggtacttcgggacgggtccttacggtaacctttaacgtttaccgttggttacggacctaacgtaccgggaaaccgggggtacccgaaccttaaaccggtaggttacggggaacgttacgaaaccgttaacgtccggttaggggtaccggggtttcgggggtttacgggggtttaccggggttacccgggggacccggggtaaaccgggggtaaacccccttaaaacggttcccgggaaccccgggtttaccccggttaaacgggtaccccggg

SEQ ID NO: 24197 - DNA, 303 bp, Homo sapiens
  misc_feature: GYAE6OF01AWALP.21.22.B11.1.454.CMB.1.raw
  modified_base (300)..(303): a, c, t, g, unknown or other
  misc_feature (300)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctcgttcccaccctcctcctcgtctctactgagcgggctggcaaggcgcatagnnnn

SEQ ID NO: 24198 - DNA, 718 bp, Homo sapiens
  misc_feature: GYAE6OF01BCOSY.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctgggcccagtctgtgctgactcagccaccctcagcgtcgtcgggaccccggngagagggtcaccatctcttgttcgtggagcaactccaacatacggaagttaattatgtattctggtactcagccaactcccgaggaactccggacccccaaactcctacactccaagaaggtaaataatcgacgccggaccctcgaccggggtccctgaaccgtattccgtcgtcggtcctaccgtaacgtcgtacggaccacccgtcgaccgtccccttacccgtacggaaccctaacgtacggtaacgggttccgggtcccgttacccggggtacgaacgggtacgtacggacggtccgtaagtaaccgtttaacgtttaccgtagggttacgtaccgtaacgtacccggtaaccgggggaacaacctaagtaacgggtacgggaaatacggaaactaacgttccgttagggtacggttcgggggttaggggtttcgggtaccggggtaacggggaacggtaaaccctaaacggttccggtaacccgttccggttaacggtacccg

SEQ ID NO: 24199 - DNA, 628 bp, Homo sapiens
  misc_feature: GYAE6OF01AJF90.21.22.B11.1.454.CMB.1.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcaggcgtcgtcggggccccggnagagggtcaccntctcttgtcnggngcaactcaanatcgaagtattatgtattctggtatcagcactccaggaactcggaccccaactcctcactcagagaataancagccggcctcgcgggtcccngaccgtattccgtcgtcggctaccgaagtccgtacggccacctccacgtccctacccgtacgtaccctactacgtcggtacgggtccgtacccgggtaccggaggtacgtcgggacggtctacgtacttacgttacgtcggtacaccgtacgtaccggaaccggggtaccgaacaacgtaggtcggaactacggtactaagtccgtagggacgggttggggttacgggttcggtaccggggaggaaccgggtaacctaaccggtcgtaccccggtaggtacggtacccgg

SEQ ID NO: 24200 - DNA, 649 bp, Homo sapiens
  misc_feature: GYAE6OF01E35OD.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggtttccctctcctcctcaccctcctcactcactgcgcagggtcctgggcccagtctgtgctgactcagccaccctcagcgtctacgggacccccgggcagagggtcaccatctcttgttctggaggcaactccaacatcggaagtaattatgtattctggtatcagacaacctcccgaggaactccggacccccaaactcctcatccagaagaataatcacgccgccctcgacgggtccctgaccgtatctctggctaccaagtctcggcacctcacgtccctccctgaccctatcgacgggtcggggcccttcccgggtacgaggtacgtggacggtcctagtaccttaagtttacgtggtcgactacgtaccggaaccgggacctaccgaaacgtaggtacgggtatacggaactaacgttcgtagggtacgggttcgggtttgggggttacgggttccgggggacggggaaacgggtaaccccgtaaaaccggtcggtaacccccgggttcgttaacgggcccgtaacccggg

SEQ ID NO: 24201 - DNA, 317 bp, Homo sapiens
  misc_feature: GYAE6OF01C7X6C.21.22.B11.1.454.CMB.1.raw
  modified_base (304)..(317): a, c, t, g, unknown or other
  misc_feature (304)..(317): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggagggaccaaactgaccgtcctaggtcagcccgaaggccgtcgccccctggtcactctcgttccccgcctcctccgagccgacgactgagcgggctggcaaggcgcatagnnnnnnnnnnnnnn

SEQ ID NO: 24202 - DNA, 539 bp, Homo sapiens
  misc_feature: GYAE6OF01A4J5W.21.22.B11.1.454.CMB.1.raw
  modified_base (209)..(209): a, c, t, g, unknown or other
  misc_feature (209)..(209): n is a, c, g, or t
  modified_base (355)..(355): a, c, t, g, unknown or other
  misc_feature (355)..(355): n is a, c, g, or t
  modified_base (390)..(390): a, c, t, g, unknown or other
  misc_feature (390)..(390): n is a, c, g, or t
  modified_base (416)..(416): a, c, t, g, unknown or other
  misc_feature (416)..(416): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaacatcggaagtaattatgtattctggtatcagcaactcccaggaatcggcccccaaactcctcatccagaggaataatcagcggccctgacggggtccctgaccgtattcncgtggcctccaagtctggccacctcacgccctccngaccatcagtcggctccggtcgaggntgaggctagacttatactgtcgcatccgacgggtacncaacngtggatgacattcgaggtacggtgggttgggtcgttcgggacgggacgggacccaacggtcggacccggttcgtaggtccg

SEQ ID NO: 24203 - DNA, 750 bp, Homo sapiens
  misc_feature: GYAE6OF01B5E6N.21.22.B11.1.454.CMB.1.raw
  modified_base (210)..(210): a, c, t, g, unknown or other
  misc_feature (210)..(210): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagaggtcaccatctcttgttctggaggcaactccaacatcggaatattatgtattctgtatcagcaactccaggaactccggacccccaaactccncatccagagaataancagccggccctcgacggggtccctaggaccgtattcctcgtggcctaccaagtctcggccacctcacgccctccgtacgacccatcgacggtcgggtcccgttcccgggtaccggaaggtacgtcggaacggtccttacggtaaccttttaacgttaccgttgggtacgtacctaaccggttaccggaaaccgggggtacccgtaaacccgaaacgtacggggttacggggacttaaacgggtaaacccgttaaagttaccgggttacggggaaccgggggtttccgggggggtttttaggggggttacccggggtttaccccggggggaaaccgggggtaaaacccgggggtaaaaccccctaaaaacccgggtttcccggggtaaaaccccccggtttccccgggttaaagggggttaaccccccgg

SEQ ID NO: 24204 - DNA, 716 bp, Homo sapiens
  misc_feature: GYAE6OF01BX2OZ.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctcgggcccagtctgtgctgactcacgcccaccctcagcgtcgtcggggacccccggnaggacgggtcaccatcttcttgttcgtggacggcaacctccaacagtacggaaagttaattagtgttattcgttaggtatcagccaacctccaaggaactcgacccccaaatcctcactccaagaagtaataatcgacggccgcccgtacgaccggggtccctacgaccgtacttctcgtcggccttaccgaagttcctacggaccctaccgtccgaccgttcccctcccgtacgaccctaacgtcgtacggtcgggtcccgttacccgggtaccgaaggtacgttcgggacgtaccgtacggtaacttttagttacgttggtacgaccgtaacgttacccgggaaccggtacccgaacctaacggtaaggttcgggaaattacgtaacgtaaacgttccgtaagggtacgggttccggggttaggggttcgggttaaccggggaccggtaaccgggaaacccgtaaccggttcggtaacccggttcgtaacggtaccccgg

SEQ ID NO: 24205 - DNA, 549 bp, Homo sapiens
  misc_feature: GYAE6OF01BBK9T.21.22.B11.1.454.CMB.1.raw
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (411)..(411): a, c, t, g, unknown or other
  misc_feature (411)..(411): n is a, c, g, or t
  modified_base (490)..(490): a, c, t, g, unknown or other
  misc_feature (490)..(490): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcatccagagaatatcgagcgccctgacgggtccngaccntcnctggctcagtctgccacctcacgccctcctgaccatcgaggtcgggctcccgggtcgaggntggtacggctgtactatttacgtgtgaccatccggaacgggtaccacaacgagtgggaatcggaactaagtcgtagggnggtcgggttaggggtcgttcgggacggtaacggacctaacgcggtaccgtcgtaggccg

SEQ ID NO: 24206 - DNA, 572 bp, Homo sapiens
  misc_feature: GYAE6OF01EC5CY.21.22.B11.1.454.CMB.1.raw
  modified_base (347)..(347): a, c, t, g, unknown or other
  misc_feature (347)..(347): n is a, c, g, or t
  modified_base (556)..(556): a, c, t, g, unknown or other
  misc_feature (556)..(556): n is a, c, g, or t
  modified_base (559)..(560): a, c, t, g, unknown or other
  misc_feature (559)..(560): n is a, c, g, or t
  modified_base (562)..(563): a, c, t, g, unknown or other
  misc_feature (562)..(563): n is a, c, g, or t
  modified_base (566)..(572): a, c, t, g, unknown or other
  misc_feature (566)..(572): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatcggcccccaaatcctcatccagaggaataatcagccggccctcgacggggtccctgaccgattctctggctccaagtctggcacctcagccctccctgaccatcaggtcgggctccgggtccgaggatggaggctgacttattactgtgcatcgacgggacncaacagtcggggatgaactaactcgtggacggtcggggtttggggtggttccggggacgggaacggggaacccaaacgtaccggtacccgtccgttaacgggtcacggacccgaaggccgtccgcccccgtcggtccactcgttcgttccccacccttcctcccgtcctcctctaccgtgacgcggtcgtcgacgacggcgcagtacgngcnncnncgnnnnnnn

SEQ ID NO: 24207 - DNA, 590 bp, Homo sapiens
  misc_feature: GYAE6OF01C4YQV.21.22.B11.1.454.CMB.1.raw
  modified_base (211)..(211): a, c, t, g, unknown or other
  misc_feature (211)..(211): n is a, c, g, or t
  modified_base (277)..(277): a, c, t, g, unknown or other
  misc_feature (277)..(277): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagagggtcaccatctcttgtctggagcaactccaacatacggaagtaattatgtattctgtatcancaactccagaatcgaccccaactcctcatccagagaatatcacgcgcctgacggtcctgacctattctcgtcggctaccaagtctggcctacctcacgtccctcccgtgacccatcgaggtcggcctcggtcgaggatggagtctagacttatacgtgtcgctacgtcgaacgggtacactaacgaggttacggggatacggaacctagttcgagggtacgggtccggggttttggggttcggtaccggggacggggtaacgggtaaaccccttaaacggtccgggtaaacccggttccgtaacgggtacccg

SEQ ID NO: 24208 - DNA, 691 bp, Homo sapiens
  misc_feature: GYAE6OF01BKQLM.21.22.B11.1.454.CMB.1.raw
  modified_base (209)..(209): a, c, t, g, unknown or other
  misc_feature (209)..(209): n is a, c, g, or t
  modified_base (248)..(248): a, c, t, g, unknown or other
  misc_feature (248)..(248): n is a, c, g, or t
  modified_base (341)..(341): a, c, t, g, unknown or other
  misc_feature (341)..(341): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcacctcctcactcactgcgcagggtcctgggcccagtctgtgctggctcagcccacctcagcgtcgtcgggacccccggnaggaggtccacctatctcgttgtctggagcaactccaantacggtaaataattatgtattcgtggtatcagacaactccgaaggtaactccggaccccctaaactcctacactccgaaggtaacgaataacncgacgccggtccctcgacggggtcctagaccgtacttctcgtacggacctaccgtaagtctacggcccaccgtccgacgttccctcccgtacgacctagtccggtaggtccgggccgttacccgggcgaaaggcgttcggaacggtccttaggtaaccttaacttcgtcgtacgcgtagtaccggaccgggaacaccgaaggtacgtaggggaactacgtaacgacggttacgtcggggtaaccgggtttggggttttaacggggccggttacccgggggaacggtaaacggggtaaaccccttaaaacgggtcccggttaaacccggtccgggttaaccgggtaacccg

SEQ ID NO: 24209 - DNA, 580 bp, Homo sapiens
  misc_feature: GYAE6OF01C3K9Q.21.22.B11.1.454.CMB.1.raw
  modified_base (305)..(305): a, c, t, g, unknown or other
  misc_feature (305)..(305): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccgggcagagggtcaccatctcttgttctggaggcaactccaacatacggaagtaattatgtattctggtatcagcactccaggatcggacccaactcncatccagagaatatcagccgccctcgacgggtccctagaccgtattctcgtggcctaccgaagtcgtcggcctacctcacgtccctcccgtacgacccatccgaggtcgggtcctccgggtcgaggagtggacggtctagtacttattacgtgtcgctactccggacgggacgacaacgagtgggattacgactagtcgtaggtacgggttcgggttggggtcggtaccgggacggaacgggaacctaacggtcggacccgttcgtaggtacccg

SEQ ID NO: 24210 - DNA, 648 bp, Homo sapiens
  misc_feature: GYAE6OF01EHSMG.21.22.B11.1.454.CMB.1.raw
  modified_base (348)..(348): a, c, t, g, unknown or other
  misc_feature (348)..(348): n is a, c, g, or t
  modified_base (633)..(633): a, c, t, g, unknown or other
  misc_feature (633)..(633): n is a, c, g, or t
  modified_base (635)..(637): a, c, t, g, unknown or other
  misc_feature (635)..(637): n is a, c, g, or t
  modified_base (641)..(644): a, c, t, g, unknown or other
  misc_feature (641)..(644): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgaggggtccctgaccgattctcgtggcctccaagtctggccacctcacgcctccctgaccatcagtcgggctccggtccgaggatgaggctgacttattactgtgcatcgaccggggacncaaacagtggggatacgaacaactcgtggacgggtccggggtttggggtgtttccggggacgggtaacgggaacccgtaaacgttcggaacccggttccgtaacgggtccaacggaccccgaagggcccgtccggtaccccccgtcggtccctacgttcccgttaccggtttccccccgtcccttccccgttcccgttaccggttcccttccgttaacccgttgggaacccgggtccggggtaccgttacgggaccgaacgggtcccgtaactacggttagcgcncnnncgtnnnngngn

SEQ ID NO: 24211 - DNA, 675 bp, Homo sapiens
  misc_feature: GYAE6OF01A8EJO.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggagcaactccaacatacggaagtaattatgtatttctaggtatacagccaacttccccaggaactcggacccccaaactcctacactccagaacgaataatcgacgcggccctcgacggggtccctggaccgtattcgtactggtcctaccgtaacgtcgtacggcctacccgtcgacgcccctcctacgaacccattaccgaggttccgggccgttccccgggtaccggtagggtacgttaggacgggtcgttacgaaccgtttaagttccggtagttcgactacgtacccggacggggtaccacgaacgtaggtacgggaagtacggaacctaagttccgtagggtaccgggttggggtttacggggttacggttccggggaggggtaaccgggaacccttaaacgggtccgtaacccgggttccgtacgggtaacccg

SEQ ID NO: 24212 - DNA, 660 bp, Homo sapiens
  misc_feature: GYAE6OF01BHWHC.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggcagagggtcaccatctcttgtctggagcactccaacatcggaataattatgtattctggtatcagcaactcccaggactcggacccccaaactcctcatccagaggaataatcacgcggccctcgacggggtccctgaccgtattcctcgtcggctccgaagtcgtggccacctcacgcccttccctgacccatccgaggtcgggtcctcccgggtccgaggtactcgggacggtccttaggaacctttagtttaccgtggtgacctagtcccggaaccgggggtaaccacgaaaccgtaggtcggggaacttacggaaaccgtagttcccggtagggtaacggggttccgggggttttagggggttcgggttacccgggggaacggggttaaccggggaaccccttaaaacgggttcgggaacccccgggttacggttacgggtaaccccgg

SEQ ID NO: 24213 - DNA, 564 bp, Homo sapiens
  misc_feature: GYAE6OF01DMSJG.21.22.B11.1.454.CMB.1.raw
  modified_base (365)..(365): a, c, t, g, unknown or other
  misc_feature (365)..(365): n is a, c, g, or t
  modified_base (394)..(394): a, c, t, g, unknown or other
  misc_feature (394)..(394): n is a, c, g, or t
  modified_base (514)..(514): a, c, t, g, unknown or other
  misc_feature (514)..(514): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (553)..(553): a, c, t, g, unknown or other
  misc_feature (553)..(553): n is a, c, g, or t
  modified_base (556)..(557): a, c, t, g, unknown or other
  misc_feature (556)..(557): n is a, c, g, or t
  modified_base (559)..(564): a, c, t, g, unknown or other
  misc_feature (559)..(564): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgaggggtccctgaccgattctctggctccaagtctggccacctcacgcctccctgacccatcgacggtcgggccttccccgggtccgagggtatcggacggcttaggacttattacgtgtcgccatccgacgggacncaaaccgtgtagggatcgaactaattcgnggacgtcgggttggtggtcggacgggaggacctaacgtgaccgtctaggtcacgacccaagggcctaccggccccttggcctacgtccgttcgtcccctcctccgtccctcgtctcgtcncggtcgcggtctcggcacgggcacctagtacggntnctnacnncnnnnnn

SEQ ID NO: 24214 - DNA, 623 bp, Homo sapiens
  misc_feature: GYAE6OF01DWDLH.21.22.B11.1.454.CMB.1.raw
  modified_base (321)..(321): a, c, t, g, unknown or other
  misc_feature (321)..(321): n is a, c, g, or t
  modified_base (421)..(421): a, c, t, g, unknown or other
  misc_feature (421)..(421): n is a, c, g, or t
  modified_base (471)..(471): a, c, t, g, unknown or other
  misc_feature (471)..(471): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtccgtcggggaccccccgggcagagggtccaccatccttcttgttctggaggcaactccaacatacggaagtaattatgtattcgtgtatcagcaactcccgaagaactccggaccccaaactcctnactccagagaataatcagccggccctcgacggggtccctagacctattctcgtggtacctccaacgtctcggacctacctcacgtccctcctcgacctancgtaggtcggcctacccggtcggagatgagctagacttagttactgtacnctaagtacccggacgggaccgtacaacggtagttacgggaataccggtaacaaacttcggtacggtaggggttcggggtttgggttacgggttacggggaccgggaaccgggtaaaccaaaccgttccggaacccgttcgtacgggtacccg

SEQ ID NO: 24215 - DNA, 301 bp, Homo sapiens
  misc_feature: GYAE6OF01CD4MT.21.22.B11.1.454.CMB.1.raw
  modified_base (290)..(290): a, c, t, g, unknown or other
  misc_feature (290)..(290): n is a, c, g, or t
  modified_base (295)..(301): a, c, t, g, unknown or other
  misc_feature (295)..(301): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaacgtgaccgtctaggtcagcccaaggctgccccctggtcactctgttcccgcctcctcctcgtctctactgagcggctggcaggcnatagnnnnnnn

SEQ ID NO: 24216 - DNA, 681 bp, Homo sapiens
  misc_feature: GYAE6OF01BBJQP.21.22.B11.1.454.CMB.1.raw
  modified_base (347)..(347): a, c, t, g, unknown or other
  misc_feature (347)..(347): n is a, c, g, or t
  modified_base (570)..(570): a, c, t, g, unknown or other
  misc_feature (570)..(570): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccgggcaggagggtccaccattcctcttgttccgtggaggcaactccaaacatcggaaagttaattatgttattctggtatcagccaactcccgaaggaactccggacccccaaactccctcactccaagagaaactancgacgccggtaccctcgacggggtccctgaccattcctcgtcggcctacgtaagtctacggccaccgtcacgtccctacctgacccatccgaggtcgggccctccgggtaccggaggagtacgggacgcccgttaggacctttagttaccgtgtacgctaacggttccggaaaccgggggtaccactaaacgtggtccgggaattcggaaactggttaccggnggggtaaccgggttcgggggtttaggggttccggggttacccggggaaggggtaacgtaaccccggttaaaccgtcccgggtaaacccgtttcccgggaagggtaaccccg

SEQ ID NO: 24217 - DNA, 775 bp, Homo sapiens
  misc_feature: GYAE6OF01DLG3L.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtccgtcgggacccccgggcagagggtcaccatctcttgttctggaggcaactccaacatcggaagtaattatgttattctggtatcagcaactcccaggaactccggaccccaactcctcactccaagaggaaatatacgacgccggccctcgacggggtccctagaccgtattcctcgtcggtacctacctaagttccgtacggaccctaacccttcgaaccgtccccttaccccgttacggacccctaacgtccgaaggggttcccgggtaccgttaccccggggttaccgggaacgggtacgtacgggtaacgggtccgttacggtaacctttaactttaccgttggttacgaccgtaacgttacccggaaccgggggtacccgacgtaaaccgaggttacggggaacttaacgaaaccgtaagtttcccggtaggggttaccgggggttcccgggggtttttaggggggttccggggtttacccggggggtaaccggggtaaaccggggttaaacccccgtaaaaacgggtttcccgggaaacccccgggtttacccggttaacggggtacccccgg

SEQ ID NO: 24218 - DNA, 683 bp, Homo sapiens
  misc_feature: GYAE6OF01AW2IK.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgtctggaggcaactccaacagtcggaagtattatgtattctgtatcagcaactcccaggactcggaccccaatcctcatccagaggaatatcacgcggcccgtcgggtccgtcgacgacttcgtcgtcgtctccgtacgtacgtcgctacctctcgaccgtccctcgacacctcgaggtcggtcgtccggtccggtacggtagtacggtacggtcgtacgtacttacttacgtaggtcgtcacgtacggtaccggacgggtaacctaacgtaacggtagggtaacgtacgtaacgaaaccgttacgttaccgggacggggtttacggggtttcgggggttaggggtttaccccgggggaccggggtaaacccgggggtaaacccccgtaaaaccgggttaacgggttaacccccgggttaaccccgggtttacggggtaacccggtaaccccgggg

SEQ ID NO: 24219 - DNA, 536 bp, Homo sapiens
  misc_feature: GYAE6OF01A3U1K.21.22.B11.1.454.CMB.1.raw
  modified_base (209)..(209): a, c, t, g, unknown or other
  misc_feature (209)..(209): n is a, c, g, or t
  modified_base (426)..(426): a, c, t, g, unknown or other
  misc_feature (426)..(426): n is a, c, g, or t
  modified_base (449)..(449): a, c, t, g, unknown or other
  misc_feature (449)..(449): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (506)..(506): a, c, t, g, unknown or other
  misc_feature (506)..(506): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaagtaattatgtattctggtatcagcaactcccaggactcggcccccaaactcctcatccaagaggaataatcagccggccctcgacggggtccctgaccgtattctctggctccaagtctggccacctcacgccctccctgacccatcgaggtcgggcctccgggtccgaggntggaggctgaccttaattctgtnacatccgacgggtacncaagngngggatgacatcgngnggtggtttgggtgtcgggnggacggtaaccaacgtgacccgtcgtggtc

SEQ ID NO: 24220 - DNA, 703 bp, Homo sapiens
  misc_feature: GYAE6OF01CWH65.21.22.B11.1.454.CMB.1.raw
  modified_base (214)..(214): a, c, t, g, unknown or other
  misc_feature (214)..(214): n is a, c, g, or t
  modified_base (357)..(357): a, c, t, g, unknown or other
  misc_feature (357)..(357): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagccgtcgtcggggacccccgggnaggacgggtcacctattctcttgtcgtggagcaactccaacatacggaagttaattatacgttattcgtaggtatcgagaccaactcccgaaggtaactccgaaccccctaactcctacactaccaaggaacggtaaataacncgacgccggccctacggacggggtccctaggacctattccgtcgtcggtacctaccgtaaggttcctaggaccctacctaccacggtccccttcctaccgaacctacgttcggacgggtcgggtccctccgggtccgaaggtacgtcggacggtccgttagtaacctttacgttacgtggttacgactaacggttaccggaccggggtaaccacgtaacgtaggtcgggtaatcggtaaacacgtttcgtagggacggttcgggggtttagggtacggttccggggaacggggtaacccggtaaaccctaaaccggttcgggaaccccgttcggtggggtaacccc

SEQ ID NO: 24221 - DNA, 714 bp, Homo sapiens
  misc_feature: GYAE6OF01E2JY5.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggcagagggtcacctatctcttgttctggaggcaactccaacatcggaagttaattatgtattctggtatcagcaactcccgaaggaactcggacccccaaatcctcactccaggaagtaataactcacgccgccctcgacggggtccctagaccgtattcctcgtcggcctaccgaagttcgtcggacctaccctcgaccgtccccttcccgtacgaaccctagttccgtacggggttccggggtacccgttaccccggggtaccggaaagggtacgttacggggaacggtccgttacggtaacctttacgtttaaccgtgggttacgtaccgtaacgttcccgggaaccggggtaaccgaccgtaaacgtacggtacggggtaactaacggaacttaaacgtcggtagggtaccgggttggggtttcggggttacgggttccggggaacgggaaccggtaaacccgtaacgtacccgggtaccgttaccggtaacggtacccgg

SEQ ID NO: 24222 - DNA, 600 bp, Homo sapiens
  misc_feature: GYAE6OF01BA1QX.21.22.B11.1.454.CMB.1.raw
  modified_base (210)..(210): a, c, t, g, unknown or other
  misc_feature (210)..(210): n is a, c, g, or t
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnaggaggtcaccatctcttgttctggaggcaactccaacatcggaagtaattatgtattctggtatcagcaactcccaggaatcggacccccaaactcctcactccagaaggaataatcagccggccctcgacggggtccctgaccgtattctcgtcggcctccgaagttctggccaccctcacgccctccctgaccctntcgaggtcgggcctccgggtccgaggntggacgtctagactattacngtncatcgacgggcacaacgtagtagggataggaacagttcgtaggtacgggttggggtttggggtcggtttaccggggacggggtaaaccgggtaaacccctaaacggttaccggtacccctttaccgggtaagggtaccccg

SEQ ID NO: 24223 - DNA, 701 bp, Homo sapiens
  misc_feature: GYAE6OF01DI383.21.22.B11.1.454.CMB.1.raw
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (328)..(328): a, c, t, g, unknown or other
  misc_feature (328)..(328): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccggnagngggtcaccatctcttgttctggaggcaactccaacatcggaagtaattatgtattctggtatcagcaactcccaggaatcggaccccaactcctcactccagacggaaataacncacgccggcctcgacggggttccctgaccgtattcctcgtcggcctccgtaacgtctggcctaaccctcgacggtccccttacccgtacgaaccctaagttccgaacgggttcgggtcccgttaccccgggggttaccgagggtacttgggaaccgggtccttaggtaaccttttacgttacccgttgggtacgaccgtaacgttaccggaaccggggtaccgaccgaaacgtacggttaggggtaactacggaaacctaacggttcgtaggtacggggttccggggtttggggttccgggttacggggaccggggtaacggggtaacccctaaacggttccgggtaaccccgttccggttacggtaaccccg

SEQ ID NO: 24224 - DNA, 747 bp, Homo sapiens
  misc_feature: GYAE6OF01EQAES.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggacccccgggcagagggtcaccatcttcttgttctggaggcaactccaacagtacggaagtaattatgtattctggtatcagacaacctccgaaggtaactccggacccccaaactcctcactccaagagaataactcgacggccggccctcggacggggtcccctaggtacccgtatttcctcgtcggtacctaccgtaacgttccgtacggccctacccgtaccaccgtccccttacccgtacgaaccctattccggacgggttcccggggcccttacccggggtaccggaaggtacgtcgggaacggtccgttaacggtaaccttttacgtttaccgtgggtcgtaccgtaacgttacccgggaaccggggtaccaacctaaacggtaggttacggggaacttacggtaaacctaacgttcggttagggtacgggggtttcgggggtttacggggttcgggttacccgggggaacggggtaaaccggggtaaacccctaaacggttaccgggtaaccccggttccgggtaacgggtacccg

SEQ ID NO: 24225 - DNA, 745 bp, Homo sapiens
  misc_feature: GYAE6OF01C677O.21.22.B11.1.454.CMB.1.raw
  modified_base (222)..(222): a, c, t, g, unknown or other
  misc_feature (222)..(222): n is a, c, g, or t
  modified_base (371)..(371): a, c, t, g, unknown or other
  misc_feature (371)..(371): n is a, c, g, or t
tcagtcgtcgctcgcacgaccggtgctcgatttagacgacagctcaggggggggaaggctcagcttcagctgtggtagagaagacaggactcaggacaatctccagcatggccggcttccctcctcctcctccaccctcctcactcactgcgcgagggtccgtcgggcccagtctgtgctgactcacgcccaccctcagccgtcgtccggggacccccgganacggagggtccaccatctcttgtcgtggacgacaacctacaacagtacggaagtaattatgttattcgtggtactcacgtaccaacctaccgaggtaaacgtccggacccccaaactcctacaactaccgaaggaacgtaaaattaacnccgaacggtccggacccctacgggtaccggggtccctacgaacccgtaacttccgttcgtcggtacctacgtaacgtccgtacggaccctaaccctcgaccgtcccgtacccgtacgaccgtactacgtacggtacgggtccgtacccgggtaccggtaacggacgtacggacggtacgtacgtaacgtttaacgttacgtcgtacgtactaacggtaccggaaccgggtaccgaaccgtaacgtaacggtacgggaacgttacgtaacgtacgttacggtacggtacgggttaccgggttcggggttcggtacggggtaacgggaacggtaaccggtaaacgtccggtaaaccggtccggtaacggtacccgg

SEQ ID NO: 24226 - DNA, 684 bp, Homo sapiens
  misc_feature: GYAE6OF01APQYY.21.22.B11.1.454.CMB.1.raw
  modified_base (173)..(173): a, c, t, g, unknown or other
  misc_feature (173)..(173): n is a, c, g, or t
  modified_base (208)..(208): a, c, t, g, unknown or other
  misc_feature (208)..(208): n is a, c, g, or t
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
  modified_base (326)..(326): a, c, t, g, unknown or other
  misc_feature (326)..(326): n is a, c, g, or t
  modified_base (361)..(361): a, c, t, g, unknown or other
  misc_feature (361)..(361): n is a, c, g, or t
  modified_base (383)..(383): a, c, t, g, unknown or other
  misc_feature (383)..(383): n is a, c, g, or t
  modified_base (540)..(540): a, c, t, g, unknown or other
  misc_feature (540)..(540): n is a, c, g, or t
  modified_base (607)..(607): a, c, t, g, unknown or other
  misc_feature (607)..(607): n is a, c, g, or t
tcagtcgtcgctcgcacgaccggtgctcgatttagacgacagctcagggggggaaggcgtcagcttcagctgtggtagagaagacaggactcaggacaatctccagcatggccggcttccctctcctctccaccctcctcactcactgcgcagggtcctgggcccagtctgtnctgactcagccacctcagcgtctcgggaccccggnagacgggtcaccattctcttgttctggacgcaactccaantcgaagtattactgtattctggactcancaactccgaggaactcggacccccaaactcctcactccagacgaataacncacgcggtcccagcgggtaccctgaccgtagttcncgtcggcctcgaacgtcggtcncctaacctcaccggtcctccctcggacctacgcgaacgggttcggcccgttccgggaccggtaaggtaccgttaggaaccggggtccttaggaaccctttaagtttcccttgggacgtccgaacgtcccggaaacgggggtacccacgtaaaccggngtttacggggaactccggtaaagtaaaccttccggttaaacggggtcggacgggggtttttcggggngggtttaccccgggaaccgggtaacggggaaaaccccgtaaagttcccgggtaaacccgtgggttaaccgggtaccc

SEQ ID NO: 24227 - DNA, 539 bp, Homo sapiens
  misc_feature: GYAE6OF01D9SJI.21.22.B11.1.454.CMB.1.raw
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (321)..(322): a, c, t, g, unknown or other
  misc_feature (321)..(322): n is a, c, g, or t
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
tcagtcgtcgctcgcacgaccggtgctcgattttagacgacagctcgagggggttccggtgaccgatctctggcgtccaagtctggcacctcagccgtccctgaccatcagtgggctccgtccgaggatgacgctgactattacgtgtgcatctacgggtacgcaacattgggaatgacctaattctgtacgtcgggttggtgttcggcggagggaccaacgtcgaccgtctaggtcacgccgaaggctcgccccgtggtcactcgtcgttccgtcctcttcctcgtactctactcgacgcggctcgcaggcncatgnagnncgntgctgctnctgcgagtcgngtncgatnactctagctcgctgaaccgntcgnctnagtctactnaaggtctntacggtatctatatctacgtctcgtcgtacgtacgtacgtacgtacgtacgtacgacgtacgtacgtacgtacgtcgtcgacgtacgtacgtacgtacgtacgtacgtcgtactcctacgtccgtcgtacgtctcgtcgtacg

SEQ ID NO: 24228 - DNA, 856 bp, Homo sapiens
  misc_feature: GYAE6OF01CZK6C.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcacgcgtctcggggaccccggcaggacgggtcaccatctcttgttctaggacgcaactccaacagtacggaagttaattatgttattcttggtatcacgactaactcccgaggaaactccggaaccccctaaactccctactaactaccgaaggaaggtaaaactaacgtaccgacggaccccggtcccccgttaggaaccgggggttccccttaccggaaccgttacgtttcccgttacggtttaccgggaccctttacccggtaaacggtttccgtaccgggtaccctaaacccgttccgaacccggtccccttacccccgttaggtaaacccccgttagtttaccccggaagggtttcccggggaccccggtttacccccggggaaccgggttaaggtacgttcgggaacgggttacgtaccggttaaccgtttaacgttttacgtcggtaggtaccctacggtacccgggtaaccggggaaccgaccgtaaacggtagttaccgggggaattacggtaaacctaacggttcgttacggggaaacggggtttccggggtttagggggttacggtttacccggggggaacccgggtaaacggggttaaaaccccgtaaaccggtttcccgggtaaaccccggttcgggtaaccggttaccccggg

SEQ ID NO: 24229 - DNA, 695 bp, Homo sapiens
  misc_feature: GYAE6OF01DZCVV.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggcagagggtcaccatctcttgttctggaggcaactccaacatacggaagtaattatgtattctggtatcagacaacctcccaggaatccggaccccaaactcctcactccagagaataatcagccggcctcggacgggtccctgaccgtattccgtctcggcctaccgtaagtcgtggcctacctcacgtccctcccgtacgaccctagttccgacgggttcgggtccctacccggggtacggaacgggtatcgggacggtcttacgggtaacctttacgtttaccgtggttacgaccgttaacgtacccgggaaccggggtaccgaaccgtaaaccgtaaggttacggggaacttacggaaactagttcgtagggtacgggttcgggggtttaggggttccgggttacggggaccggggtaaaccgggtaacccgtaaaaccgggttccggtaaaccccgggttcccggttaaggtaaccccgg

SEQ ID NO: 24230 - DNA, 753 bp, Homo sapiens
  misc_feature: GYAE6OF01AI7Q9.21.22.B11.1.454.CMB.1.raw
tcagtcgtcgctcgcacgaccggtgctcgatttagacgacagctcaggggggggaagctcagcttcagctgtggtagagaagacaggacctcaggacaatctccagtcatggccggcttccctctcctcctcaccctcctcactcactgcgcagggtcctgggcccagtctgtgctgactcacgccaccctcagcgtctcgggacccccggcaggacggtccaccgattccttcttggttccgtggacggccaacctccaagactaccgggtaaagtaatttatggttattctaggtatcagacaactcccaggactcggacccccaaatcctcactccagagataatcgagccggacctcgacggggtccctgaccgtattccgtcgtacggtcctacctaacgtcgtcggacctaccctcgaccgccccttccccgtagacccctagttacgcggggttcgggccttacccggggtaccggaaggtcgtcggtaacggtcccttaggtaactttacgtttaccgtggttaccgaccgtagttacccggaacggggtacccaacgtaaaccggacggtttacggggaacttacggaaaccgttaaacgtcgggttaagggtaaccgggtttccggggggtttaacggggtttccgggggttaaacccggggacggggttaaacccccggggtaaacccgtaaacgggttcccgggtaaacccccgggttccgggtttaaccgggaaccccgg

SEQ ID NO: 24231 - DNA, 685 bp, Homo sapiens
  misc_feature: GYAE6OF01BHFVQ.21.22.B11.1.454.CMB.1.raw
  modified_base (671)..(671): a, c, t, g, unknown or other
  misc_feature (671)..(671): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
  modified_base (680)..(680): a, c, t, g, unknown or other
  misc_feature (680)..(680): n is a, c, g, or t
  modified_base (682)..(682): a, c, t, g, unknown or other
  misc_feature (682)..(682): n is a, c, g, or t
  modified_base (684)..(685): a, c, t, g, unknown or other
  misc_feature (684)..(685): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgaggggtccctgaccgattctctggctccaagtctggcacctcagcctccctgaccatcaggtcgggcctccgggtccgaggatgggacgtcgtacgtacttacgttacgtgtcgactacgtaccggaccgggacaaccaacgtagggtaggtactacgaactaacgttcgtagggtacgggttcggggtttgggttacgggtaccggggacggggtaaccgggaaacctaacggttaccggtacccgttacggtacggtacgaacccggaccggtaacggtcccgtccccgtcccccgttcggtacccgtaccgttccgttccccgttacccccctaccccgttccccttcccgttcccgttacccttaccgttaccgtcgggtaccggggccgggtcggtaccgggtaaccggaccgggtccgacgtacggtacgtgactncgncncngncngnn

SEQ ID NO: 24232 - DNA, 555 bp, Homo sapiens
  misc_feature: GYAE6OF01AHAKS.21.22.B11.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
  modified_base (482)..(482): a, c, t, g, unknown or other
  misc_feature (482)..(482): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaanatcggaagtaattatgtattctggtatcagcaactcccaggaatcggacccccaaatcctcactccagaaggaataatcagccggccctcgaggggtccctggacccgtattcgtctggcctccaagtctggcctaacctcagccctccctagacccatcaggtcgggcctccgggtccgaggatgagggctgacttattactgtncaatcgaacgggnacaacatgggatcgganactcgtgacggtcggttagggtcggttccgggaggacgggtaacccaacgttacgaccgttccgtaggtaccg

SEQ ID NO: 24233 - DNA, 773 bp, Homo sapiens
  misc_feature: GYAE6OF01BRORL.21.22.B11.1.454.CMB.1.raw
  modified_base (218)..(218): a, c, t, g, unknown or other
  misc_feature (218)..(218): n is a, c, g, or t
  modified_base (287)..(287): a, c, t, g, unknown or other
  misc_feature (287)..(287): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcacgcgtccgtcggggaccccccgggnacggacgggtccacctattcctcttgttcgtgggacggccaactccaacagtacggaagttaattagtntattcgtaggtatcagacaacctccgaaggactccggaccccctaaactcctacacgtaccaaggaacggtaaactaaacgtcgacggtacccggtccccgttacgggaccggggttccctacggaccgtactttacctcgtcggtacctacgtaacggttccgttacggcctaaaccctccgtaaccggtccccttaccccgttaccggacctacggttaccggtaacgggtccgggtacccgtcccggggtaccgggtaaggacggttcggaacgggtccgtacggttaaaccttttcggtaacgttcgtcggaacctacgggtacccggaaccggggtaccgaaacgtaccgtaaggtacgggtaactacgaaccgtacgttaccgtaggggtaaccgggttcgggtttcgggggttcggtacgggacccggggaaacggtaaccgtaacccggtacgggtaccccgttacggtcggtacccg

SEQ ID NO: 24234 - DNA, 564 bp, Homo sapiens
  misc_feature: GYAE6OF01CFTOF.21.22.B11.1.454.CMB.1.raw
  modified_base (207)..(207): a, c, t, g, unknown or other
  misc_feature (207)..(207): n is a, c, g, or t
  modified_base (241)..(241): a, c, t, g, unknown or other
  misc_feature (241)..(241): n is a, c, g, or t
  modified_base (406)..(406): a, c, t, g, unknown or other
  misc_feature (406)..(406): n is a, c, g, or t
  modified_base (432)..(432): a, c, t, g, unknown or other
  misc_feature (432)..(432): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcgggaccccggnagaggtcacatctcttgtctggagcaactcaacntcggaagtattatgtattctggtatcagcactccaggaactcggaccccaactcctcatccagagaataatcagcgccctcgacgggtccctgaccgtattctcgtgctcaagtctcgctacctcacgtccctccctagaccatcgaggtcggctcccggtacgnggtactggacgctagacttatacgtntcgctacgtacgacgggtacacaacgtgtagggatcggtacaagttccgaggtacgggttcgggttaggggttggttccggggagggtaaacgggaccctaaacggtcggttacccgtcggtaggtaccccg

SEQ ID NO: 24235 - DNA, 649 bp, Homo sapiens
  misc_feature: GYAE6OF01DA3ZR.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnaggagggtcaccatctcttgttctggaggcaactcaacatacggaagtaattatgtattctggtatcagcaactccaggaatcgaccccaactcctcactccagacgaatatcagccgccctgacgggtccctgaccgtattctctgctccaagtctggcacctcacgtccctcctagaccctatccagggttcggtccgtcccgggtacgaggatggacggtctagtaacctttattacgtggtacgacctaacgttccggaaccgggggtaccaccgtaaaccgtagggttacggggtaacttacgggaaacctaaacgttccgtacgggtaacgggttccgggggttttagggggtccggtttaccgggggaccgggtaacggggtaaacccctaaacggttccggtaaccccggttccggttaacgggtacccg

SEQ ID NO: 24236 - DNA, 304 bp, Homo sapiens
  misc_feature: GYAE6OF01A5Y2M.21.22.B11.1.454.CMB.1.raw
  modified_base (293)..(293): a, c, t, g, unknown or other
  misc_feature (293)..(293): n is a, c, g, or t
  modified_base (299)..(304): a, c, t, g, unknown or other
  misc_feature (299)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccgccctcctcctcgtctctactgacgcggctggcaaggcncatagnnnnnn

SEQ ID NO: 24237 - DNA, 580 bp, Homo sapiens
  misc_feature: GYAE6OF01E2KY9.21.22.B11.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggaccccaactcctcatccagagaataatcagccggccctcgacggggtccctcgaccgtattcctctacggcctaccgaagttccgtggccaccctcgaacgtcccttcccctagaccctataccgaggtcgggcctccgggtccggagactggaacggcttaggaccttagttacctgtcgctagtcgaccgggacacaacgtgtcgggatcgaactaatccgttggacgttgggttcgggtgttcgggacggaacggtaccctaaagtgacccgtcgtaggtaccg

SEQ ID NO: 24238 - DNA, 797 bp, Homo sapiens
  misc_feature: GYAE6OF01BXTCS.21.22.B11.1.454.CMB.1.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccggnagagggtcaccattctcttgtctggagcaactcaanatcggaagtaattatgtattctggtatcagcaactccaggaactccggaccccaaactcctacactacccgaagaacggtaaattaacgtccgaacggccccgggaccccttacggaccgggggttacccctacgggaaccccgttactttcccgtacgtacgggacccttaccgaaacggttccgtagggtaccctaacccgtccgtaaccggccccctttaccccggtacgtaacccgtaacgttcccgtacggggttccggggtaccccgtttccccggggttacccgggaagggttacgtaccgggtagggtacccgttacggtaaccttaacgtttttacggacggtttcgtaacccttaacggttacccggaaacccgggggacccgtaaccgtaaaccgtaagggtttacgggggaacttaacgggaaaccgttaaacggttacccgtaaggggtacccggggtccgggggttaccgggtttaccgggggaacggtaaaccgggggaccgtaacccgtaaacggttacggactccgtaggtacccg

SEQ ID NO: 24239 - DNA, 766 bp, Homo sapiens
  misc_feature: GYAE6OF01ERBNM.21.22.B11.1.454.CMB.1.raw
  modified_base (193)..(193): a, c, t, g, unknown or other
  misc_feature (193)..(193): n is a, c, g, or t
  modified_base (216)..(216): a, c, t, g, unknown or other
  misc_feature (216)..(216): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctcgggcccagtctgtgctgactcacgcccaccctnacgcgtcgtccggggaccccggnaggacggtcaccatctcttgtcgtggacggacaactccaacagtacggaagttaattatagttattcgtaggtatacgacacctaactacccgaaggtaactccggaccccctaaacgtcctacactaccgaagaaggtaataactcgacggccgtcccgtaccgtacgggtccctacgaccgtacttcgtcgtcgtaccgttaccgtaggtacgtcggacctaccctcgtaccgtccctacccgtacgaaccgtcgtacgtagggtccgggtcccgtacccgggtacgggtaacggtcgtacgggtacgtaccgtacgttaaccgtttacgtttaaccggttcgtacgtaccgtaccgtaccgggtaaccggggaacctaccgtaaaccgttagggtacggggtaacgaacggtaaaccctttacggtacggttaccggggtacggggttaccgggttttcggggttaccgggttaccggggaaccgggttaaccggtaaaccgtaacggttacccgggtaaccccgggttacgaccggggttaaccgg

SEQ ID NO: 24240 - DNA, 582 bp, Homo sapiens
  misc_feature: GYAE6OF01CJ6YA.21.22.B11.1.454.CMB.1.raw
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (432)..(432): a, c, t, g, unknown or other
  misc_feature (432)..(432): n is a, c, g, or t
  modified_base (482)..(482): a, c, t, g, unknown or other
  misc_feature (482)..(482): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccggcagagggtcaccatctcttgtctggagcaactcaacatcggaagtaattatgtattctggtatcagctaactcccaggactcggcccccaaatcctcactccgagagtaatancagccgccctgacggggtccctgaccgtnttcncgtggcctacgaagtcgtacggccacccgtcacgccctccctgaccctatcgaggtcggccttccgggccgaggtntcggacggtctacggtacttacgtactggtacgcacgtcgaccgggtacnccaacgtagcggaatcgaactatccgtaggcggttcggggttgggttcggtccgggacgggtaacggaacccgtaacgcggtaccccgtgtacgggaccg

SEQ ID NO: 24241 - DNA, 740 bp, Homo sapiens
  misc_feature: GYAE6OF01CRXHM.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggaccccggnagagggtcacatctcttgtctggagcaactccaacagttacggaagttaattagtgtaattcgtaggtatacgacgacgaacctaccgaagtaaccgtccggaaccccctaaacttccacctactaccgtagaacggtaaataacgaccgacggtccggtaccccttacggaccggggttccccgtagtacccggtaactttccgtccgtacggtaccctaccgtaacgttctacgggaccctacgttaccgacgtcccctaccctacgaaccgtacgtacgtacggttcgggtacccgttaccgggtacccggaaggtacgtacggaacggtcctaacggttacgtaacttacgtcgtacgtactacgtaccggaaccgggtaacctacgaagttacgaggaactacgtacgacgttacgtacgggaacgggtttcgggttagggttccggggtaccgggaaccggggtaaacggtaaacccgtaaccgggttaacgggtaacccggttacccgtaagggtaaccccgg

SEQ ID NO: 24242 - DNA, 811 bp, Homo sapiens
  misc_feature: GYAE6OF01CHD2E.21.22.B11.1.454.CMB.1.raw
  modified_base (224)..(224): a, c, t, g, unknown or other
  misc_feature (224)..(224): n is a, c, g, or t
  modified_base (454)..(454): a, c, t, g, unknown or other
  misc_feature (454)..(454): n is a, c, g, or t
  modified_base (626)..(626): a, c, t, g, unknown or other
  misc_feature (626)..(626): n is a, c, g, or t
tcagtcgtcgctcgcacgaccggtgctcgatttagacgacagctcgaggggggggaagctcagcttcagctgtggtagagaagacaggactcaggacaatctccagcatggccggcttcctctcctcctccaccctcctcacctcactgcgcgacgggtccgtcgggcccagtctgtgctgactcacgcccacctcgacgtccggtcgtaccggggaccccggngacggacggtccaccattcttgtttcgttcgagggacgaccaacctaccgaaacagttacggtaaagtttaacttgttagttacgttgtaggttactacgacgaccaaccgtccgaaggaaccgtacccgaccccctaaactcctacaactaccggaagtaacggtaaactaacgtccggaccggcccggtacccgtacgggtacccggggtccctaacggtaacccgtntttccgtaccgtcggtacccttacgaacggtttccgaccggtaccctacccgtacctacccgtaccccgttacccgtacgaaccctacgtaccggtacggggtccgggtcccgttaccggggaccggtagggtcgacgggtacgtaccgttacgtaacgtttactacgggtntaaccggcgtaaccggtccgggaaccgtaacccgaacgaacgggttagggacggtactaaacggtaccttaaggtccggttaagggtccggggttcggggttaggggttacccggaccgggggaacgggtaaaccgtaaaccggttaaccgtacccgggtacccgttccgggtaccggtaaccgg

SEQ ID NO: 24243 - DNA, 742 bp, Homo sapiens
  misc_feature: GYAE6OF01B7JC7.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactcccaggaactcggaccccaatcctcactaccagaaggaataactcagccggtccctcgacggggtccctagaccgtattccgcgtcggtcctacgtaacgtcctacgggcctaacccgtcgaccgtccccttaccccgtaggaacccctattcccggtaacggggttcggggtacccgtttacccggggtacccggaagggtacgttacgggacggtcctacggtaacctttaacgtttaccgttggtcgaccgtaacggttcccggaacgggggtacccgaacctaaacggtaggttaggggaaacttacggaaccttaaacggtaccggttaggggtaccgggtttccgggggtttacgggggtttcgggttacccgggggaacggggaaccggggtaaacccttaaaacccggttcccggggtaaccccgggtttaaccggtcggggtaaccccg

SEQ ID NO: 24244 - DNA, 743 bp, Homo sapiens
  misc_feature: GYAE6OF01EKO93.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggcagagggtcaccatctcttgtctggaggcaactcaacatcgaagtattatgtattctggtatcagcaacctccaaggactcggacccccaaactcctacactcctagaacggaataactcacgccggtacccctcgaccgggggttccctggtaacccgtatttcctccgttacgggtccctaccgtaaacggttcctacgggtcccaaccctaccgtaccgtccccttcccgtacgaaccctactccggtaacgggtcgggtcccgttacccgggtaccggtaagggtacgtcgggtaacggtacccgtaagttaacccgtttaattttaacccgtgggttacgaccgttaacgttacccggaaccggggggtaccgtaccgtaaaaccgtgggtaacgggtacgtacgaaaccgttaacgtccgttacgggtacggttcgggggtttacgggttccggggtttacgggacggggtaaccgggtaaaccgaaacggttcccggtaacccgggttccggttacgggtaaccccg

SEQ ID NO: 24245 - DNA, 549 bp, Homo sapiens
  misc_feature: GYAE6OF01BIT8V.21.22.B11.1.454.CMB.1.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (452)..(452): a, c, t, g, unknown or other
  misc_feature (452)..(452): n is a, c, g, or t
  modified_base (467)..(467): a, c, t, g, unknown or other
  misc_feature (467)..(467): n is a, c, g, or t
  modified_base (489)..(489): a, c, t, g, unknown or other
  misc_feature (489)..(489): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggagcaactccaanatcggaagtaattatgtattctggtatcagcaaatcccaggaatcggacccccaaactcctcatccagagaataatcagcgccctcgacggggtccctgaccgattcctcgtcggctaccaacgttcctaggccacctccgacgccctccctgacctatcgaggtcgggcctccgggccgaggctggagtctgacttattactgngcagtcgacgggacncaactagtggatgaacacgtgngtcggtcgggttgggtcgttcgggacggacgggaccaaagtcggaccgtcgtggtacccg

SEQ ID NO: 24246 - DNA, 714 bp, Homo sapiens
  misc_feature: GYAE6OF01E3CRB.21.22.B11.1.454.CMB.1.raw
  modified_base (207)..(207): a, c, t, g, unknown or other
  misc_feature (207)..(207): n is a, c, g, or t
  modified_base (307)..(307): a, c, t, g, unknown or other
  misc_feature (307)..(307): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgatgactcagccacctcagcgtctcgggaccccggnagagggtcaccatcttcttgttctggagcaactccaaacatacggaagtaattatgtattcgtggtatcagcaactcccaggaatccgaccccaactccncatccagagaatatcacgccggcctcggacggggtccctacgaccgtattctcgtcggacctacgaacgtctcgggacctacccgtcaccgtcccctacccgtgaaccctacgtccgtacgggttccggggtcccgttcccgggtaccgggaacggtagtcggacggtcgttacgtaaccgtttagtttaaccgttggtacgcctaacggtacccgggtaaccgggggaaccgaaccgtaaacgtacgggtacgggtaacttaggaaaccttaaaggttcggttacggggtaacggggtttcggggggtttggggtttccgggttacccgggggaaccggggtaaaccggggtaaaccctaaacgggtaccccgtaacccggggtttcccgtaagggtacccccggg

SEQ ID NO: 24247 - DNA, 574 bp, Homo sapiens
  misc_feature: GYAE6OF01BXX8C.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccggnagagggtcaccatctcttgttctggagcaactccaacatcggaagtaattatgtattctggtatcagcaactcccaggaatcggacccccaaactcctcatccagaggaataatcagccgccctcgacggggtccctggaccgtattcctcgtggcctccaagtctggccacctcacgccctccctgacccagtccagggtcggcccgtccgggtaccgaggactcggacggtctagacttattacgtgtcgacataccgacgggtacgacaacgtaggtacggatagaactaagtcgtaggacggtcgggttgggttcgttcgggacgggacggaaccaacgtcggacccgtcgtaggtacccg

SEQ ID NO: 24248 - DNA, 875 bp, Homo sapiens
  misc_feature: GYAE6OF01B3DCV.21.22.B11.1.454.CMB.1.raw
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtccgtggcccagtctgtgctgactcacgcccaccctcacgcgtccgtccggggaccccggnaggacggtccaccnttctctttcgtcgtggacgaccaacctccaagacgtacggtaagttaattagtgttacttcgtaggtatacgacgtacctaaccgtacccgaaggtaaccgtacccggaaccccccctaaacgttcccctaccgtaacgtacccggtaaaggtaaacggtaaaacttaaccggtaccgtaacgggcccccgggttaccccttaccgggtacccggggttacccctacggtaacccgttactttcccgtacggtccgggtaccctaacccgttaaggttcccgtacggaccctaacccgttccgaacccgttcccccgtaaccggtacgtaacccctaacggttcccggtaacggggttccccggggcccgtttaaccccggggaacgtaagggtacgttacgggaaccgggtaccttaacgtaccgttttaaaccgttggtccggtaacaccgttaccgtaaccggggaccggtacgtaacgacgtaggtacgggtaactaccgtaaacgtacgttcggggtaggtaacggggttcccgggggtttagggtttacccgggacccgggggaaaccggtaaacccggggtaaaccgtttaacccggtaccgggttaacccccggttaacggtaggggtaaaccccccg

SEQ ID NO: 24249 - DNA, 627 bp, Homo sapiens
  misc_feature: GYAE6OF01BBTHW.21.22.B11.1.454.CMB.1.raw
  modified_base (211)..(211): a, c, t, g, unknown or other
  misc_feature (211)..(211): n is a, c, g, or t
  modified_base (309)..(309): a, c, t, g, unknown or other
  misc_feature (309)..(309): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagtcaccctcagcgtcgtcgggacccccgggnaggagggtcaccatctcttgttctggaggcaactccaacatcggaagtattatgtattcgtagtatcagcaactcccaggactcggaccccaactccncactccagagaatactcgacgccggccctcgacggggtccctaggaccgtattcctcgtacggccttaccgaacgttccgtcggacctacccgtcaaccgtccccttacccgtacgaacctacgtcgtacgggtcgggtcccgtcccgggtcgaggactggacggtctagacttacgttacgtgtcgactacgtaccggaaccggggtacacgaaacgtagtacggtagtagaacctaatcgtaggtaccgggtgggttcgggttcgggtcgggacgggaacggtaacctaaacggttcggacccgtcgtacggtccg

SEQ ID NO: 24250 - DNA, 552 bp, Homo sapiens
  misc_feature: GYAE6OF01EYWSS.21.22.B11.1.454.CMB.1.raw
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (540)..(542): a, c, t, g, unknown or other
  misc_feature (540)..(542): n is a, c, g, or t
  modified_base (544)..(552): a, c, t, g, unknown or other
  misc_feature (544)..(552): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgaggggtccctgaccgattctctggcctccaagtctggccacctcacgccctccctgacccatccaggtgggcctccggtccgaggatggaggctgactattactgtgcatcgacgggcncaacngtgggatgacaatctgagtcgggttgggtcgttcgggcgggaacgggaccaacgtcgaccgtctaggtcacgcccgaaggcctccgcccccgtcggtccaccgttccgtccgttcccccaccccttccctcccgttccgtcctccgtaccgtcgacggccgggctcggccgaaggccgctagtacgnnncnnnnnnnnn

SEQ ID NO: 24251 - DNA, 566 bp, Homo sapiens
  misc_feature: GYAE6OF01ATBSJ.21.22.B11.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (503)..(503): a, c, t, g, unknown or other
  misc_feature (503)..(503): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggagcaactccaanatcggaagtaattatgtattcgtggtatccagccaactcccaggaatcggcccccaaatcctcatccaagaggaaataatcagccggccctacgacgggggttcccctggaccgtattccgtcgtggcctccgaagttcctggtacccacctcacgccctccctgacccatcaggtcgggacctccgggtcgaggatcggaggctgaactattactgtgctagtccgaacggggccacaacgagtgggatgactaancgtgacggtgggttggtggtccgggaggacgggtaacccaaggtccggacgtccgtggtaccg

SEQ ID NO: 24252 - DNA, 723 bp, Homo sapiens
  misc_feature: GYAE6OF01BJML6.21.22.B11.1.454.CMB.1.raw
  modified_base (350)..(350): a, c, t, g, unknown or other
  misc_feature (350)..(350): n is a, c, g, or t
  modified_base (714)..(714): a, c, t, g, unknown or other
  misc_feature (714)..(714): n is a, c, g, or t
  modified_base (719)..(719): a, c, t, g, unknown or other
  misc_feature (719)..(719): n is a, c, g, or t
  modified_base (721)..(721): a, c, t, g, unknown or other
  misc_feature (721)..(721): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaaaatcggaagtaattatgtattctggtatcagcaactcccaggaatcggacccccaaactcctcatccagaggaataatcagcggccctcgacggggtccctgaccgattctctggctccaagtctggcacctcagcctcctgaccatcgagtcggcctccggtcgaggatggaggctgactattactgtcgcatcgacgggacacaacngtgggactagaacaatcgtaggaggtcgggtttggggtcgttccggggacgggtacgggtaacccgtaaacgttcgggaacccgttaccggttacggtaccgtaaccgaccccggtaacgggtcccgttaccggtaccccccccgtttgggtacccctacccgtttccccgtttacccgggtttacccccccctaccccgttaccccccgttttccccgttacccgtttaccccgttttaccgttaaccccgttcggggtaaacccgggttccccgggggtaccgttaccggggggaacccgtaaaccgggggttaccccggcccggtaaacgttaccgggacttcgaccggtcgcgacgcgcncagcngngc

SEQ ID NO: 24253 - DNA, 605 bp, Homo sapiens
  misc_feature: GYAE6OF01AM5O9.21.22.B11.1.454.CMB.1.raw
  modified_base (227)..(227): a, c, t, g, unknown or other
  misc_feature (227)..(227): n is a, c, g, or t
  modified_base (342)..(342): a, c, t, g, unknown or other
  misc_feature (342)..(342): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (597)..(597): a, c, t, g, unknown or other
  misc_feature (597)..(597): n is a, c, g, or t
  modified_base (599)..(605): a, c, t, g, unknown or other
  misc_feature (599)..(605): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaactcctcatccagaggaataatcagcggccctnagggggtccctgaccgattctctggctccaagtctggcacctcagcctccctgaccatcaggtggcctccggtccgaggatgaggctggactattactgtcgcatcgacgggacncaacagtgggatgaactaatcgtaggacgtcgggttgggtcgttcgggacgggtaacgggacctaaacgtcggaccgtaccgtaggtaccgacgacccgaaggcctacccgcccccgttcggtaccctaccgttccgttccggttccccctaccccgttcccgttccccgttcccgttcccttaccgtacccgttgggaaccggtccggggtcgtacgggaccgacgggtccgtaccgtaagtacgctancngcncnnnnnnn

SEQ ID NO: 24254 - DNA, 773 bp, Homo sapiens
  misc_feature: GYAE6OF01CMAY7.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcgaggggggggaagctcagcttcagctgtggtagagaagacaggactcaggacaatctccagcatggccggcttccctctcctcctcaccctcctcactcactgcgcgagggtcctgggcccagtctgtgctgactcacgccaccctcagcggtcgcggggaccccgggnacggagggtccacctattctcttgttcgtggacggcctaaactaccaaactacgtacggtaaagttaatttagttaggttaatttcgttagggttaactcgaacgacctaaacctcccgaacggaacgttccggaaccccctaaaactcccttacaacctaccgaaaggaacggtaaattaacgtaccgaacggaccgggtcccctacggtaaccggggggttaccctacggaacccgttacttccgtacgtcgggtacccttacgtaacggttcgtacgggaccctaaccgttccaacgtccccgtacccgtacgtaacctacgtacgtacgggttcggggtcccgttaccgggtaccggaggtacgtcggtacggcctaggtacttagtttacgtcgttacgctacggtaccggaacggggtcctaacgtaaacgaagggtcgaacgtagtaactaacggttcggtaggacgggttaccggggtttggggtcggttaccgggggacgggtaacggggaaccctaaacggttgggaaccccttcgggtacggtaccgg

SEQ ID NO: 24255 - DNA, 724 bp, Homo sapiens
  misc_feature: GYAE6OF01CSOPK.21.22.B11.1.454.CMB.1.raw
  modified_base (211)..(211): a, c, t, g, unknown or other
  misc_feature (211)..(211): n is a, c, g, or t
  modified_base (711)..(711): a, c, t, g, unknown or other
  misc_feature (711)..(711): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctgggcccagtctgtgctgactcacgccaccctcagcgtcgtcgggaccccggnagagggtccaccatcctcttgttctgggacgcaacctccaaacagtacgggtaaagttaatttacgtgttaactttcgtaggttaactcgaacggccaaacctccccgaagggtaactccggtacccccaaactcctacactccgaaggaaggaaactaactcgacgccggaccctcggaccggggttccctacgaacccggttattccgtcgtcgggtacctaccgtaaacggtccgttcgggaccctaacccgttccgtaaccggtcccccttcccccgtacggtaacccctacggttacccgtacgggggttcccggggtccccgttaccccggggtacggacggtacgtcggtacggtcgtacgtaactttacttacgtagtcgtaccacggtaccggaaccgggtacgaccgtaaacgagggtcgggaaatcgaaactacgttcggtacggtacggtggggttacgggtcggtacgggacgtaacggaccgtaancggactcgtgccg

SEQ ID NO: 24256 - DNA, 378 bp, Homo sapiens
  misc_feature: GYAE6OF01DZ5US.21.22.B11.1.454.CMB.1.raw
  modified_base (189)..(189): a, c, t, g, unknown or other
  misc_feature (189)..(189): n is a, c, g, or t
  modified_base (306)..(306): a, c, t, g, unknown or other
  misc_feature (306)..(306): n is a, c, g, or t
  modified_base (309)..(310): a, c, t, g, unknown or other
  misc_feature (309)..(310): n is a, c, g, or t
  modified_base (313)..(313): a, c, t, g, unknown or other
  misc_feature (313)..(313): n is a, c, g, or t
  modified_base (317)..(378): a, c, t, g, unknown or other
  misc_feature (317)..(378): n is a, c, g, or t
tcagtcgtcgctcgcacgaccggtgctcgattttagacgacagctcagggggtccctgaccgattctctggctccaagtctggcacctcagccctccctgaccatcagtgggctccggtccgaggatgaggctgactattactgtgcatcacgggacgcaacatgggatgacaatctgagcggttgggngttcggcgagggaccaaactgaccgtctaaggtcagcccaaaggctcgcccccctggtcacttctcgttacccgccctcctcctcgtctctactgagcggctggcaaggcgtcatgngcnnganctgnnnnnnnnnnnnnnnnnnnnnnnnnnnnnnnnnnnnnnnnnnnnnnnnnnnnnnnnnnnnnn

SEQ ID NO: 24257 - DNA, 682 bp, Homo sapiens
  misc_feature: GYAE6OF01C33H0.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccgggcaggagggtcaccatctcttgtctggaggcaactccaacatacggaagtaattatgttattctggtatcagcaactccaggaactcggaccccaactcctcactcagaggaataatcagccggccctcgacgggtccctacgaccgtattcctcgtcggtctacctaagtcgtcggcaccgtcacgtccctaccgtcgaccctactcgaacgggttgggcccgttccgggaccgaggtacgtggacggtcgtacgtacttagttaccgtgtacgtctaacggttccgaaccggggaccaaccgtaaccgtaggtcgggtaacgttacggaactaaacggttcgtacgggtaacggttcccggggggtttggggtttaccgggttaccggggtacccggggtaaacgggggttaacccccaaaaacgggtttccggtaacccccggggtttcgttaaccggggtaacccggg

SEQ ID NO: 24258 - DNA, 682 bp, Homo sapiens
  misc_feature: GYAE6OF01A2YF1.21.22.B11.1.454.CMB.1.raw
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccccggcaggagggtcaccatctcttgttctggaggcaactcaacatcggaagtaattatgtattctggtatcagcaacctcccgaaggaatcggacccccaaactcctcatccagagaataacncagccgacctcgacggggtcccngaccgtattcgtcgtcggctaccaagtcctcggctacctcacgcccttccctgacctagtcgacggtcgggtccgtcccgggtaccgaaggtctgggacggtcctaggtaactttaactttacgtggtacgaccgtagtacccggaaccggggaaccgacctaaacgtaggttacggggaattaccgggtaaactacgttccggttagggtaaccgggggttcggggttttgggggtcgggttaccgggggacccgggggaaaccggggtaaccccgttaaaacggttcccggggtaaacccccggttaccggttaacggggtaaccccg

SEQ ID NO: 24259 - DNA, 615 bp, Homo sapiens
  misc_feature: GYAE6OF01BHH16.21.22.B11.1.454.CMB.1.raw
  modified_base (209)..(209): a, c, t, g, unknown or other
  misc_feature (209)..(209): n is a, c, g, or t
  modified_base (338)..(338): a, c, t, g, unknown or other
  misc_feature (338)..(338): n is a, c, g, or t
  modified_base (501)..(501): a, c, t, g, unknown or other
  misc_feature (501)..(501): n is a, c, g, or t
  modified_base (527)..(527): a, c, t, g, unknown or other
  misc_feature (527)..(527): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccggnaggacgggtcaccatctcttgttctggaggacaactccaacatcggaagtaattattgtattctggtatcagcaacctccgaggaactcggaccccctaactcctacactaccgagaacggtaataacncgacgccggtccctacggacgggttccctacggacccgttacttcgtacgtcggtcctacgtaacgtctcggcctacctacgaccgtcccttccgcgtaacctagtccgtaggttcgggcccttcgggaccgaggactacgggcgtaccgtgacttattacgngtgacacgtccggaacggtccacagngtaggtactcgaactcgtcgtagggtacgtgggttagggtcggtcgggacggacggtaaccaacggttagacccgttcgtaggtcccg

SEQ ID NO: 24260 - DNA, 824 bp, Homo sapiens
  misc_feature: GYAE6OF01EEP7S.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnaggagggtcaccatctcttgttctggaggcaactccaacatcggaagtaattatgtattctgtatcagcactccaggaactcggaccccaactctcatcagagaataatcacgcggccctcgacggggtccctagaccgtacttccttacgtcggtcctacccgtaaggttccgtacgggtaccctaaccccgtaccgtaaccgtcccccgttaccccgtaccggtaacccctaacgttacccggtaacggggttcccgggggtacccgtttaccccgggggttaacccgggaacggggttaacgttacgggtaaacggggtcccgtttacggtaacccgttttaagttttaacccggttcgggtttacggtacccgtaacggttaccccgggaaacccggggggtaacccgtaaccgtaaaaccggtaggttacgggggtaacttaacgggaaactttaaaccgttcggttaacggggtaaccggggtttcggggggtttagggggtttaccggggtttaccgggggtacccggggtaaaccgggggtaaaccccgtaaaacccgggttccgggttaaacccccgggttcccggttaacggggttaaccccgg

SEQ ID NO: 24261 - DNA, 958 bp, Homo sapiens
  misc_feature: GYAE6OF01BZFOW.21.22.B11.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagacgacagctcaggggggggaagctcagcttcagctgtggtagagaagacaggacgtcaggacaatctccagcatggccggcttccctctcctcctcaccctcctcactcactgcgcgacgggtcctcgggcccagtctgtgctgactcacgcccaccctcagccgtcgtccggggacccccgggnaggacgggtccacctatccttcgttgttcgtgggacggaccaacctaccaacgagtacggtaaagttaactttagttgttaacttcgtaggtaactcgacgacctaacctcccgaagggtaacgtacccggaacccccctaaaaccttccctacaacgtacccgaagggaacggtaaaacttaaacgtcgaaccggtccccggtaccccgttaccgggtaccggggggttccccttaccgggtaaccccgttacgtttacccgttccggttacccgggtacccttaacccggtaaacggtttcccgttaccggggaccccttaaccccgttaccgaacccggtccccctttacccccgttaccggaaaccccctacgttaccggtaaccgggggtttcccgggtaccccggtttccccgggggtaacccgggaggggtacgttacggggacggtaccgttacggttaaccttttaacggtttacccgtttagggtccggaccgttaaccgggtaccgggtaacccgggggtaaccgtaaccgtaaacgtagggttacgggggtaacttaacgggtaaccttaaccggttaccgggtagggttaccgggggttacggggggttttacgggggtttaccggggtcccgggggaaaccgggggtaaacccgggtaaaccccggtaaaccgggtttacccgggtaaacccccgggttaccgggttaaccggggtaaccccgg

SEQ ID NO: 24262 - DNA, 311 bp, Homo sapiens
  misc_feature: GYAE6OF01CQP8G.21.22.B11.1.454.CMB.1.raw
  modified_base (300)..(300): a, c, t, g, unknown or other
  misc_feature (300)..(300): n is a, c, g, or t
  modified_base (307)..(311): a, c, t, g, unknown or other
  misc_feature (307)..(311): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaaacgtcgaccgtcctaaggtcacgacccaaggcctcgccccctggtcactctcgttcccacctcctcctcgtctctactgagcggctggcaaggcncatacgnnnnn

SEQ ID NO: 24263 - DNA, 720 bp, Homo sapiens
  misc_feature: GYAE6OF01A4K7D.21.22.B11.1.454.CMB.1.raw
  modified_base (583)..(583): a, c, t, g, unknown or other
  misc_feature (583)..(583): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcaggtcctggcccagtctgtgctgactcacgccaccctcagccgtcgtcggggacccccggcagacgggtcaccatctcttgttctggacgcaaactccaacagtacggaagttaattatgtattctggtatcagctaactccgaggtaactccggacccccaaactcctcactaccgaaggaacggaaacttaacgtaccaacggccccggaccctacggaaccgggggttcccctaggaacccgtacgttcctacgtcggccttaacccgaaggttccgtacggaccctaacccgtccgtaacccggtccccttccccgttaacggaccccttaacgttccggtaaacgggttcccggggtacccgttacccggggttacccgaagggtacgttacggggaacgtccgtttacgtactttaacgtttaccgnggttacacgttaccgccggtaacgggaaccgtacaaatcggagggaactacggaactagtcgtcggaacggttccgggttagggttcggtaccgggaggaccggtaaccaacggttcgaacggttccgaaggtaccc

SEQ ID NO: 24264 - DNA, 669 bp, Homo sapiens
  misc_feature: GYAE6OF01DPEWK.21.22.B11.1.454.CMB.1.raw
  modified_base (337)..(337): a, c, t, g, unknown or other
  misc_feature (337)..(337): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggacccccgggcaggacgggtccaccatctcttgtctggaggcaactccaacagtacggaagttaattatgttattctggtatcagacaactccgaggaactccggacccctaactcctcactccaagagaataancgacgccgcctacgacggggtccctggaccgtacttccgtcgtacggcctaccgtaacgtccgtaggccctaccgttccaccggtcccctacccgtacgtaccctagtccgtacgggtccggggtaccgttcccgggtaccggaaggtacgttggaacggtctagttaactttaacgttcgtggtacgactacgtaccggacggggaccacgaaacgtaggtacgggaactagaactaacgttcgtaggtcggggttacgggtttggggtcggttacggggaccgggtaacgggtaccgtaaaccgtcggtaaccccgtcggtacggtaccg

SEQ ID NO: 24265 - DNA, 661 bp, Homo sapiens
  misc_feature: GYAE6OF01B7NN6.21.22.B11.1.454.CMB.1.raw
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (286)..(286): a, c, t, g, unknown or other
  misc_feature (286)..(286): n is a, c, g, or t
  modified_base (637)..(637): a, c, t, g, unknown or other
  misc_feature (637)..(637): n is a, c, g, or t
  modified_base (645)..(645): a, c, t, g, unknown or other
  misc_feature (645)..(645): n is a, c, g, or t
  modified_base (650)..(650): a, c, t, g, unknown or other
  misc_feature (650)..(650): n is a, c, g, or t
  modified_base (654)..(654): a, c, t, g, unknown or other
  misc_feature (654)..(654): n is a, c, g, or t
  modified_base (656)..(657): a, c, t, g, unknown or other
  misc_feature (656)..(657): n is a, c, g, or t
  modified_base (659)..(659): a, c, t, g, unknown or other
  misc_feature (659)..(659): n is a, c, g, or t
tcagtcgtcgctcgcacgaccggtgctcgatttagacgacagctcagggtcctgggcccagtctgtgctgactcagccaccctcagcgtctcgggacccccgggcaggagggtcaccatctcttgttctggaggcaactccaacatcggaagtaattatgtattctggtatcagcaactcccaaggaatcggaccccaaatcctcatccaagagaataancagcgccncgacggggtccctagacctattcctcgtacggctaccgagtccgtaggacctacctcncgacccttccctgaccatccgaggtcggtccttaccgggccgaggactggacgtctagtaacttacttacgtagcgacacgtcccgaagggtaccacaacgtaggtcggggaatcgaaacaacgttcggaggtcggtcggggttggtcggtcgggacgggtaaccggtaaccgtaacgtaccggaccgttacgtacgggtacaccggtaccgaacggcgtccccggcccgttcggttactccgttccgttcccggtacccgtcccccttaccgtcccgttccgttcccgtaccgttcggtaccggcgggtaccggttcgaaccggacgtacgggcctacgtaagtcggtanacgcgtanacgtnacgnanngngc

SEQ ID NO: 24266 - DNA, 802 bp, Homo sapiens
  misc_feature: GYAE6OF01ERFUQ.21.22.B11.1.454.CMB.1.raw
  modified_base (216)..(216): a, c, t, g, unknown or other
  misc_feature (216)..(216): n is a, c, g, or t
  modified_base (370)..(370): a, c, t, g, unknown or other
  misc_feature (370)..(370): n is a, c, g, or t
tcagtcgtcgctcgcacgaccggtgctcgatttagacgacagctcaggggggggaagctcagcttcagctgtggtagagaagacagtactcaggacaatctccagcatggccggcttccctctcctcctcaccctcctcactcactgcgcagggtcctgggcccaggtctcgtgctgactcagccaccctcacgccgtcgtccggggacccccggnaggtacgggtccacctattcctcttcgttcgtgggacgccaacctaccgaaactagtacggtaattaaagttattagttatttccgtaggttaactcgaacgacctaacctaccccgaagggtaaccgtcccggaaccccctaaacctttcccncctaacctacccggaaagggaacggttaaaacttaacgtaccgaaccgggtccccggtccccggttaccgggtaccgggggttcccctaggtaccgttacgttccgtcgtcgggtaccctacgtaacggtcgtacggtacccaccgtcgaccccgtcccttcccgacgtacccagttccggacgggttccgggcccgttaccgggtaccgaggtacgtcgggaaggtcctaggtaccttaagtttcagggtcgtaactacggttaccggaccgggaaccgtaacgtaacgtagggttaccgggaagtacgtaaacccgtaggtgttaacgggtacggggtttcgggggtttcgggtaccggggttccggggaacgggtaaaccggtaaaccggttaccgtaccgggttacccgttaccgggaaggtaccccg

SEQ ID NO: 24267 - DNA, 698 bp, Homo sapiens
  misc_feature: GYAE6OF01DZZ9T.21.22.B11.1.454.CMB.1.raw
  modified_base (209)..(209): a, c, t, g, unknown or other
  misc_feature (209)..(209): n is a, c, g, or t
  modified_base (231)..(231): a, c, t, g, unknown or other
  misc_feature (231)..(231): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgagggtcctcgggcccagtctgtgctgactcagccacctcagcgtcgcgggaccccggnaggacggcacatctcttgttcnggagacaactaccaacgagtacggtaaagttaattatagttattgtaggtatcgagactaacctacccgaggaacttacccggacccctaaactcctacactccgagaagaataancagccgccngacgggtcctggactatctcgtgacctaccgaagttcgtacgacctacctaccgacctccctaccctacgtaacccaacgttacggacggttcgggacccgttaccccggggtaccgtaagggtacgtacgggtacggactttaacgtacgtttaatacggtctagacgtaacgtaccggacggggtaaccaacaaacgcgttaggggaactacgtaaacgtgtagggttacggaagggttccgggggttttaggggttaccggttaaccggggaccggttaaacggggtaaaacccttacccggtagggttaacccccgtcgggttaacccgtaaacccgg

SEQ ID NO: 24268 - DNA, 776 bp, Homo sapiens
  misc_feature: GYAE6OF01E5GWW.21.22.B11.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (489)..(489): a, c, t, g, unknown or other
  misc_feature (489)..(489): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagccgtcgtcggggacccccggnagagggtcaccatctcttgtctggaggccaactcaacngtacggaagtaattatgtattcgtggtatcagcaactccgaggactccggaccccctaaactcctcactaccaggaacggtaaataacgtccgaacggccggccccgttacggacgggggttcccctacggtaacccgtactttccgttaccgttcgggtacccttacccgtaaagttcccgtacgggccctaacccgttccgaacccgtccccctttacccgtacccggtaaaccccngtttacccggtaacgggttcccggggacccgtttcccccgggggttaccgggaaagggtacgttgggaacggtcccgtttacggtaacctttaactttacggtcggtacgtaccctaacgtccggtacccgggggacgtaaccaaacgtaggtacggggtatacgggaccttaaacgtgttagggacgggttcgggggtttcgggttacgggttacccggggaggggtaaacccgggtaaccttaaccgggtaccgggtaccccggttaacgtacggggtaacccgg

SEQ ID NO: 24269 - DNA, 607 bp, Homo sapiens
  misc_feature: GYAE6OF01C1I5O.21.22.B11.1.454.CMB.1.raw
  modified_base (196)..(196): a, c, t, g, unknown or other
  misc_feature (196)..(196): n is a, c, g, or t
  modified_base (322)..(322): a, c, t, g, unknown or other
  misc_feature (322)..(322): n is a, c, g, or t
  modified_base (463)..(463): a, c, t, g, unknown or other
  misc_feature (463)..(463): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcncgggacccccggcagagggtcaccatctcttgttctggagcaactccaacatacggaataattatgtattctgtatcagcaactccaggaactcgacccccaaactcctacactccagagaataancagccggccctgacgggtcctgaccgtattctctggcctacgtaagtctggcctacctcacgtccctaccctgaccctattcgaggtcgggtccctccggtaccgagggtactggaacggtcctaggtaacttagttacgngtagactaacgtcggaacggacacaacgtggtgggaatacggtaacagttcggtaggtcgggttcggggtttaggggtcggttacggggaaccgggtaacggtaaacccctaaggttcccgtaacccggtccgttaacggaccg

SEQ ID NO: 24270 - DNA, 588 bp, Homo sapiens
  misc_feature: GYAE6OF01AIFGS.21.22.B11.1.454.CMB.1.raw
  modified_base (327)..(327): a, c, t, g, unknown or other
  misc_feature (327)..(327): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgtctggaggcaactccaacatcggaaagtaattatgtattctggtatcagcaactcccaggaactcggaccccccaaactcctcatccagaggaataancagcggccctcgacggggtccctgaccgtattcctctggcctaccgaagtcctggcctacctcacgccctccctgacccatcgaggtcgggccttccgggcgaggatggacgctagacttatctgtgctatccgacgggtacacaacgtggtagggatcgaactaatcgtagggtacggtcggggtttggggtcgtttacgggggaccgggtaacgggaaacccgtaaacgtcccgggaacccgttccggtagggtacccg

SEQ ID NO: 24271 - DNA, 726 bp, Homo sapiens
  misc_feature: GYAE6OF01CP9WK.21.22.B11.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (616)..(616): a, c, t, g, unknown or other
  misc_feature (616)..(616): n is a, c, g, or t
  modified_base (663)..(663): a, c, t, g, unknown or other
  misc_feature (663)..(663): n is a, c, g, or t
tcagtcgtcgctcgcacgaccggtgctcgatttagacgacagctcgaggggggggaagctcagcttcagctgtggtagagaagacaggactcgaggacaatctccagcatggccggcttccctctcctcctccaccctcctcactcactgcgcgagggtcctgggcccagtctgtgctgacctcacgcccacctcagccgtcgccgggaccccggnagcggtcacctntctcttgtactggacgcaacctcaacagtacaagtaaagttaattagttagttattctaggtatctaacgacctaaccgtcccaaggtaacctcccggaacccccctaaactccctacaacgtacccgaagtaaacggtaacttaacgccgtaacggacccggtcccgtaccggggtaccggttacccctacgggtaacccgtacttttcccgtaccggttcgggtaacccttaccggtaaacgtttcccggtaccggtaacccttaacccggttccctaccgggtccccccttaccgtacgaaccctacggtacctcgggttacccggtccgtacccgggtaggtacggagttaccggagtacttaccggttaaattacgtttacgngggtctaaccgacgtaccggaccggagtaccaacgttaggacggtanactacgtaacgtgcggtgtacggggttgcgggtacgacgtaacgactaagcgtccgagtacgg

SEQ ID NO: 24272 - DNA, 682 bp, Homo sapiens
  misc_feature: GYAE6OF01CBVIQ.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccggnagacgggtcaccatctcttgttcgtggaggcaactccaacatacggaagttaattatgttattcgtggtatcagcaactccaggaactcggaccccaactcctacactaccagaaggaaatactcgacggccgccctaggaccggggtcctacgaccgtattcctcgtacgcctacgaacgtcgtcgcctacctcgaccgtccctcccgtacgaccacgtcgtacgggttcggccgtcccgggtacggaggtacgtacgggtacggtccgttacggtacttaacgttacgtgttacgcgtaacgtacccggaacggggtaccgaactaacggtaggtaggtaacgtacgtaaacgtacgtacggttggtacgggggttacggggtttcggggttacgggttacccgggggtacgggtaacccggggtaacctaaaccgggttccggtaacccggttccggtaacggtacccgg

SEQ ID NO: 24273 - DNA, 660 bp, Homo sapiens
  misc_feature: GYAE6OF01C240K.21.22.B11.1.454.CMB.1.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (323)..(323): a, c, t, g, unknown or other
  misc_feature (323)..(323): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctccaccctcctcactcactgcgcagggtcctggcccagtctgtgctgactcacgccaccctcagcgtcgtcgggacccccggnagacggtcaccatctcttgttcgtggagcaactccaanatacggaagtaattatgtattcgtgtatcagacactcccgagactccgaccccaactcctcactcagagaatacncagccgcctgacggtcctacgacgtatctcgtgctacagtccgtgcctaccgtcgactccctcccgtacgaccctaagtccgaagggtccggtccgtcccgggttaccggagggtacgtacggtacggtacgtacgtaaccgtttacttaccgttcggtcgtaaccgtaacgtaccggtaaccggggtaaccgaaccgtaaacgtaacgggttacggtaacgtaaccgaaacgttaacgtcggttagggtaacggggttggggtttggggttacggttccggggaaggtaaccgggtaaccgtaaacgtccggtacccgtacgttacgggtaacccg

SEQ ID NO: 24274 - DNA, 682 bp, Homo sapiens
  misc_feature: GYAE6OF01D8GVG.21.22.B11.1.454.CMB.1.raw
  modified_base (211)..(211): a, c, t, g, unknown or other
  misc_feature (211)..(211): n is a, c, g, or t
  modified_base (635)..(635): a, c, t, g, unknown or other
  misc_feature (635)..(635): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagccgtcgtcgggacccccggnagaggtcaccatctcttgttctggagcaactccaacatacggaataattatgtattctgtatcagacaactcccgaaggactccggaccccaaactcctcactccaaggagtaataatcgacgccgtcctacggacggggtccctaggaccgtacttcctcgtcggtcctaccgaacggttccgtcggacctacccgtaccgaccgtccccttcccgtacgaacccctattacccggagggttcccgggtaccgttcccgggtaccggaagggtacctgggaccggtcttacgtaacccgtttaattaccgtggtacgaccgtaacgttacccggaacgggggtaccacgtaaacgtaggttacgggaacttacgaactaacgttcgtaggtacggggttcgggttgggtccggttaccggggngggtaaaccgggtaccctaaaggcccgtaaccggtcgtaggtacccg

SEQ ID NO: 24275 - DNA, 747 bp, Homo sapiens
  misc_feature: GYAE6OF01E4TZH.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcggggaccccgggcaggagggtcaccatctcttgttctggaggcaactccaacagtacggaagttaattatgtattctggtatcagaccaacctccaggaactccggacccccaaactcctacactccaaggaaggtaataactcgacgccggtccctacgacggggtccctacgaccgtacttcctcgtcggtcctaccgtaacgttccgtcggacctacccgtccgaccgtccccttacccgagacccctagttccggaaggggttccgggtcccttcccggggtacgaagggtacgtgggaacggtccttaaggtaacctttacgtttaaccgtggtacgtaccgtaacgtacccgggaaaccggggaccgtaacctaaacgtagggttacgggaacttacggaaacctacgttcgtaaggggtaccggggtttcggggggtttacggggttccggggttacccgggggaaccggggtaaaccggggtaaacccttaaaccgggttccggtaaccccgggtttaccggtaacggggttaaccccg

SEQ ID NO: 24276 - DNA, 710 bp, Homo sapiens
  misc_feature: GYAE6OF01BRH25.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcgacgccaccctcgacgcgtcgtcggggaccccggnaggacggtcaccatctcttgtctggacgcaactccaaacagtacggtaagtaattagtagttattcgtaggtatcagtacaactcccgaggtaactccggacccccaaatcctacactaccgagaagtaaatactcgaacggccggtcctacggaacggggtccctaggacccgtattcccgtcgtacggtcctacccgaagttcccgtaggaccctaccgtacaaccgtccctacccgtagaaccctagtccgtaagggtcgggacccttccgggtaccgaggtatcggacgtctacgtacttagttacgtgtacgactaccgtacggaacgggtaccaacgtaacgtaggtacggacgtaagtaaaccgtagttaccggagggtacggttacgggggtttacggggttacgggttacccggggaacggggtaaacccgggttaaacccgtaacgggttaaccggtaacccccggttcggttaacgggtaccccg

SEQ ID NO: 24277 - DNA, 653 bp, Homo sapiens
  misc_feature: GYAE6OF01CB1XD.21.22.B11.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
  modified_base (357)..(357): a, c, t, g, unknown or other
  misc_feature (357)..(357): n is a, c, g, or t
tcagtcgtcgctcgcacgaccggtgctcgatttagacgacagctcagggggggaagctcagcttaagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccgggcagagggtcaccatctcttgttcnggagcactcantcgaagtattatgtattcngtatcagcaactcccaggaactcggccccaaatcctcactccgagaaggaataatcgacgccggccctacgaggggtccctcgaccgtattcnctcggctaccgaagtcgtcggcctaacctcacggtaccctccctgaccctatccgaggttcgggcctccgggtacgaggtacgtggacggtcctggtactttacgttcgtcgttcgacctacgtaccggaaccgggaccgtaacccgaaacgtaggttacgggggaatacggtaaccaaacgttcgtaacgggtacgggttcggggtttaggggtcggtttaccggggaccgggttaaagggaaccccttaaacggtccggaccccggtttaaccgtagggttcccgaaccccggg

SEQ ID NO: 24278 - DNA, 657 bp, Homo sapiens
  misc_feature: GYAE6OF01AOAMJ.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggcaggacgggtcaccatctcttgttctgggacggcaacctccaaacagtcggaaagtaatttatgttattcgtggtatcagcaacctcccgaaggaacgtccggacccccaaactcctacactccaagaggaataatcaggtcgccctgacggggtccctggacctattctcgtcggcctaccgaacgttcgtcgcaccctcgactccctccctcgacctacgtcgtacggtcggtccgtccggtaccgtagggacgtcggacggtctcggtaaccttagttacttggtcgctaacgtccggaaccggggtacacgaaaccagggtacgggaattacgaacgtacgttacgtaggcgggttcggggtttgggtcgggttccgggaaccggggaaccggttaacccgaaacggttccgggaaacccgttccgggtaacggtaacccgg

SEQ ID NO: 24279 - DNA, 788 bp, Homo sapiens
  misc_feature: GYAE6OF01CUDWU.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagccgtcgtcggggacccccggnaggagggtccaccattctcttgttcgtggacggccaacctccaaactagtacggtaaagttaattataggttaacttcgtggtatacagaccaacctccgaaggaactccggacccctaaactcctacactccgaagaagtaactaatccgaacggccggtaccctaggtaccgggggtccctaggtaaccgtacttccgtcgtcggaccctacgtaacgttccgtacggaccctaccgttaccgaccgtccccttacccgtacggtaaccctacgtaccggtacgggtccgggtacccgttacccgggtaccggaggtacgttacggacggtccgtaacgtaactttacgtttacgtacggttacgaccgtaacggttacccgggaaaccggggacccgtaaaccgtaacgtaacgggtaggggtaacctaacggtaaacccgtaaaggttccggtaaaggggtcgggttaccggggggtttcgggttcggggtttacccgggggacgggtaaaccgggtaaaccctaacgggttaaccgggtcccccggtttacgggttacgggtaccccgg

SEQ ID NO: 24280 - DNA, 641 bp, Homo sapiens
  misc_feature: GYAE6OF01EH12Z.21.22.B11.1.454.CMB.1.raw
  modified_base (279)..(279): a, c, t, g, unknown or other
  misc_feature (279)..(279): n is a, c, g, or t
  modified_base (376)..(376): a, c, t, g, unknown or other
  misc_feature (376)..(376): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctccctcctcaccctcctcactcactgcgcagggtcctgggcccagtctgtgctgactcagccaccctcagcgtctcggggacccccgggcagagggtcaccatctcttgttctggaggcaactccaacatcggaataattatgtattctggtatcancaactcccaggaatcggcccccaaatccctcatccagagaataactcagcggccctcgacggggttccctgaccgtattctcgtggcctccaagtcnggccacctcacgtccctccctgacccatccgagtcgggtcctcccgggtacgaggtctgacgggtcttaggaacctttagttaccgtggtagccgtaacgttaccggaaccgggggtaaccgacctaaacgaggttacggggtaattcggaaaccttaagtaccgttgggaaccgggtttgggggtttggggtcgggtttccgggacgggggtaaacgggtaccctaaaacggtcggtaaccccgggttaccgtacgggtacccg

SEQ ID NO: 24281 - DNA, 603 bp, Homo sapiens
  misc_feature: GYAE6OF01EWMHG.21.22.B11.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagaggtcaccatctcttgttctggagcaactccaantcggaagtaattatgtattctggtatcagccaactcccaggactccggacccccaaactcctcactccagagaataatcgacgccggccctcgacggggtccctggacccgtattcctcgtcggcctaccgaagttcctcggcctacctcgacgtcccctccctacgaccctagtcgaggtcgggccgttcccgggtacgaggtacgtcggacggtcctagtaacctttagttaccgtgtgcctaagtccggaacgggacacaacgaggtagggataggaactagtcgtaggaggttcggggttgggtcggtaccgggcggaacggtaccctaacgtcgaccggttcgtagggtaccg

SEQ ID NO: 24282 - DNA, 676 bp, Homo sapiens
  misc_feature: GYAE6OF01CWAC2.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggaccccccggcaggacgggtcaccatcctcttgtctggcggacaactccaacatacggaagtaattatgttattctggtatcagacaactcccaaggactaccggacccccaaactcctcactccaagagaaatactacgagccggtccctcggaccgggtccacgaaccgtacttctcgtcggtcctaccgtaacgtcctcggccacccgtcaccgtccctcccgttacgaccctactccgaacgggtcgggtcccgttacccggggtaccgaggtacgtacggtaacgggtccgtacgtaacctttagttaccgtggtcgtaactacgtaccggtaccggggaacctaccgaacgtagttcgggaactaggacctaagtcgtaggtacgggttccggggtttagggtcgggttacggggaccgggtaacgggtaaccctaaacggtccggtaacccggttcgtggtaccccg

SEQ ID NO: 24283 - DNA, 695 bp, Homo sapiens
  misc_feature: GYAE6OF01EJPMA.21.22.B11.1.454.CMB.1.raw
  modified_base (211)..(211): a, c, t, g, unknown or other
  misc_feature (211)..(211): n is a, c, g, or t
  modified_base (366)..(366): a, c, t, g, unknown or other
  misc_feature (366)..(366): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnaggacggtcaccatctcttgttctggagcaactccaacagtacggaagtaattattgtattctggtatcagcaactccgagaatcggaccccaaactcctcataccaggtaagaaataatcacgccggccctcgaggggtccctgaccgattccncgtcggcctacaagtctggccacctctacgccctcctacgaccctataccgtacggtcggaccgttcccgggtaccgaggtacgtgggacggtccgttacgtaacgtttacgtttaccgttggtaccgtactaaccgttacgggaacccggggtaaccgaacgttaaaccgtaaggttacgggaacgttacgaaaccgtaacgtttcggtaaaggggtccgggtttaggggggtttcggggttcggggttacccggggtacggggaaacgggttaaaacccctaaacggttcccgggtaaccccgggtttaccgtcgggtaaccccggg

SEQ ID NO: 24284 - DNA, 565 bp, Homo sapiens
  misc_feature: GYAE6OF01EF6ZF.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagttaattatgtattctggtatcagcaactccccaggaatcggacccccaaactcctcatccagagaataatcagcggccctcgacggggtccctgaccgtattctctggcctccaagtctggcacctcacgccctccctgacccatcaggtcggcctccgggtacgaggatggaggtctgacttattactgtcgctatcgacgggacacaacgagtagggatgaactaatcgtaggtacggtcgggtttgggtcggttaccgggacgggaacgggtacccaaacgtcggaacccgttccgtaaggtcccg

SEQ ID NO: 24285 - DNA, 654 bp, Homo sapiens
  misc_feature: GYAE6OF01BPVXT.21.22.B11.1.454.CMB.1.raw
  modified_base (216)..(216): a, c, t, g, unknown or other
  misc_feature (216)..(216): n is a, c, g, or t
  modified_base (363)..(363): a, c, t, g, unknown or other
  misc_feature (363)..(363): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggcaggngggtcaccatctcttgttcgtggaggcaactccaacatacggaagtaattatgtattctggtatcagcaacctccaggaactccggaccccaactcctcactccagagaatatcacgcgccctcgacgggtccctgaccgtattccncgtcggcctccgaacgtctcggccacctcacgtccctaccctcgaccctatcgagggttccggccgttcccgggtcggaaggtcgtaggacggtccttacgtacgtttaacgtttccgtgtcgactacgttaccgggaaccgggtacaaccgaagtaacgggtgggaactacgtaacctaagtccgtagggtacggttcgggggtttagggtccgggttaccgggggaccgggtaaccgggtaaaccgtaaccgggttaccggtaaccccggttcggtacgggtaacccgg

SEQ ID NO: 24286 - DNA, 621 bp, Homo sapiens
  misc_feature: GYAE6OF01AJK00.21.22.B11.1.454.CMB.1.raw
  modified_base (342)..(342): a, c, t, g, unknown or other
  misc_feature (342)..(342): n is a, c, g, or t
  modified_base (591)..(591): a, c, t, g, unknown or other
  misc_feature (591)..(591): n is a, c, g, or t
  modified_base (608)..(608): a, c, t, g, unknown or other
  misc_feature (608)..(608): n is a, c, g, or t
  modified_base (611)..(611): a, c, t, g, unknown or other
  misc_feature (611)..(611): n is a, c, g, or t
  modified_base (618)..(618): a, c, t, g, unknown or other
  misc_feature (618)..(618): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggccccaaactcctcatccagaggaataatcagcggccctgacggggtccctgaccgattctctggcctcaagtctggccacctcacgccctccctgacccatcgacggtggcctccggtccgaggatgaggtctagactattacgtgtacgctancgacgggcacaacgagtggggatgaactaatcgtaggacgtcggggtttggggtcggttcgggacgggaacgggtaccaaacgtcggtacccgtccgtagggtccacggacccgaggcgtccgtcccccgtcggtcctaccgtccgttccgttccccggccccttcccgtcccttaccggtccttaccgttaccgtcggtacggtccgggtccgtcgggaccgacgggtccgaccggtaacgttacggnacgcgtcgacgacgcgngtntacggcngtc

SEQ ID NO: 24287 - DNA, 823 bp, Homo sapiens
  misc_feature: GYAE6OF01EF8UM.21.22.B11.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcacgggtcctcgggcccagtctgtgctgactcacgcccaccctcacgccgtcgtccggggacccccgggnaggacgggtccacctattccttcgttgttcgtggacggaccaacctccaaacgtacgttacggtaaagttaaatttagttagttactttcgtaggtaacttcgaacgtacctaaccgtaccccgtaagggtaaccttacccggaacccccctaaaaccttcccgtaccaactaccgaaggaaaggtaaactaaactcgaaccggtcccggaccccgttaccgggaccgggggttaccctacggtaccgtactttccgtaccgtacggtcctaacccggtaagttccgacggacctacccgtcgaccggttcccctcccgtacgaacccttacgtaccggtagggttccgggacccgttacccgggtacgaacgggtacgttaggaacggttcgtaacgtaactttacgttacgtcgtacggacgtaacgtaccggaccgggacctacgaacgtagggtaccggattaacggaactacggtcggtacggttcggggttacgggtttggggttaccggggttaccgggaaccgggggaaaccgggttaacccggtaaaccgggttacccggtaacccgggtttacccggtaacggggtaaccccgg

SEQ ID NO: 24288 - DNA, 779 bp, Homo sapiens
  misc_feature: GYAE6OF01AHDHC.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggaccccgggcagacgggtccaccatctcttgtctggagcaactccaacatacggaagtaattatgtattcgtggtatcgacgaccaactccccaaggaactcggacccccaaactcctacactaccaggaaggaaactatcgacggccggccctcggaacggggtccctacggaaccgtattccgtcgtcggctaccgtaacgttccgtcggtacctaccctaccgaccgtccccttcccgtacgaaccctacgtacgtacgggtccgggtacccgttcccggggtacccggtaagggtacgtcgggtaacgggtccttaggtaacctttacgtttacgtaggttcgtaccgtaacggttaccggaacccggggtaaccgaccgtaaacgtacgggtacgggtaactacgggtaaacctaaacggttcggtaacggggtaccgggtttccgggggggttttaggggtttcccggggtttaccggggggaaaccgggggttaaaccggggtaaacccccgttaaaacccggttccgggtaaacccccgggttttcccggttaacggggttaacccccgg

SEQ ID NO: 24289 - DNA, 687 bp, Homo sapiens
  misc_feature: GYAE6OF01A0Z8R.21.22.B11.1.454.CMB.1.raw
  modified_base (212)..(212): a, c, t, g, unknown or other
  misc_feature (212)..(212): n is a, c, g, or t
  modified_base (323)..(323): a, c, t, g, unknown or other
  misc_feature (323)..(323): n is a, c, g, or t
  modified_base (370)..(370): a, c, t, g, unknown or other
  misc_feature (370)..(370): n is a, c, g, or t
  modified_base (545)..(545): a, c, t, g, unknown or other
  misc_feature (545)..(545): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggacccccggnaggacggtcaccatctcttgttcgtggaggccaactccaaacagtacggaaagttaattatgttattcgtggtatcgagacacctccgaggtaactcggaccccaactccncactccgagagaactatcgagccggcctagacgggttccagaccgtnttctcgtggcctacgacgttcgcggcctaaccgtcacgccctcctacgaccacgtcgtacgggtcgggtcccttcccgggtacggaaggtcttacgggacggttccttaacggaactttacgtttacgaggtcgaactaccgttaccgggaaccggggtaacctaacgtaaacgngggttaacggacttaaacgaccgttaaagttccgggtagaccggggtttggggtttacgggtacgggttaccggggtacggtaaaccgggggtaaaccctaacgggtaccggttaaccccggttaaggtccggtaaccccgg

SEQ ID NO: 24290 - DNA, 306 bp, Homo sapiens
  misc_feature: GYAE6OF01C01PA.21.22.B11.1.454.CMB.1.raw
  modified_base (301)..(306): a, c, t, g, unknown or other
  misc_feature (301)..(306): n is a, c, g, or t
tcagtcgtcgctcgcacgaccggtgctcgatttagacgacagctcaggggtccctgaccgattctctggctccaagtctggcacctcagcctccctgaccatcagtgggctcccggtccgaggatgaggctgactattactgtgcatcacgggacgcaacatgggatgacaatctgagcggttgggtgttcggcggagggaccaaactgaccgtcctaggtcagcccaaggcctcgccccctcggtcactctcgttcccacctcctcctcgtctctactgagcggctggcaggcgcatagnnnnnn

SEQ ID NO: 24291 - DNA, 795 bp, Homo sapiens
  misc_feature: GYAE6OF01CTB0T.21.22.B11.1.454.CMB.1.raw
  modified_base (210)..(210): a, c, t, g, unknown or other
  misc_feature (210)..(210): n is a, c, g, or t
  modified_base (254)..(254): a, c, t, g, unknown or other
  misc_feature (254)..(254): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctctcaccctcctcactcactgcgcgagggtcctgggcccagtctgtgctgactcacgcccacctcagcgtcgtcggggaccccggnaggacggtccacctattctcttgttcaggacgcaaccgtcaacngtacggaagttaattatagttattcgtaggtactacgacgacctaactacccgaaggtacgtaccggaccccctaaactccctacaacgtaccgaaggaacggtaaataaccgtcgaacggcccggtccctacgggtaccggggttaccctacggaccttacgttcgtccggtacgtcctaccgtaacggtttccgtaccggaccttacccgtaccgaacccgttccccgtacccgtaactaacccgtccgtacggtacggggttcccgggtaacccgtttccgggacccggtaaggacgttcggggtaacgtaccgtacgtaaccgtttacttacggtagtaccgtacctaacgggttaccggaaccggggtacaacctaacggtaggtaccggaaagtttacggaaccttaacggttcggaacggggtttcgggtaccggggttttacggggtacggggttccggggaaacggggtaccggtaaacccggttaaaccggtaccgggtaaccccggtttacgggtaaccggtaacccggg

SEQ ID NO: 24292 - DNA, 821 bp, Homo sapiens
  misc_feature: GYAE6OF01EISCY.21.22.B11.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagacgacagctcagggggggggaagctcagcttcagctgtggtagagaagacaggactcaggacaatctccagtatggccggcttccctctcctcctcaccctcctcactcactcgcgcgacgggtcctgggccagtctgtgctgactcacgccacctcacgcgtcgtcggggacccccgggnacggacggtcaccattcttctttcggttctgggacgacaactccaaacacgtacggtaaagttaaatttagtcgttacttcgttaggtattacgaacgtaccaaacccgtccgaaacggtaacgtaccggaacccctaaaacttcctacacgttaccgaaggtaacggtaaaacttaactaccgaacggcccggtaccccgttacggacccgggggttaccctcggtaaacccggttactttccgttaccggttacggtaccctaaccggtaacggttccgttaccgggacctaccccgttcgaccgtccccttaccgtaccggaacccttaagtccggtacgggtccggtacccggttaccggggtaccggtacggtacgtacgggcgttactacgtacgtttaacgttctcggtacgtacgaaccgtaccgggaaccgggaactaacggtaacgtaggttacgggtactacggtaaactaggttacggacgggttacggggttcggggttttaggggcggtttaaccgggggacggtaaaccggggtaaccctaacgggttaccggtacccggttacggttaccggtaccgggtaaacccggg

SEQ ID NO: 24293 - DNA, 593 bp, Homo sapiens
  misc_feature: GYAE6OF01DQASQ.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccccgggnagagggtcaccatctcttgtctggaggcaactccaacatacggaagtaattatgtattctggtatcagcaactcccaggaatcggaccccaactcctcatccagagaataatcgagccggccctgacggggtccctgaccgtattcctcgtcggtcctccgaagtcgtggccaccgtcacgtccctcccgtagaccctatccaggtcgggccttcccgggtaccgaggtatggacggtctagtacttagttactgtcgctagtccgacggggtacactaacgagtgggatagactaattcgaggacggttcgggtttgggtcggtttccggggacgggaacgggtaaccctaaacgtcggaacccgtccgtaggtacccg

SEQ ID NO: 24294 - DNA, 833 bp, Homo sapiens
  misc_feature: GYAE6OF01BPU4A.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggccagtctgtgctgactcagccaccctcacgcgtcgtccggggaccccggnaggacggtcaccatctcttgttctggacgtacaacctccaacatacggaattaacttatgtattctaggtatcgagaccaactcccgaggaactccggaccccctaaacgtcctacacgtaccgaggtaacggtaaactaacgaccgtaacggtacccgggaccccttacgggaacccggggggtttccctacgggtaacccgttacgtttccgttccgtaccggggtaccctaaccgtaaacggttcccgtcgggacctacccgttacccgaaccgtcccccttcccgtaagtacccctaacgtaccggtaacgggttccgggtccgttacccggggtacggaacggtacgtacggtaccgggtactttacggaactttacgtttacgtcgtacgggccttaaggttcccgggaaccgggtaaccgtaaccgtaaaccggttagggtacccggggtaacgttaaacggtaccgtaaaacgttcgggtaacgggttaaccggggtttccggggtttagggggttacccgggtttaccggggaaaccccgggggttaaacgggtaaacccctaaacgggtttacccggaaccccgggtttaaccggtaacgggttaaccccgg

SEQ ID NO: 24295 - DNA, 711 bp, Homo sapiens
  misc_feature: GYAE6OF01BJEAA.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctctcaccctcctcactcactgcgcagggtcctgggcccagtctgtgctgactcagccaccctcagcgtctcggggacccccggnagagggtcaccatctcttgtctggagcaactccaacatcggaagtaattatgtattctggtatttcagccaacctcccaggaatccggaccccctaaactcctacactaccgagaggtaataactacgacgccggccctacgacggggtccctacgaccgtacttcctacgtcggtacctaccgaacgttccgtcggacctaccctccgacgtcccctcccgtacggaccctacgtccgtagggtccgggtcctcccgggtaccggaggacgtcggacggtctacggtaccttacgttacgtcggtcgacctaacggtaccgaaccggggtaaccgtacctaaaccgtaggtacgggtactacggaaacgtaacgttacggtacgggtacgggttcggggtttagggggttccgggttacccggggaaccggggtaaaccgggtaaacccgttaaaccggttaccgggtaccccggttaccgggttaacgggtaacccccgg

SEQ ID NO: 24296 - DNA, 643 bp, Homo sapiens
  misc_feature: GYAE6OF01ELD9Y.21.22.B11.1.454.CMB.1.raw
  modified_base (214)..(214): a, c, t, g, unknown or other
  misc_feature (214)..(214): n is a, c, g, or t
  modified_base (257)..(257): a, c, t, g, unknown or other
  misc_feature (257)..(257): n is a, c, g, or t
  modified_base (384)..(384): a, c, t, g, unknown or other
  misc_feature (384)..(384): n is a, c, g, or t
  modified_base (407)..(407): a, c, t, g, unknown or other
  misc_feature (407)..(407): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggaccccccgggnaggagggtcaccatccttcttgttcgtggaggccaactccaanatacggaaagtaattatgttattctggtatcagcaactccaggaatccggaccccaactccacactccagagaatatcagccgcctcgacgggtccagaccgtattctcgtcgcctacgaacgtcgnggccaccttcgactcccctaccncgacccagtcgtacgggtcgggtcccgtccggacggtaggagtacgggtcgacgtaggtacttacgttacgtggtcgactacggtaccgacggggtacaaccgaatacgggtagacgtacgaactaagtcggtaggtaacgggttcggggtttcgggtacgggtaccggggaaccgggtaaaccgggtaacccaaaacggtcccgggtaacccggttccggttaaacggacccggg

SEQ ID NO: 24297 - DNA, 715 bp, Homo sapiens
  misc_feature: GYAE6OF01CWPFH.21.22.B11.1.454.CMB.1.raw
  modified_base (284)..(284): a, c, t, g, unknown or other
  misc_feature (284)..(284): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctgggcccagtctgtgctgactcacgcccaccctcgagccgtcgtccggggacccccggcaggacgggtccaccattcctcgttgttcgtgggacggaccaactccaacagtacggaaagttaattntagttaattcgtaggtatcagaccaacctcccgaagtaacgtccggaccccaaacgtcctacacgtaccaaggtaacgaaataacgtcacggcccggccctcggaccggggtccctaggtacccgtattccgtcgtacggtacctaccgtaacgtccgtacggaccctacccttcgaccgtccccttacccgtcgaacctacgtcgacgggttccgggtccgttacccgggtacggaggtacgtcgggtacggtccttaggtaacctttagttacctagggtccacgtacggtaccggaaccgggtccaacgtaaactcgggtggaaacttacgtaacctaacgtccggtagggtaccgggttcgggtttggggtacccgttacggggacggaacggtaacccctaaggtccgtacccgtcggtacgaccg

SEQ ID NO: 24298 - DNA, 753 bp, Homo sapiens
  misc_feature: GYAE6OF01A6XNT.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggnagagggtcaccatctcttgttctggaggcaactccaacagtcggaagtaattatgtattctggtatcagcaactccaggatcgaccccaactcctcactccaagagaatactcacgcgccctcgacgggggtccctgaccgtattcctcgcggtcctaccgtaacgtccgtacgggtaccctaccccgtaccgtacggtcccccttaccccgtcggtaacccctacgttacccgaagggttccggggtacccgttcccggggttacccgggaagggtaccgtcgggaacggggttcctagggtaaccctttaagtttacccgttgggttacgtactaaccggttacccggaacccggggttaacggaacccgtaaacggtacgggttacggggtaacttacgggaaaccctaaacgtcggttacggtaacggggttcccgggggttttaggggggtcccgggtttacggggacccggggtaaacggggtaaaccccgaaaacgggttccggtaacccccgggttacgtaaccgggggttaccc

SEQ ID NO: 24299 - DNA, 856 bp, Homo sapiens
  misc_feature: GYAE6OF01EI9SV.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnagagggtcaccatctcttgttctggaggcaactccaacatcggaagtaattatgtattctggtatcagcaactcccgaggactcggacccccaactcctcactccagagaataactcagccggccctcgacggggtccctaggacccgtattccgtcgtcggtcccttaccgaaggttccgtcgggacctaccccgttcgaaccgtccccttacccgtcggaacccctagttccgaaacggggttccggggtacccgttaccccgggggtaccggaaagggtacgttaggggtaaccgggtaccgtttacgggtaaacccttttacggttttaacccgttcgggttaccgtaccccgttaaacggttcccccggggaaacccgggggggtaaccctaacccggttaaaacccggtaaggggttacggggggtaaccttaaacccggggtaaaccgttaaaaccgtttcccgggttaagggggttaaccggggtttaccccgggggggtttttagggggggtttacccgggtttaccccgggggggaacccgggggtaaaacccggggtaaacccccgttaaaacccggggtttccccggggtttaaacccccggttaacccgggttaaccgggggtaaacccccgg

SEQ ID NO: 24300 - DNA, 819 bp, Homo sapiens
  misc_feature: GYAE6OF01BUDGQ.21.22.B11.1.454.CMB.1.raw
  modified_base (645)..(645): a, c, t, g, unknown or other
  misc_feature (645)..(645): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctcgggcccagtctgtgctgactcacgcccaccctcagcgtcgtccggggaccccggcagacgggtcaccattcttcttgttcgtggaggcaactaccaacgagtacggtaaagttaattagttgttattcgttggtactacgaacgacctaaccgtccccgaaggtaaccgtcccggaaccccccctaaaccgtcccttacgtactacccgaaggtaaaggtaaaacttaacgtaccgtaaccgggccccggtaccccgtaccgggtaccgggggttaccccttacggtaaccccgttacgtttcccgttaccgtcgggtacccttaccgttaacggttccgtccggaccctaaccccgttaccgacccgttcccccgttaccctacgtaccctaacgtccggtaacgggtccgggttaccccggttacccgggtccggaagggtacgttacgggtacggtaccttacggtaactttacgtttacgngttcgacgtacggtacccggaaccggggtaaccgacgtaaacgtagggttacgggataaccggtaacttaacggtcggttagggtacggggttcggggtttgggttaccggggtacgggaacggggtaccggaaaccgtacggtacccggtaacccgttcggtacgggtacccg

SEQ ID NO: 24301 - DNA, 777 bp, Homo sapiens
  misc_feature: GYAE6OF01B906V.21.22.B11.1.454.CMB.1.raw
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
  modified_base (239)..(239): a, c, t, g, unknown or other
  misc_feature (239)..(239): n is a, c, g, or t
  modified_base (350)..(350): a, c, t, g, unknown or other
  misc_feature (350)..(350): n is a, c, g, or t
tcagtcgtcgctcgcacgaccggtgctcgatttagacgacagctcaggggggggaagctcagcttcagctgtggtagagaagacaggactcaggacaatcctccagcatggccgcttccctctcctcctcaccctcctcactcactgcgcgagggtcctgggcccagtctgtgctgactcacgcccaccctnagcgtcgccggggaccccggnaggaggtccaccattctcttgtaccngggagccaactcgaacagtacggaagttaattactgtaattcgtaggtatcagacaacttccgagtaacgtccggaccccctaaactcctacacgtcctaagagtaaatancgtaacgcccggaccctcggaccggggttccctacggaccgtagttccctcggttccggtaccttacccgaaacggttccgtacgggtaaccctccctaccgaacgtccccctcccgtaccgaacccttagaccgtagggttaccgggtccccgtacccgggttacccggaagggttacgagggtaccggtcgttacggtaaccttacgtttacggttagttccgaccgtaacttcccggaaaccggggtccgtaaccgaaacgttacgggtacgggtaacggtttaacgaccgttaaaacgttcccggaggggttaaccgggtttcggggggttacgggtttcgggttacccgggggtaacgggtaacgggttaaaccccgaacggtttaaccccgggcccgtttaacccgggtggtaacccccgg

SEQ ID NO: 24302 - DNA, 777 bp, Homo sapiens
  misc_feature: GYAE6OF01D0NC4.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcgaggggggggaagctcagcttcagctgtggtagagaagacaggactcaggacaatctccagcatggccggcttccctctcctcctcaccctcctcactcactgcgcgagggtcctgggcccagtctgtgctgactcagccaccctcagcgtcgtcgggaccccggnaggacgggtcaccatcttcttgttcgtggacggcaacctccaaacagtacggaaagttaacttagttgttacttcgtaggtactacgacgacaacctcccgaaggtaacgtccggaaccccctaaaactccctacaactaccgaaggaacggtaaactaacgtcgacggccggaccctacggaccggggtcctacgaccttattctcgtcgctacctaagtcgtcggacctacccgtcgacgtccctaccgtcgaaccctagtcgacgggttcggcccgtccgggtaccgaagggttcgtacgggtacggtccttacggtaaccctttaagtttacgtcgggtactacgtaaccggttaccggaaccgggggtaccaaccgtaaacgtacgggttaggggtaactaacgggtaaacctaaacgttccgggttaaggggtaccgggggtttcggggttttacggggggtttccggggtaacccgggggtaacggggtaaacccgggttaaacccgtaaaacgggttcccgggttaaaccccggttaccgggttaaacgggtacccgg

SEQ ID NO: 24303 - DNA, 635 bp, Homo sapiens
  misc_feature: GYAE6OF01D03TM.21.22.B11.1.454.CMB.1.raw
  modified_base (486)..(486): a, c, t, g, unknown or other
  misc_feature (486)..(486): n is a, c, g, or t
tcagtcgtcgctcgcacgaccggtgctcgatttagacgacagctcaggggggggaagctcagcttcagctgtggtagagaagacaggactcaggacaatctccagcatggcccggcttccctctcctcctcaccctcctcactcactgcgcagggtcctgggcccagtctgtgctgactcagccaccctcagcgtcgtcggggacccccggcaggacgggtccacctatctcttgttcgtggaggcaactccaacagtcggaattaattatgttattcgtggtatcgagacaacctcccgaaggaactccggaccccctaaactcctcactaccaggagaataactcgacgccggtccctcggacggggtccctagaccgtattctcgtgcctccgaagtcctcgccacctcacgtccctcctagaccctagtcgaggttcggcctccggtacgaggtgtcggacggtcctagactttagttacgngtacgactacgtaccggacgggtacacgaagtaggtacgggatacgaactacgttagtgggtacgggttcggggtttgggtccggttacggggaccgggtaaccgggaacccttaaacggttccggaaccccgttggtacggtacccgg

SEQ ID NO: 24304 - DNA, 694 bp, Homo sapiens
  misc_feature: GYAE6OF01CHMQ2.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtcgtccggggacccccgggcaggagggtccacctattcttcttgttcgtgggacggccaaacctccaaacagtacggaaagttaatttagtgtaattcgtaggtatcagcaacctccgaaggaactccggaccccaaactcctacactccgaagagaataactcaggccgccctacgacggggtcctcgacgtattctctggacctctaagtctacggcctacctcgacgtccctcctacgacctactcgacggtcgggtccgtcccgggtacggacggtacgtgggacggtctacggttaccttaagtttacgtaggtcgactaacgtccggaaaccggggaccaaccgaaacgtaggtacgggacgttacgaaactaacgttcgttagggaacgggttcgggggttttacggggtcgggttaccgggggacgggtaaaccgggtaaaccctaaacgggttaccgggtaaccccggttacggtacgggtaaacccgg

SEQ ID NO: 24305 - DNA, 316 bp, Homo sapiens
  misc_feature: GYAE6OF01B5HPH.21.22.B11.1.454.CMB.1.raw
  modified_base (306)..(316): a, c, t, g, unknown or other
  misc_feature (306)..(316): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacagtgggatgacaatctgagcggttgggtgtcggcggaggaccaaacgtgaccgtcctaggtcacgcccaaggctccgccccgtcgtcactcctcgttccccaccctcctcctcgtctctactgacgcggctcggcaaggcacatagnnnnnnnnnnn

SEQ ID NO: 24306 - DNA, 812 bp, Homo sapiens
  misc_feature: GYAE6OF01CG4UF.21.22.B11.1.454.CMB.1.raw
  modified_base (784)..(784): a, c, t, g, unknown or other
  misc_feature (784)..(784): n is a, c, g, or t
  modified_base (788)..(788): a, c, t, g, unknown or other
  misc_feature (788)..(788): n is a, c, g, or t
  modified_base (804)..(804): a, c, t, g, unknown or other
  misc_feature (804)..(804): n is a, c, g, or t
tcagtcgtcgctcgcacgaccggtgctcgatttagacgacagctcagggtccgtgggcccagtctgtgctgactcagccaccctcagcgtctcggaccccgggcagagggtcaccatctcttgtcctggaggctaactccaacatcggaagttaattatgtattctggtatcagcaactcccaggatcggaccccaactcctcatccgaggaggaataatcagccggccgtcgacgggggtccctagaaccgtatttccgtcgtcggcctaccgaagttcgtcgggcctaccctcgtaacggtcccttccccgtagaaccctagttacccgaagggttcgggggtcccgttaccccggggtaccggtaacgggtacttacgggaccgggtccgtacgggtaaaccttttaacggtttaaccgtgggttaccgaccgtaacggttacccggaaaccggggttacccgaaccgtaaaacgttacggtagggggtaaacttacgggaaaacgtaaacgtttaccgtagggttaaacgggtccggggttttaggggttaccggttaccggggacgggtaaccggggtaaccgtaaacggtacggtaacccggttacgtacggtaccgtaccgtaacccgaaacggtccgtacccgacccccggttacggtacccgaacccgttccgtacccgtttccccgtccccgttacccgttcccgtacccgttaccgtacccgtacgtccggtacgggccggtacgtcggaaccggacggcgtacgagttacgngtcntacgctagcttacganctgcgtac

SEQ ID NO: 24307 - DNA, 604 bp, Homo sapiens
  misc_feature: GYAE6OF01BPBFN.21.22.B11.1.454.CMB.1.raw
  modified_base (210)..(210): a, c, t, g, unknown or other
  misc_feature (210)..(210): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (407)..(407): a, c, t, g, unknown or other
  misc_feature (407)..(407): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgttccgtggacggcaactccaacagtcggaagtattatgtattctaggtatcagactaacctcccgaggaactccggaccccctaaactcctacataccagagaataatcagcgcctcgacgggtccctgaccgnttcgtntcgctccagtctgcacctcacgtccctaccctgacctntccgaggtcgggacctcccgggtccgaaggtacgtcggaacggtcctagaacctttgttaacctggtcgacaacggttacgaccgggtacacgtaaacacggttgggatacgggaactaacgttggacggtaggggtcggttggggtcggttccgggacgggacgtaactaacgtggtaccctcggtaggtaacccg

SEQ ID NO: 24308 - DNA, 686 bp, Homo sapiens
  misc_feature: GYAE6OF01DQ8AG.21.22.B11.1.454.CMB.1.raw
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
  modified_base (242)..(242): a, c, t, g, unknown or other
  misc_feature (242)..(242): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcaggtcctgggcccagtctgtgctgactcagccaccctnagcgtctcgggacccccggnagaggtcaccatctcttgtctggagcaactcaantcggaatatatgtattctgtatcagcaacctccgagatcggacccctaatcctacatccagaagaatancagccgcctgacggggtccctagaccgtattccgtcnggtacctcgaaagttccgtcggacctacccttcaccggtccccttccgtacgacctacgtacgtacgggtcggcccgtttaccggcgaaggtctaggacggccgttaggtaccttaacgtttcgtcggttaccgacgtaaccgttcgggaaacccggggttaccgaaccgtaaacgttagggtaggggtaccttaagggaacccttaaaagttcccgtaagggtacgggttaccggggtttggggtttaccggttcccggggaaacggggttaacccgggaaaccctaaaccgggttaccgggtaaacccccggtttcggtttaagggtacccccggg

SEQ ID NO: 24309 - DNA, 578 bp, Homo sapiens
  misc_feature: GYAE6OF01BTGRJ.21.22.B11.1.454.CMB.1.raw
  modified_base (363)..(363): a, c, t, g, unknown or other
  misc_feature (363)..(363): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (568)..(568): a, c, t, g, unknown or other
  misc_feature (568)..(568): n is a, c, g, or t
  modified_base (572)..(572): a, c, t, g, unknown or other
  misc_feature (572)..(572): n is a, c, g, or t
  modified_base (574)..(578): a, c, t, g, unknown or other
  misc_feature (574)..(578): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagccggccctcgacggggtccctgaccgattctctggctccaagtctggccacctcacgccctccctgaccatcaggtgggcctccggtccgaggatggaggctgactattacgtgtgcatccgacgggccacgaacagtggganacgaactaactcgtgggaggtcgggtttggggtcgttcgggacgggtacgggaacctaacgtcggaacccgtcgtacggtccaacgacccgaacggtcctccgccccgttcgcctaccgtcttccccgtccctacccctcctcccgttctccgttcctcgtcgacggcggtcgcggacgaacggccgagtaacgcggancngacngctncnnnnn

SEQ ID NO: 24310 - DNA, 798 bp, Homo sapiens
  misc_feature: GYAE6OF01EAW4A.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccggnagagggtcaccatctcttgttctggagcaactccaacatcggaagtaattatgtattctgtatcagcaactccaggactcggaccccaactcctcactccagagaataatcacgcgcctcgacggggtccctgaccgtattctcgtacggcctaccgaagtccgtacggacctacccgtcgaccgtaccccttccccgtacgaaccctacttaccgtaacggggttcccggggtacccgttaccccgggggtacccgggaagggtaaccgttaccggggaacgggttacccgtttacggttaaccctttaaacggtttttaccgtacgggtacgtaccgttaaccggttcccgggaaacccgggggtaacccgttaaccgaaaccgtaacgggttacgggggtaaacttaacgggtaaacccttaaacggttacggttaccggggaacgggggttttaccgggggttttacggggggttccggggtttaacccggggggaaccgggggtaaaaccgggggttaaaccccctaaaacgggttacccggggttaacccccggggtttaccggttaacccgggtaacccggg

SEQ ID NO: 24311 - DNA, 781 bp, Homo sapiens
  misc_feature: GYAE6OF01DYQCC.21.22.B11.1.454.CMB.1.raw
tcagtcgtcgctcgcacgaccggtgctcgatttagacgacagctcgagggggggggaagctcagcttcagctgtggtagagaagacaggactcaggacaatctccagcatcggccggcttccctctcctcctccaccctcctcactcactgcgcgacgggtccgtcgggcccagtctgtgctgactcacgcccaccctcacgccgtccgtccggggacccccgggcaggacgggtccacctatccttcttgttcgtgggacggacctaacctaccaacagtacggtaagttaaattagttagttacttacgttaggttatacacgaccaacctacccgaacggtaacgtaccggaccccctaaaccctacctacctactaccgaacggaaggtaaactaacgggggggggggggggggggtacacggaccggcccgtaccggtaccggggtcccgtacgtaccgtacttccgttcgtcgtaccgtaccgtacgtcgtcggtacctaccctacctaccgtccctaccctaccgtacctacgtacgtacgggtcgggtccggtaccgggtaccggtacggtacgtcggtacggtacgtacgtaacgttacgttacgttcgtcgtacgtacgtaccggaaccgggaccgacgtaacgtaaggtacgggtagtacgtaacgtaacgttacgtacggtacgggttacggggttcggggttcggggttacgggtacgggaaccgggtaaccgtaacggtaccggtaccggtaccggtacggtaccgg

SEQ ID NO: 24312 - DNA, 580 bp, Homo sapiens
  misc_feature: GYAE6OF01DEGOP.21.22.B11.1.454.CMB.1.raw
  modified_base (210)..(210): a, c, t, g, unknown or other
  misc_feature (210)..(210): n is a, c, g, or t
  modified_base (322)..(322): a, c, t, g, unknown or other
  misc_feature (322)..(322): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctggggaccccccggnaggagggtcaccatctcttgttctggagcaactccaacatcggaagtaattatgttattctggtatcagcaactcccaggaactcggaccccaactctcactcagagaatancagccgcctgacgggtcctgactattctcgtcgctccaagtcctggcctacctcacgtccctccctgaccatcgagtcggcctcggtcgagatggacgtctagtaccttagtactgtgactacgtacgaccggggacacaacgtaggttcggaatacgaacagttcgtggaacgggttcggtttagggggtcgttccggggacgggtaaccgggaaccctaaaccgttcgggaaccccgtttccgtagggtaaccccg

SEQ ID NO: 24313 - DNA, 672 bp, Homo sapiens
  misc_feature: GYAE6OF01CXKRZ.21.22.B11.1.454.CMB.1.raw
  modified_base (222)..(222): a, c, t, g, unknown or other
  misc_feature (222)..(222): n is a, c, g, or t
  modified_base (450)..(450): a, c, t, g, unknown or other
  misc_feature (450)..(450): n is a, c, g, or t
  modified_base (538)..(538): a, c, t, g, unknown or other
  misc_feature (538)..(538): n is a, c, g, or t
tcagtcgtcgctcgcacgaccggtgctcgatttagacgacagctcgagggggggggaaggcgtcagcttcagctgtggtagagaagacaggactcaggacaatctccagcatggccggcttccctctcctcctccaccctcctcactcactgcgcgacgggtcctgggcccaggtctgtgctgactcacgcccaccctcagcgtcgtcggggacccccgggnaaggcgggtaccaccattctacttgtctggagcaactccaaacatacggaattaattagtgttattctggtatcagacaacctcccgaaggaacgtaccggaccccaactcctacacgtaccgaagaacggaaataactcgacgccggccctggaccgggtccctacgacctagttcctacgtcgtcctacgtaacgtcgtcggacctacctcacgtccctccgtacncctaacgtcgacggttcggccgtcggtaccggagacgtggacgtctagtaaccttagttcgtggtcacgacgtaccgaaccggggtanaccgaacgtaggtcggaattaccgaatacgttcggtacggacgggtttacgggtttcggggtacggtttacccgggggacggtacgggaaaccccgttaaagcccgggtaacccgttacgggtacggtaacccg

SEQ ID NO: 24314 - DNA, 640 bp, Homo sapiens
  misc_feature: GYAE6OF01AR2JO.21.22.B11.1.454.CMB.1.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
  modified_base (361)..(361): a, c, t, g, unknown or other
  misc_feature (361)..(361): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtcgtcgggaccccggnagaggtcaccatctcgttgttctggagcaactccaacngtcggaagtaattatgtattctggtatcagccactccgaggatccggacccccaactccacactaccgaagaagaatactcgacggccgtccctcggacggggtccctgaccgtnttcctcgtacggtcctaccgaagttccgtacggcctaccctcgtaccgcccttaccctacggaccctagtccgtacggtcgggacccgttcccgggtacggtaaggagttcgggaagttcgtacgtaacttactttacgtgtacgctacgaccggtaacggaccgacaatagggtacgacgtacgaccgtaagtccgtagggtacgggtcgggttacgggtcggtcggggacggaacggtaacctaacggtaccggtcccgtaacggtcggtaacccgg

SEQ ID NO: 24315 - DNA, 549 bp, Homo sapiens
  misc_feature: GYAE6OF01D8NKL.21.22.B11.1.454.CMB.1.raw
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (543)..(549): a, c, t, g, unknown or other
  misc_feature (543)..(549): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatcggcccccaaactcctcatccagaggaataatcagcggccctcgacggggtccctgaccgattctctggctccaagtctggccacctcagccctccctgacccatcaggtcgggcctccgggtccgaggatggaggctgactattacngtncatcgacgggacgcaacngtgggatgaacaatcgtaggaggtcgggtttgggtgttcgggacggacgggacccaagtcgaccgtcgtacggtcacgcccgaaggcctaccgccccgtcggtcctctccgtcgttccccgccctccgtccgagccgacgacgtggacggcgggtctcggcgacggtccgactagtacgangcngncgnnnnnnn

SEQ ID NO: 24316 - DNA, 645 bp, Homo sapiens
  misc_feature: GYAE6OF01D4YHI.21.22.B11.1.454.CMB.1.raw
  modified_base (209)..(209): a, c, t, g, unknown or other
  misc_feature (209)..(209): n is a, c, g, or t
  modified_base (275)..(275): a, c, t, g, unknown or other
  misc_feature (275)..(275): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnaggagggtcaccatctcttgttctggaggcaactccaacatcggaagtaattatgtattctggtancagcactcccaggactccggaccccaactcctcatccagaagataactcagccggccctcgacggggtccctgaccgtattctcgtcggcctaccgaagtcgtcggcctaccgtcacgtccctcccgtacgaccctatccgtagggttcgggccgttcccgggtaccgagggtatcggaggtccttagaactttattaccgtgtcgacctagtacccggaacggggacaccgaacgtacggtagggaactagaacgtaagttccggtagggtacgggttcggggtttggggtcgggttaccggggaacgggggtaaccgggtaaccctaaaacgggttccggtaaccccgggtcggttaacggtacccgg

SEQ ID NO: 24317 - DNA, 641 bp, Homo sapiens
  misc_feature: GYAE6OF01A1VQB.21.22.B11.1.454.CMB.1.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnaggaggtccaccatctcttgtctggagcaactcaacntcggaagtattatgtattctggtatcagcaactccaggaatcggccccaactcncatcagagatancagcgcctcgacggggtccctgaccgtattccgtctcggctcccgaagtctacggccaccgtcacgtccctccttaggaccctaatccgacggttcgggcccgttcccgggtaccggaaggtacttggggaaggtcccgttagtaacccgttagtttaaccgtggtcgacctaagtcccgaaaccggggacacgaaaccgtgtcgggaattacggactaaagttcgtacggtacggttcggggttttagggcggtttaccggggaccggggtaaacgggtaaccccgttaaaactcccggggaaacccctttccggtaaacggggttaccc

SEQ ID NO: 24318 - DNA, 650 bp, Homo sapiens
  misc_feature: GYAE6OF01CQCYC.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagccgtcgcgggaccccggcaggagggtccaccattctcttgttctggaggccaactcaacagtcggaagtaattatgttattcgtgtatcagccaactccgaggaactccgaccccaactcctcacgtcagagaatatcagcgcctcgacgggtcctgaccgtattcctacgtcggtcctacgtaagtccgttcggacctaccgtcaccggtcccttcccctagaccctcgtacgtcggtacgggtcccgtaccgggtacccgaggtacgtggaacggtccgttacgtaaccttacgtttacgttcgtcgtacctacggtaccggaaccgggacgacaacgtaggtaggactaacgaactaacgtcgtaagggtcgggttacggggttcgggttcgggttaccggggaggaaccgggtaacccgtacggttacgaaccggttcgtaaccgggtacccgg

SEQ ID NO: 24319 - DNA, 958 bp, Homo sapiens
  misc_feature: GYAE6OF01DKPAI.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctcgggcccagtctgtgctgactcacgcccaccctcacgcgtcgtccggggacccccgggcgaggacgggtccacctatccttctttggttccgtgggacggtaccaactaccaactacgtaccgggtaaagttaaatttatagttactttcgttaggtacttcgaacgacctaaccttaccccggaaagggtaaaccgttacccgggaaccccccctaaaccgttccctaccgtaaccttacccgaaagggtaacgggtaaaacttaactaccgaccggtaccccgggtccccgttacggaaccggggggttccctaacggtaaaccggttaactttccgttaccggtcgggtacccttaccgtaacggttcccgtacgggaccctaacccctcgtaccgtccccttacccttacggaacccctaacgtcggtaaccgggttccggggtacccgttccccggggtaaccgggtacgggtaacgggtcgggtaacccggggtacgtttaacggttaacctttaacgttttacccgggttcggttaccggtacgtttaaccgttaacccggggtaaccccggggggtaaccgaaaccggtaaaccggttaacgggttaccggggaaagttaaacccgggtaaacctaaacggtttcccggtaggggtaaccgggggttttcgggggttttacggggggtttaccgggttaccccggggggtaacggggtaaacccggggtaaaccccgtaaaaccggtttccccggggtaaccccgggttaacggttcccgggtaaacccggg

SEQ ID NO: 24320 - DNA, 320 bp, Homo sapiens
  misc_feature: GYAE6OF01C4CO4.21.22.B11.1.454.CMB.1.raw
  modified_base (178)..(178): a, c, t, g, unknown or other
  misc_feature (178)..(178): n is a, c, g, or t
  modified_base (292)..(292): a, c, t, g, unknown or other
  misc_feature (292)..(292): n is a, c, g, or t
  modified_base (297)..(320): a, c, t, g, unknown or other
  misc_feature (297)..(320): n is a, c, g, or t
tcagtcgtcgctcgcacgaccggtgctcgatttagacgacagctcaggggtccctgaccgattcctctggctccaagtctggcacctcagcctccctgaccatcagtgggctccggtccgaggatgaggctgactattactgtgcatcacgggacgcaacatgggatgacatctgagnggttggtgtcggcggaggaccaactgaccgtcctaggtcagcccaagcctcgcccctcgtcactctcgttccccgccttcctcctcgtctctacgtgacgcggctggcaaggcncatannnnnnnnnnnnnnnnnnnnnnnn

SEQ ID NO: 24321 - DNA, 797 bp, Homo sapiens
  misc_feature: GYAE6OF01DODFS.21.22.B11.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcgagggtccgtgggcccagtctgtgctgactcagccaccctcacgcgtccgtcggggacccccgggnaggacgggtcacctattcttcgttgttcgtgggacggtaccaacctaccaacgtaagttaccgggtaaagttaaactttagtagtttaactttacgtagggtactaccgaacgtacctaaaccgtccccgaacgggtaacgtacccgggtaaccccctaaaccttccgtaccaacttaccgaaggaacggtaaacttaacgtaccggacggcccggtacccgtacggtaccgggggttacccctagggtaacccgttaatttccgtcgtacggtacccttaccgtaacgttccgtacgggtaccctaccgttccgtaccgtccccttacccgtaccgtacccgtaacgttccggtacgggttacccgggtccgttacccggggtaccgagggtacgtacgggaccggttacgttacgtacgtttacgttacgtgtacgtactaccgttaccggacgggtaccacgtaacgtaggtgggaactacgaactacgtcggaggtacgggttgggttacgggttcgggtaccgggacggaaccggtaaccgtaacggtaccgtacccggttaggtacggtaccgg

SEQ ID NO: 24322 - DNA, 648 bp, Homo sapiens
  misc_feature: GYAE6OF01BIFSQ.21.22.B11.1.454.CMB.1.raw
  modified_base (212)..(212): a, c, t, g, unknown or other
  misc_feature (212)..(212): n is a, c, g, or t
  modified_base (529)..(529): a, c, t, g, unknown or other
  misc_feature (529)..(529): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcggggacccccgggnagagggtcaccatctcttgttctggagcaactcccaacatacggaaagtaattatgtattctggtatcagcacctccaggactcggaccccaaactcctacactccagagaatatcgagccgccctcgacggggtccctggacccgtattcctcgtggcctaccgaagttcgtacggtaccacccttcaccgtcccctacccgtcgaaccctagtccgagggtccgggtcccttcccgggtacccggaggtacgtggacggaccttcggtaaccttagtttaccgtaggtcgactacgttaccggacggggtaaccncgtaaacgtggtacggggatcgaaactagtcggtaggacgggttcgggttggggttcggttaccggggagggtaaccgggaaccttaaacggccgttaaccccggtgtcgggtaacccg

SEQ ID NO: 24323 - DNA, 754 bp, Homo sapiens
  misc_feature: GYAE6OF01C08FR.21.22.B11.1.454.CMB.1.raw
  modified_base (58)..(58): a, c, t, g, unknown or other
  misc_feature (58)..(58): n is a, c, g, or t
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (621)..(621): a, c, t, g, unknown or other
  misc_feature (621)..(621): n is a, c, g, or t
tcagtcgtcgctcgcacgaccggtgctcgatttagacgacagctcgaggggggggaanctcagcttcagctgtggtagagaagacaggactcaggacaatctccagcagtggccggtcttccctctcctcctcaccctcctcactcactgcgcgacgggtcctcgggcccagtctgtgctgactcacgccaccctcagcgtcgccggggaccccggnaggacgggtcacctnttctcgttgttcgtgggacgccaaccgtccaacgtagtacggtaaagttaatttagtagttaatttccgttaggttacttacgaacgtaccctaaaccgttacccgaaggaaccgtccggaacccccctaaaacttccctaacgactaccgaaaggtaacggtaaaacttaactaccgaacggtcccggtaccccgttcggaccgggggttccctacggtaaccgttacttccgtccgtacggtcctaccgtaacggttccgtacggacccttacccgtccgtaaccggtccccttcccgtaacgaacccgtagtaccggtaacggggttccgggacccgttccccggggtaacggaggacgttcggaacggtctacgtaaaccttttntacgtcggtacgaccgtacgtacccggaacgggtacctaacgacgttaggagggactacgactaagtcgaggtacggttgggttggttcggacgggacgtaacggaacctaacggcgtaccgaggtcgaccgg

SEQ ID NO: 24324 - DNA, 522 bp, Homo sapiens
  misc_feature: GYAE6OF01E0JEX.21.22.B11.1.454.CMB.1.raw
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
  modified_base (470)..(470): a, c, t, g, unknown or other
  misc_feature (470)..(470): n is a, c, g, or t
  modified_base (495)..(495): a, c, t, g, unknown or other
  misc_feature (495)..(495): n is a, c, g, or t
  modified_base (511)..(522): a, c, t, g, unknown or other
  misc_feature (511)..(522): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcgacggggtccctgaccgattctctggcctccaagtctggccacctcacgccctccctgaccatcgaggtcgggccttcccgggtccggaggagtggacggctagaccttatttacctgtcgctagtccgacgggaccacaacagtgggatgacaatctggagtcgggttggtggtcgggcgggacgggaccaacgtcgaccgtcgtagcagccgagccncgcccctcgtcnctctctcccncctcctctctctctcgtgcgcggcncggcgacgcgcagtgnnnnnnnnnnnn

SEQ ID NO: 24325 - DNA, 874 bp, Homo sapiens
  misc_feature: GYAE6OF01D93JF.21.22.B11.1.454.CMB.1.raw
  modified_base (852)..(852): a, c, t, g, unknown or other
  misc_feature (852)..(852): n is a, c, g, or t
  modified_base (858)..(858): a, c, t, g, unknown or other
  misc_feature (858)..(858): n is a, c, g, or t
  modified_base (867)..(867): a, c, t, g, unknown or other
  misc_feature (867)..(867): n is a, c, g, or t
  modified_base (870)..(870): a, c, t, g, unknown or other
  misc_feature (870)..(870): n is a, c, g, or t
  modified_base (872)..(872): a, c, t, g, unknown or other
  misc_feature (872)..(872): n is a, c, g, or t
tcagtcgtcgctcgcacgaccggtgctcgatttagacgacagctcagggtcctgggcccagtctgtgctgactcagccaccctcagcgtcgtcgggaccccgggcagagggtcacatctcttgtctggaggcaactccaacatcggaagttaattatgttattcgtggtatcagcaactccgaggactcggaccccaaactcctacactaccgagaaggaattaacgtcgaacgccggtccctcggtacgggggttccctacggtaaccgtactttcgtcgtcggtacctaccgtaaggttcctcggaccctacctcgaccggtccccttacccgtacggaacctacgtccggacggggttccggggtaccccgttacccgggtaccggaagggtccggttacggaaccgggtccttaacggtaaccgtttacgtttaacggtcggttacgaccttacgtaccgggaacccggggtaacaaccgtaacgttacgggtaggtaaacgtacgtaaacgtaccgttacggtggggtaaccgggtttcgggggtttacgggttacggggttaccgggggaaccggggtaaacgggtaaacccgtaaccggtaccgggttaacccggttaccggttacggtaacccggaacccggtaacccggtaccgggtaccccgttcccgggtacccccggtcgggttaacccctccggttaccccggttccccgtttaacccccgtacccccgttccccggtaacccgggtaccggtaacccggaccggtaccggtacgggtaccgggcccggggttacgacccgggacgggtacccggtccgtaacggtaacggtcgaccgngcgcgngtacgcagngcngngc

SEQ ID NO: 24326 - DNA, 668 bp, Homo sapiens
  misc_feature: GYAE6OF01E2YGG.21.22.B11.1.454.CMB.1.raw
  modified_base (335)..(335): a, c, t, g, unknown or other
  misc_feature (335)..(335): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcctcggggacccccgggcagagggtcaccatctcttgttctggagcaactccaacatacggaagttaattatgtattctggtatcagccaactcccgaggaacgtcgacccccaactcctcactaccgagaagaataancacgccgccctcggacgggtccctagacctattcctcgtcgcctaccagtcgtcggacctaccctcgacccgtccctccccgtacgaaccctacgtaccgaacggggttccgggtcccgttacccgggtccgggaaacggttacgtacgggacggttcgttacgtaacctttaagtttaccgtggtacgaccgtacgtacccgggaacgggtaccacgtaacgaggtacgggatagactagtcgtagggtcggttcgggttaggggtcggtacccggggaacgggtacccgggaaacctaacggtaccggtcccgttacggtccgggtaaccg

SEQ ID NO: 24327 - DNA, 812 bp, Homo sapiens
  misc_feature: GYAE6OF01D29AU.21.22.B11.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctcgactcacgccaccctcacgccgtcgtccggggacccccgggnaggacgggtcaccatctcttgttctgggacgcaacctccaacagtacggaagttaacttagtgtacttcgtaggtactcgacgtacctaacctacccgaaggtaactccggaacccccctaaaacgttccctacaacgtaccaaggtaacggtaaattaaactccgaacggtccccggtacccgtacggtaccggggtcccctacggaaccgttacttcccgttacgtacggtaccttaccgtaacggttaccgtccggacctacccgtacgacccgtccccttacccgtacgtaacccgtacgtaccgtacgggttccgggtacccgttaccgggtaccggaagggtacgtacgggtacgtacgtacgtacgtttaacgttacgttcgacggtacctaacgtccgggaaccgggtaccgaacgtaacgtacggtaacgggtataacggtaacgtacgtacgggtacggtacggggttacgggggttacggggttaccgggttaccggggggaaccgggtaaaccgggtaaaccccgttaaaacgggttacccgggttaacccccggtttaccgggtaaccgggtaaaccccggg

SEQ ID NO: 24328 - DNA, 879 bp, Homo sapiens
  misc_feature: GYAE6OF01CL10M.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctgggcccagtctgtgctgactcacgcccacctcagtcgtccgaccggggaccccggagaggacgggtccacgacgttcttctttcgtcgtgggacgtacaacctccaacgtagtaccggtaaagttaattagttagttaacgttgttaggtacttaccgacgtaccctaaccgtacccggaacggtaaccgtaccccggtaaccccctaaaccttcccgtaccaacgttaccgaaaggaaacgtaaaacttaacgaccgaaccggtacccggtaccccgttacgggtacccggggttaccctaaccggtaaccgttaacgtttcgtccggtacggtccctaaccgtaacggttcccgtacggtacctaccccgtaccgtacccgtaccccttacccgtaccgtaacctaccggttacggtacgggttacccgggtcccggtaccgggtaacccgggtaagggtacgtacggtaccggtacctaacggttacctttaacgttcggttacggtacgtaccgtaaccgggtaccggaaacccggggaccgaaccggtaaacgtaacgggtacgggtacgttaacgtaaaccggacgttacggtaacggggttacggggttaccggggtttacggggttccggggttaacccggggaaccgggttaaccggtaacccggttaaacggtcccgggtaaaccggttaccgggtacgtaccccgggg

SEQ ID NO: 24329 - DNA, 674 bp, Homo sapiens
  misc_feature: GYAE6OF01BMADE.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccgggcagacgggtcaccatctcttgttctggagcaactccaacatacggaagtaattatgtattctggtatcagcaactccaggaatcggacccccaactcctcactccagagaataatcagccgcctcggacgggtccctagaccgtattctcgtggctaccacgtcgtgccacctcacgccctcctcgacccatccgaggtcggccgtccggaccgaggtatggacggtccttagacctttagtttacgtggtcgacctacgtacggaaccgggggtaccaaccgaaaccgtggtacggggtaactagggtaaacctaaacttcgggttaagggtacggggtttaccgggggttttcggggggttcgggtttaccccggggggaacggggtaaaccgggggtaaccccgttaaaaaccggttccggggtaaacccccggtttaccggtaaccggggttaaccccgg

SEQ ID NO: 24330 - DNA, 653 bp, Homo sapiens
  misc_feature: GYAE6OF01BZC9H.21.22.B11.1.454.CMB.1.raw
  modified_base (638)..(638): a, c, t, g, unknown or other
  misc_feature (638)..(638): n is a, c, g, or t
  modified_base (642)..(642): a, c, t, g, unknown or other
  misc_feature (642)..(642): n is a, c, g, or t
  modified_base (644)..(645): a, c, t, g, unknown or other
  misc_feature (644)..(645): n is a, c, g, or t
  modified_base (647)..(653): a, c, t, g, unknown or other
  misc_feature (647)..(653): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcgaggggtccctgaccgattctctggctccaagtctggcacctcagccctccctgaccatcaggtcggcctccgggtccgaggatggaggctagactattactgtgcataccgacgggacacaacagtgggatagaactaattcgtaggacggtcgggtttggggtcggttaccggggacgggtaacggggtaacccgtaaacgttccgggtaacccggttcccgttaacgggtacccgaacggaccccgaaacgggtccctacccggtccccccgttcgggtccctacccgttcccgttacccggttccccccgtccccgttccccttccccgttcccgttcccttcccgttaccgtcggaccggtccggggtccgtcgggaccgtaacgggccgaccgtaacgtacgnacgncnngnnnnnnn

SEQ ID NO: 24331 - DNA, 841 bp, Homo sapiens
  misc_feature: GYAE6OF01ERQU6.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgagggtccgtgggcccagtctgtgctgactcacgcccaccctcagccgtccgtcggggacccccgggcgaggacgggtccaccatcttcttgttccgtaggtacggaccaacctaccaactagtacggaattaattatagttattcgtggtatacagacctaacctcccgaaggtaactccggacccctaaacctcctacactaccgagtaaggaataacgtcgaacggccgcccgtacgtaccggggtaccctacggtaccgtacgttccttcgtacggtccttaccgtaacggttcgtcgggtacccacccgttaccgacccggttccccttcccggtaacgacccttaacgttcccggaagggggttccggtaccccggtaacccggggttcggaagggtcgttacggacggttcccttaagtaaccgtttcgttttacgcgggttacgaacccgttaggtaccccggaaaccgggggtaaccgtaaccgtaaaacggtcgggttaaacggggtaccgttaaacgggaaactttaaacccgggtttcgaaagggggtttcccggggtttaagggggggttttccgggggttaacgggtaccccggggggtaaacggaaaccccggggttaaaccgttaaaccggttccccggggttaaaccccgttcgggttaacgggtaacccccgg

SEQ ID NO: 24332 - DNA, 953 bp, Homo sapiens
  misc_feature: GYAE6OF01E546R.21.22.B11.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagacgacagctcaggggggggaagctcagcttcagctgtggtagagaagacaggactcaggacaatctccagcatcggccggtcttccctctcctcctccaccctcctcactcactgccgcgacgggtccgtcgggcccagttctggtgctagacctacacgacccaccctcacggtccgtccgggtacccggggaccccccgggngtacgggtaccgggtacccaaccctacttcctttccgtttcggtttcggtagggaaccggtaccctaaaccgtaccctaaacgtaccggttaacgggaaaagttttaaatttagttacgtttaacgtttaccgtagggttaactaccgaacgtaccctaaacccggttaccccgaaaggggtaaaccgttacccccggaaaccccccttaaaacttccccgtaacctaacccgtacccgggtaaaaggtaaacgggttaaaacttaacccgtacccggtaacccgggtccccggggtaccccgttaccgggtaacccgggggttaccccgtacggtaaccccgttacggtttcccgtacggtttccgggtaccctaacggtaacgtccgttaaccggacctaacccgtcgtaccctccccgtccgtaacgtaccttacggacggtaccggggtccgtacccggttccgggtacggaagtcgtcggacggttctaaccgtacgtttaacgtttccggagtaccgtcctaaaccggggtacccggaacgggaaaccgacgttaaacggtcgggtaacggttaggaaacgtacccgttagtacggggtttcggaacggggttggggggtttaccggtacggggtaccgggggaaaccgggtaacccgtaaaccctaccgggtaaccgtccccgggttaaacggtacccgggaacccg

SEQ ID NO: 24333 - DNA, 304 bp, Homo sapiens
  misc_feature: GYAE6OF01EH318.21.22.B11.1.454.CMB.1.raw
  modified_base (297)..(304): a, c, t, g, unknown or other
  misc_feature (297)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgcccctggtcactctcgtcccgcctcctcctcgtctctactgagcggctggcaaggcgcatagnnnnnnnn

SEQ ID NO: 24334 - DNA, 309 bp, Homo sapiens
  misc_feature: GYAE6OF01EFYJ3.21.22.B11.1.454.CMB.1.raw
  modified_base (302)..(309): a, c, t, g, unknown or other
  misc_feature (302)..(309): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggaggaccaaactgaccgtctaggtcagcccaaggctcgccccctggtcactctcgtcccgcccttcctcctcgtcctctactgacgtcgggctggcaaggcgcatagnnnnnnnn

SEQ ID NO: 24335 - DNA, 836 bp, Homo sapiens
  misc_feature: GYAE6OF01BRFBX.21.22.B11.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagacgacagctcgaggggggggaagctcagcttcagctgtggtagagaagacaggactcaggacaatctccagcatggccggcttccctctcctcctccaccctcctcactcactgcgcgacgggtccgtgggcccagtctgtcgctgactcacgcccaccctcacgcgtccgtccggggacccccggngaggacgggtccacctattccttcgttgttcgtggacgaccaacctaccaaacagtacggtaaagttaattatagtattcgtaggtactacacgaccaacctcccgaaggaacctcccggaaccccctaaactccctactaacctaccgaaggtaacggtaaaattaacgtaccgacggtccccggtaccccgtaccgggtaacccgggggttcccctaacggtacccgttacgtttcccgttaccggtccggtacccttaaccggtaacggtttcccggtacggaaccccttaaccccgtccgtaacccgtccccctttaccccggtaccgtaacccgtacgttcccggtaacgggtttcccgggtacccgttacccggggttaaccggaaggttacggtacgggtacggtcttaacggttaactttaacgttaacgtggtacgacgtaaccgtaccgggaaccgggtaaccaaccgtaagagtacgggtatacgtaacctaacgtacggtaggtaccggggttgggtttacggggtcggttaccggggaacgggtaaccgggtaaacccgttaacggtacccgggtaacccgttcggtaacccgggtacccg

SEQ ID NO: 24336 - DNA, 938 bp, Homo sapiens
  misc_feature: GYAE6OF01D8CWF.21.22.B11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagacgacagctcgagggggggggaagctcagcttcagctgtggtagagaagacaggactcaggacaatctccagcatggccggcttccctctcctcctccaccctcctcactcactgcgcgagggtccgtgggcccagtctgtgctgactcacgcccaccctcacgccgtcgtccggggacccccggnagggacggtccacctattccttcgtttcggttcgtagggacgaccaaccgtaccaaacgtagtaacggaagttaatttagtgttattcgttaggtatccgagacctaacctcccgaaggtaccgtaccggaaccccctaaactcctacacgttaccgaaagggtaacgtaaataactccggtaaccggtccccgggtacccgttacgggtaaccgggggttccctacggtacccgttacttccgtacgtaccggtacccgttaccgtaacggttccgtccggacccttacccggtaccaccccggttacccttaccccgtacggtaacccctaggtttccgggtaacggggttccccgggttaacccgggtaccccgggtaacggggtaacggtacggttacgggaaccggtacgttaaacgttaaccgtttaaccggttttagttcgggtaaccgtaccggttaacccggtaaccgggaccccggggtaaaacctaccggttaaaagggttcccgggttaacggggttaaacacgttaaaaccggttaccgggttaaccgggttaacggggggttcggggttttaaccggggggggtttttacggggtcccgggggttaccccgggggtaaaccggggtaaacccggggttaaacccctaaacccgggttttaccgggaacccccgggtttaacgggttacccgaaaccccggggg

SEQ ID NO: 24337 - DNA, 778 bp, Homo sapiens
  misc_feature: GYAE6OF01D7Q9C.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtccgtcggggacccccgggnaggagggtcaccattctcttgttcgtgggacggaccaactccaacagtacggaagttaattatgttattcgtggtatacagaccaacctcccgaaggtaactccggaccccctaaactccctacactaccaggaacggtaaataactcgacgccggtccctacggaccggggtccctcgaacctcttcctacgtcggtacctccgtaaacggttccgtcggacccgtacctacgtaccgtcccctaccctaccgaacctaccgtcgtacgggtccgggtaccgttacccggggtaccggaacgggtactacggggacggtccgtttacgaacgtttacgtttacggttcgggtcgtaaccgtacgttacccgggaaacccgggtacccggtaaacgtaacgtaacgggttacggtaacggttaacgaacgttaacgtacgggttagggtaccggggtttcggggggttacggggtttccggggttaaccgggggaccgggtaaacgggtaacccgttaaaccggtaccgggttaccccggttaccgggtacggtaaccccggg

SEQ ID NO: 24338 - DNA, 770 bp, Homo sapiens
  misc_feature: GYAE6OF01ASYTB.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggaccccccgggcagacgggtccaccatccttcttgttctggaggcaactccaacatcggaagtaattatgtattctggtatcagcaactcccgaaggaactcggacccccaaactcctcactccaagaaggaaataatcgacggccggccctacggaccggggtccctggaacccgtacttcctcgtcggcctaccgaagtccttacggcctacccttcgaccgtcccctacccgtacgaaccctataccggtacgggttcccggggtccgtttacccccggggacccggtaagggtaaccgttacggggtaaccggggtccctttaacgggtaacccttttaacgtttaaccggttacgttaccgggtacctaacggttacccgggaaaccgggggtacccgaccgtaaacgtacgggttacggggtaacttaacgggaacctaaacgttccggtaagggtaccggggttcgggggttttcggggtcgggtttaccgggggacgggtaaaccgggtaacccgtaaacccggttaccggggaaccccgttaccggtacgggtaacccg

SEQ ID NO: 24339 - DNA, 587 bp, Homo sapiens
  misc_feature: GYAE6OF01A8N8V.21.22.B11.1.454.CMB.1.raw
  modified_base (212)..(212): a, c, t, g, unknown or other
  misc_feature (212)..(212): n is a, c, g, or t
  modified_base (449)..(449): a, c, t, g, unknown or other
  misc_feature (449)..(449): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggnagagggtcaccatctcttgttctggagcaacgtccaacagtcggaagtaattatgtattcgtaggtatcgagcctaacctccccgaaggtaactccggaccccctaaactcctacactccaagaggaataatcagccgcctcgacgggtccctgaccgtacttctcgtcggcctacgaacgtctggcctacctcacgtccctccctgacctatcgaggtcggcctccgggtcgaggntggagctagacttatcgtgtcgctagccgacggactacagagtggatcgaactagtcgtacggtagggtcgggttaggggttcggttacgggccgggaacgggtacccctaaagtccggacccgttcgacggtacccg

SEQ ID NO: 24340 - DNA, 621 bp, Homo sapiens
  misc_feature: GYAE6OF01EAD1T.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggcaggacgggtcaccatcctcttgttctggagcaactccaacagtacggaagtaattatgtattctggtatcagcaactcccgaaggaactccggacccccaaactcctacactaccaaggaagtaataaatcgacggccggccctcggacggggtccctgaaccgtattcctcgtcggcctaccgaagtcctggccacctcgacgtccctccctagacctgtcgaggtcggcctccgggtcgagtagtgaggtctagtactattacgtgcgcacgtacggacgggacacaacaggtacgggatacgaactacttcgtagggacggtcggggtttgggtacgggttacccgggacgggaaccgggtaaacccctaaacggttccggaaccccggtttgtagggtaccccg

SEQ ID NO: 24341 - DNA, 627 bp, Homo sapiens
  misc_feature: GYAE6OF01D1JEO.21.22.B11.1.454.CMB.1.raw
  modified_base (212)..(212): a, c, t, g, unknown or other
  misc_feature (212)..(212): n is a, c, g, or t
  modified_base (358)..(358): a, c, t, g, unknown or other
  misc_feature (358)..(358): n is a, c, g, or t
  modified_base (406)..(406): a, c, t, g, unknown or other
  misc_feature (406)..(406): n is a, c, g, or t
  modified_base (446)..(446): a, c, t, g, unknown or other
  misc_feature (446)..(446): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnagagggtcaccatcttcttgttctggaggcaactccaacatacggaagttaattattgtattctggtatcagcaacctccaaggaactccggaccccaactcctcactccaaggagaataatcacgccggcctcggacgggtcccngaccgtattcgtcgtgcctctaagtcgtggcacctcacgcccttaccncgaccactcgacggttcgggcccttccgggtaccgaaggntggacggtctagtaccgttattacgtgtcgacttacggccggaacgggactaaccaatgggtagggtactagaactaattccggtagggtaagggttcggggttaggggttcggtccgggggacgggtaaaccgggaacccttaaacggttccgggaaccccgttccggtaggtaccccgg

SEQ ID NO: 24342 - DNA, 777 bp, Homo sapiens
  misc_feature: GYAE6OF01C8LTL.21.22.B11.1.454.CMB.1.raw
  modified_base (221)..(221): a, c, t, g, unknown or other
  misc_feature (221)..(221): n is a, c, g, or t
  modified_base (295)..(295): a, c, t, g, unknown or other
  misc_feature (295)..(295): n is a, c, g, or t
tcagtcgtcgctcgcacgaccggtgctcgatttagacgacagctcgagggggggggaagctcagcttcagctgtggtagagaagacaggactcaggacaatcctccagcagtggccggcttccctctcctcctccaccctcctcactcactgcgcgagggtcctcgggcccagtctgtgctgactcacgcccaccctcgacgccgtcgccgggaccccggngacgggtacgtacactcttcgttgttcgtcggacggacgactaccaacaacgtacggtaaagttaattaagttnttagttacgttagtacgtactacgaacaccgtacccgaacggtaacggtaccggaacccccgtaaacccctacttcccgaataccgaacgtaaaggaaaacttaaactcgaaccgcccggtacccggtaccgaccgggtaccgtccgacgtaacgttctccgtcggacctaccgtagtaccgtcgtcaccgtccacgtcttcccacacgcttacggcggtcggtaccgtcccggaacggtacgaggtacgtacggttcgacgtttaacttaacgtttacgtacgtacgaccgtacgtaaccggaccgggaaccgttacaaaccggttagtcggtaagaaccacgtaacgtccggttagggaccgggttttcggggttcggggtaaccgggtttcgggggacccgggaaacggttaaaccccggtaaaaccgttccggggttaaccccggtttaaccggtacccggggtaacggaaccccggg

SEQ ID NO: 24343 - DNA, 821 bp, Homo sapiens
  misc_feature: GYAE6OF01B997G.21.22.B11.1.454.CMB.1.raw
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
tcagtcgtcgctcgcacgaccggtgctcgatttagacgacagctcgagggggggggaagctcagcttcagctgtggtagagaagacaggactcaggacaatctccagcatggccggcttccctctcctctcaccctcctcactcactgcgcgagggtccgtcgggcccagtctgtgctgactcacgcccacctcacgcgtcgtcggggaccccggnaggacggtcacatcttcttgtcgtggacgccaactaccaacngtacggtaaagttaattatgttattcgtaggtactcgacgacctaaccgtacccgaaggtaaccgtcccgaaccccctaaacttcctacaacgtaccgaaggtaaacgtaaacttaacgcgaaccggtcccggtacccgttacgggtaaccgggggttcccctacggtaaccgtacgtttccgtacggttccggtacccttaaccgtaacggttccgtaccgggtaccctaacccctaccgtacccgcccctttacccggtactaacccgtacggtaccggttacggggtcgggtccccgttaccggggaaccgaggttacgacgggtacgtccgttacgtaacttacgttacgtcggtacgtacgtaacggtcccggaaaccggggtacctaaccgaaacggttacgggttacgggaactttacggaaaccctaggtttacccgggtagggtaccgggtttcggggggtttacggttccgggggttaccggggaacggggtaaccccgggtaaaccgtaaccggttacccgggtaacccgttaccggggtgtaaaccccggg

SEQ ID NO: 24344 - DNA, 681 bp, Homo sapiens
  misc_feature: GYAE6OF01DWSOG.21.22.B11.1.454.CMB.1.raw
  modified_base (212)..(212): a, c, t, g, unknown or other
  misc_feature (212)..(212): n is a, c, g, or t
  modified_base (469)..(469): a, c, t, g, unknown or other
  misc_feature (469)..(469): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcccgggcccagtctgtgctgactcagccaccctcagcgtcgtcggggacccccgggnaggagggtcaccatctcttgttctggagcaactccaacagtacggaagtaattatgttattcgtagtatcagccaactcccgaggaactccggacccctaactcctacactaccagaaggaacttaatcgacggccgcccgtacggacgggtccctacgaccgtattcgtcgtcggctaccagtcgtcggccactcgacgtccctccgtacgacccacttcgacggtcgggtacccgttccgggtacggaggtacgnggtacggtcgtagtactatttacgtgtcgtctaacgtccggaaccgggtaccgactaaacgtgtaggggtactacggtaactaagttcgtacgggtacgggttaccgggtttgggggttccgggttccggggtaaccggggtaacggggaaacccgttaaacggtacccgggtaacccggtttacccggtaccgggtacccgtaacccgggg

SEQ ID NO: 24345 - DNA, 609 bp, Homo sapiens
  misc_feature: GYAE6OF01D362V.21.22.B11.1.454.CMB.1.raw
  modified_base (227)..(227): a, c, t, g, unknown or other
  misc_feature (227)..(227): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (583)..(583): a, c, t, g, unknown or other
  misc_feature (583)..(583): n is a, c, g, or t
  modified_base (590)..(590): a, c, t, g, unknown or other
  misc_feature (590)..(590): n is a, c, g, or t
  modified_base (594)..(594): a, c, t, g, unknown or other
  misc_feature (594)..(594): n is a, c, g, or t
  modified_base (601)..(601): a, c, t, g, unknown or other
  misc_feature (601)..(601): n is a, c, g, or t
  modified_base (605)..(605): a, c, t, g, unknown or other
  misc_feature (605)..(605): n is a, c, g, or t
tcagtcgtcgctcgcacgaccggtgctcgatttagacgacagctcagggtcctagggcccagtctgtgctgactcagccaccctcagcgtctgggaccccgggcagagggtcaccatctcttgttctggaggcaactccaacatcggaagtaattatgtattctggtatcagcaactcccaggaatcggccccaaactcctcatccagaggaatatcagcggccctnaggggtccctgacccgtattctctggctccaagtctggccacctcagccctcctgacccatcaggtggtctccggtccgaggntgaggntgactattactgngcatcacgggacncaacgagtcgggaatgaaccgtaaattcgtagacggtacgggtttggggtacgtttacgggacggtaacggggaaccctaaacggtcggaacccgttccgtaaggtccgacgacccgtaaggcccgtacgtccccccgtcggtacccgtaccttcctcggttccccaacccccgttccgtccctccgttcctccgttacgtcggacggcgggtcgtacggcgaaaggccgtacagttacgnctagctnacgnaacgtcnctgntacg

SEQ ID NO: 24346 - DNA, 693 bp, Homo sapiens
  misc_feature: GYAE6OF01ESK16.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggaccccggnaggagggtcaccatctcttgttctggaggcaactccaacagtacggaagtaattatgtattcgtggtatcagcaactccgaggaactccggacccccaaactcctcactccaagaagaatactcgacgccggtccctacggacggggttcccaggtaccgtattccgtctcgggcctaccgaagttccgtcggccctaccctcgaccgtcccctcccgtacgaccctagtccgtacgggtcgggtccgtcccggggtaccgaaggtacgtcgggacgtacgttacgtaacctttacgtttaaccgtggtacgacctaacggtacccggaacggggaccgaaccgtaacggtaggtacgggtataaccgtaacgtaacgttccggtagggtacggggtttcggggttaggggttccgggttaccggggaacgggtaaccggtaaaccctaacggtaccgggtacccggttaccgtggtacccgg

SEQ ID NO: 24347 - DNA, 767 bp, Homo sapiens
  misc_feature: GYAE6OF01AWA9C.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcacgcgtcgtcggggacccccgggnagacgggtcaccatctcttgttctggaggcaactccaacagtcggaagtaattatgtattctggtatcagcaactccaggaactcggtaccccaaactcctacactaccaaggacggtaaataacgtcgacggtccggcccctcggaccgggggttcccctaggacccgtattccgtacgtcggaccttaccgtaacggtccgttacggcctaccccgtcgtaccggtccccttcccgtacggtaccctagttcccggtaacggttccggggtacccgttcccggggtacccggtaagggtacgttacgggaacgggtccttacggtaacctttacgtttacgtcggtacgtacgtaaccgtccgggtaaaccgggtaccgtacctaaacgcggttacggggaacttacggtaaaccgtaacgttccggttaggaaccggggtttcgggggtttacggggttcggggtttaccggggaccgggggtaaaccgggtaaacccgttaacccggttacccgggtaacccgggttacccggttaaggggtaaccccgg

SEQ ID NO: 24348 - DNA, 774 bp, Homo sapiens
  misc_feature: GYAE6OF01AL3BN.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctctcaccctcctcactcactgcgcgagggtcctcgggcccagtctgtgctgactcacgcccaccctcagcgtcgtcggggacccccggcgaggacgggtaccaccattcctcgtttggttccgtggacggacctaaccgtaccaactagtacggtaaagttaactttatgttatttcgtggttactcgagaccaccgtacccgaaggtaaccgtccggaccccccaaaacttcccactacgtaccgaaggaacggtaaactaacgtaccgaccggtcccggtacccgtaccggtaccggggttcccctacggtacccgtacgtttccgtccgtcggtcctaccgtaacgttccgtcgaccctaccctcgaccgtcccttccccgtagaccctacgtcggtacggtacgggtcccgtcccgggtacggacggtacgtacgggaccggtcttacgtaacctttacttccgttaggtctaccgtacgtacccggacgggtaaccgaaccgtaaacgtaggtagggtactaacggtaacgtacgtacggttacgggtacggggttcggggttacggggtttcgggtaccgggacggggtaaaccggtaacccggtaacgtcccgggttaaccgtccggttaacggtaccccgg

SEQ ID NO: 24349 - DNA, 601 bp, Homo sapiens
  misc_feature: GYAE6OF01BOV8D.21.22.B11.1.454.CMB.1.raw
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (594)..(596): a, c, t, g, unknown or other
  misc_feature (594)..(596): n is a, c, g, or t
  modified_base (598)..(600): a, c, t, g, unknown or other
  misc_feature (598)..(600): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagccggccctcgaggggtccctgaccgattctctggctccaagtctggcacctcagcctccctgacccatcagtggcctccggtccgaggatgaggctgacttagttactgtnctatcgacgggaccgctaaacgngtcgggatacgactaatcgtaggacgggtcgggttggggtggttccggggacgggtacggggaaccaacggttcggaccgttccgaaggttaccacggacccgaagcccgtaccgcccccgtcggtcctaccgtcctcccgttaccccacccttccgttccctaccgttcctaccgttaccgtcggacgccgggtactcgggaccgaacgggtccgcgtaacggtcgagtcngncncgcnnncnnnc

SEQ ID NO: 24350 - DNA, 580 bp, Homo sapiens
  misc_feature: GYAE6OF01AG3VU.21.22.B11.1.454.CMB.1.raw
  modified_base (351)..(351): a, c, t, g, unknown or other
  misc_feature (351)..(351): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggaggagggtcaccatctcttgttctggagcaactccaacatcggaagtaattatgtattctggtatcagcaactccaaggaactcggaccccaactcctcactccagagtaataatcagcgcctcgacgggtccctgacctntctctcgctcaagtctcggcacctcacgccctccctacgaccactcgacggtcggccttccgggacgaggacgtggacggtctagacttacgttctgtcgcacgtccggaacgggtacacgtaacgaggtaggactagactaagtccgtaaggcggttcggggttagggtcggttaccggggacggtacgggtaaccaacggttcgacccggttccggtaggtacccgg

SEQ ID NO: 24351 - DNA, 559 bp, Homo sapiens
  misc_feature: GYAE6OF01DBDNF.21.22.B11.1.454.CMB.1.raw
  modified_base (210)..(210): a, c, t, g, unknown or other
  misc_feature (210)..(210): n is a, c, g, or t
  modified_base (257)..(257): a, c, t, g, unknown or other
  misc_feature (257)..(257): n is a, c, g, or t
  modified_base (294)..(294): a, c, t, g, unknown or other
  misc_feature (294)..(294): n is a, c, g, or t
  modified_base (354)..(354): a, c, t, g, unknown or other
  misc_feature (354)..(354): n is a, c, g, or t
  modified_base (492)..(492): a, c, t, g, unknown or other
  misc_feature (492)..(492): n is a, c, g, or t
  modified_base (511)..(511): a, c, t, g, unknown or other
  misc_feature (511)..(511): n is a, c, g, or t
tcagtcgtcgctcgcacgaccggtgctcgatttagacgacagctcgaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcacatctctgtctggagcaactccacatcgaagtaattangtatctgatcagtcaactccagaatcgacccaactcncatccagagaatatcacgcggcctcgagggtccctgaccgtatctctcgctaccagtcgngccaacctcacgtcctccgtagacctatcgagtcgggacctaccggttacggaggagttcggaaggtctacggtaacttaagttcgtagtcgactacgtacgacgggtctaacaatagtgggatacggataacgtcgngaacggtgggtttacgggngttaacgggcgtaaacgggacctaaacgtgtacccgtgtacgtaaccg

SEQ ID NO: 24352 - DNA, 695 bp, Homo sapiens
  misc_feature: GYAE6OF01DAVCV.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtccgtcggggacccccggnagacgggtccaccatctcttgtctggagcaactccaacagtacggaagtaattatgttattcgtaggtatcacgcaacctcccgaaggaactccggacccctaaactcctacactaccaaggagtaaataactcgacgccggccctacggacgggtccctacgaccgtacttccgtcgtcggcctaccgtaacgtcgtacggcctaccgtccgacgtccctacccgtacgacctacgtcgacgggtcgggtcccgtcccgggtacggaggtacgtggacggtctacggtaactttacgttacgtgtacgcctacggtacccggaacggggacctacgaaacgtaggtcgggtaatacggaactaacgttcggtaagggtacgggttccgggggtttaggggttcggttacccgggggaacgggtaaccgggtaaaccctaaacggttccgggtaaacccggttccggtaacggggtacccg

SEQ ID NO: 24353 - DNA, 821 bp, Homo sapiens
  misc_feature: GYAE6OF01AVNW3.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgagggtccgtcgggcccagtctgtgctgactcacgccaccctcagcgtcgtccgggacccccggnacggacgggtcacctatccttctttgtcgtggacgccaactaccaacagtacggaaagttaattatgttattcgttaggtatcacgaccaacctacccgaaggaacgtaccggaaccccctaacctccctacgaactaccgaaggaacgtaaaataacgtaccgaacggtccgggaccccgttaccggaaccgggggttcccctacgggtaacccgttacgtttcccgtcgtacggtacccttacccgaacggttccgtccgggtaccctaacccgtcgtaaccgtcccccttacccgtacgaaccttaccgtaccggtacggggttcccgggtccccgttacccggggtacgggtaaaagtacgtcgggtaaccggtaccgtttacggtaaccccttttaagttaccggttacgtcggaacctaacggttaccgggaacccgggtacgtaaccgaacgtaacgggtaggaaccgtacgtaaaccgtaagttcgtaaggggtacggttcgggttttacgggggtcggtacccggggtaacggggaaaccccgggtaaacccttaaccggttcggggtaaacccgttcccggttaaaggggtacccc

SEQ ID NO: 24354 - DNA, 581 bp, Homo sapiens
  misc_feature: GYAE6OF01CRPJ8.21.22.B11.1.454.CMB.1.raw
  modified_base (568)..(568): a, c, t, g, unknown or other
  misc_feature (568)..(568): n is a, c, g, or t
  modified_base (570)..(574): a, c, t, g, unknown or other
  misc_feature (570)..(574): n is a, c, g, or t
  modified_base (576)..(581): a, c, t, g, unknown or other
  misc_feature (576)..(581): n is a, c, g, or t
tcagtcgtcgctcgcacgaccggtgctcgatttagacgacagctcagggtcctgggcccagtctgtgctgactcagccaccctcgagcgtctgggacccccgggcagagggtcaccatctctgttctggaggcaactccaacatcggaagtaattatgtattctggtatcagccaactcccaggaactcggacccccaaactcctcactccagaggaataatcagccggccctgacggggtccctgaccgattctctggctccaagtctggcacctcacgcctccctgaccatcagtgggcctccgggtccgaggactcgaggcctggactattactgtgcatccgacgggtaccgcaactagtcgggatacgactaagtcgtagaggtcgggttgggtcggttcgggacgggtacgggaaccgtaacgtcggaccgttccgtacgtacgacgacccgaacggcctcgcccccgtcggtccgtaccgtccgttccgttccccgtccccttccttcccgtccgtcccttaccgtacgtcggtacgcgggctcggcgacggcgcagtcgncnnnnncnnnnnn

SEQ ID NO: 24355 - DNA, 739 bp, Homo sapiens
  misc_feature: GYAE6OF01D3O97.21.22.B11.1.454.CMB.1.raw
  modified_base (731)..(731): a, c, t, g, unknown or other
  misc_feature (731)..(731): n is a, c, g, or t
  modified_base (733)..(733): a, c, t, g, unknown or other
  misc_feature (733)..(733): n is a, c, g, or t
  modified_base (735)..(735): a, c, t, g, unknown or other
  misc_feature (735)..(735): n is a, c, g, or t
  modified_base (739)..(739): a, c, t, g, unknown or other
  misc_feature (739)..(739): n is a, c, g, or t
tcagtcgtcgctcgcacgaccggtgctcgatttagacgacagctcagggtcctgggcccagtctgtgctgactcagccaccctcagcgtctcgggaccccgggcagagggtcaccatctcttgttctggaggcaactccaacatcggaagttaattatgtattctggtatcagcaactccaggactcggaccccaaactcctcactccaggaagaataatcgacgccggccctacggacggggtccctcgaaccgtctttcctcgtcggcctaccgtaacggttcgtacggaccctacccgtcgaccgtccccttacccgtacgacctacgtcgtacgggtccgggtaccccgttaccgggtccggaaggtacgtcgggacggtcctacgttaaccttacgtttacgtggtcgaacgtacgtaccggaccggggaactaccgaacgtaggtacggatacggtaactaacggttcggtagggtaggggttccggggtttaggttcgggttacgggacgggaaccggtaacgtaacgtcgtaccgtcgtacggtaccgaaccggaccgacgtcccgtcccgtacccggtaccgtcctaccgtcccgttcccgttccccgtcccttacccgttcccgtacccgtttccgtaccgttacggacggtaccggtacgggtcccgacgggtacccgaacggtccgacggtaacgtcgtacgcgtcgcgcgtcggactnancngcgn

SEQ ID NO: 24356 - DNA, 673 bp, Homo sapiens
  misc_feature: GYAE6OF01CTOTJ.21.22.B11.1.454.CMB.1.raw
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (328)..(328): a, c, t, g, unknown or other
  misc_feature (328)..(328): n is a, c, g, or t
  modified_base (358)..(358): a, c, t, g, unknown or other
  misc_feature (358)..(358): n is a, c, g, or t
  modified_base (652)..(652): a, c, t, g, unknown or other
  misc_feature (652)..(652): n is a, c, g, or t
  modified_base (668)..(670): a, c, t, g, unknown or other
  misc_feature (668)..(670): n is a, c, g, or t
  modified_base (672)..(673): a, c, t, g, unknown or other
  misc_feature (672)..(673): n is a, c, g, or t
tcagtcgtcgctcgcacgaccggtgctcgatttagacgacagctcagggtcctgggcccagtctgtgctgactcagccaccctcagcgtctcgggacccccgggcagagggtcaccatctcttgttctggaggcaactccaacatcggaagtaattatgtattctggtatcagcaactcccaggaactcggccccaaatcctcactccagaggaataancagcgcctcgagggtcctagacgattcnctggctcaagtctggccactcacgcctcctagaccatcgaggtcgggcctccgggtcgaggtctgacggctgactattacngtcgcagtccgaacgggtacgactaaacgngtaacggggatacgaaacgtaacgtcgtacgggaacggttcggggtttaggggttaccggtacggggtaccgggaacggggaaccgtaaacggtaccggttaacccggttacgtaaacgggttacgaaccggtaacccggaaccggtccgtacccggtcccccgtcgggttacccaccggtttccctacccggtttaacccctccccgttcccgttcccgtaccttcccgtaccgttaccgtcggacgggtccggtacgtcgggaaccgtacggccgtaaccgtagtaaccgtncgctagcgctacgacnnngnn

SEQ ID NO: 24357 - DNA, 725 bp, Homo sapiens
  misc_feature: GYAE6OF01ED6UQ.21.22.B11.1.454.CMB.1.raw
  modified_base (215)..(215): a, c, t, g, unknown or other
  misc_feature (215)..(215): n is a, c, g, or t
  modified_base (543)..(543): a, c, t, g, unknown or other
  misc_feature (543)..(543): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtccgtcggggaccccccgggnaggagggtccaccatctcttgttctggagcaactccaacatacggaagtaattatgtattctggtatcagacaactcccgaaggaactccggacccccctaaaactccctacactaccgaaggaagtaaataactcgaaggccggtccctcggacgggggtacccctaggaacccgtatttccgtctcggtacctaccgaacgttcgtcggtaccaccctcgtacgtccccttcccgtagaacccacgtcgaacgggttcgggtacccttcccggggtacgaagggtacgttcgggaacggtcttaacggtacctttaacgtttacgnggttacgacccgtacgtacccgggaacggggtaccgaaccgtaaacgtggttacggggaactaggaaccttaagttcggtacgggtacggggttccggggtttaggggtccggttaccgggggacgggtaacccgggtaaaccctaacgggttacgggtaaccccgttgggtacggtacccg

SEQ ID NO: 24358 - DNA, 616 bp, Homo sapiens
  misc_feature: GYAE6OF01AUAHV.21.22.B11.1.454.CMB.1.raw
  modified_base (210)..(210): a, c, t, g, unknown or other
  misc_feature (210)..(210): n is a, c, g, or t
  modified_base (609)..(609): a, c, t, g, unknown or other
  misc_feature (609)..(609): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccgggnagagggtcaccatctcttgttctggaggcaactccaacatcggaagtaattatgtattctggtatcagcaactccaggaatcggccccaaactcctcatccagaggaataatcagcgaccctcgacggggtccctagaccgtattcctctcggcctacctaagtccgtcggcctacccgtcacgcccttcccctgaccctatcgaacgggttcgggtacccgttccgggtaccggagggacgttcggaacggtcttaggaccttagttaccgtgttcgactaacgttaccgaccggggacctacaaacgtcgtaggggaacttggaacctagtcgtaggacggtcggggttagggtcggttcgggacggtaacggacccgtaaagtccggacccgttgnggtaccg

SEQ ID NO: 24359 - DNA, 702 bp, Homo sapiens
  misc_feature: GYAE6OF01EWBTT.21.22.B11.1.454.CMB.1.raw
  modified_base (544)..(544): a, c, t, g, unknown or other
  misc_feature (544)..(544): n is a, c, g, or t
  modified_base (581)..(581): a, c, t, g, unknown or other
  misc_feature (581)..(581): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctcgggcccagtctgtgctgactcagccaccctcacgcgtcgtcggggacccccgggcaggagggtcacctatcttcttgttcgtggacggcaactccaactagtacggaagttaacttatgttattcgttaggttataccgagtaccaaccttaccccgaaggtaacgtcccggaacccccctaaacgtccctaccgtactacccgaaggacggtaaataacgtcgacggaccggtccctacggtaccggggtaccctgacccgtagttcctacgtggtacctacgtaacgtcgtacggccacctcacgcccttccgacgacctagtcgtacgggtcggtccgaccgggtacgaggtacgtggacggccgtagtaccgttattacgnggtacgcctaacgtccggaccggtaaccacgtaacgnggttacggatacgacgttaccgaggttcgggtaggttcggggttagggttccgggtacgggggtacggaaacccggttaaccgaaaccgtccgggttacccgtcggtaccgggttacccgg

SEQ ID NO: 24360 - DNA, 812 bp, Homo sapiens
  misc_feature: GYAE6OF01CGXTJ.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcacgcgtcgtcggggacccccggcaggacgggtccaccattcctcgtttcgttcgtgggacggccaacctccaaacagtacggaaagttaattattgttatttccgtggttactcgagaccaacctcccgaaggtaacgtccggaccccctaaactccctacactaccgaggaaggtaactaactcgacggtccggacccgtcggaccggggtccctagacccgtattccgtcgtcggtacctccgtaacgtcgtacggaccctacccgttccaccgtccccttaccgtacgaacccgtacgtaccggacgggttcgggccccgttaccgggtacccggaggtacgtacgggtacggtcccttaacggtaaccgttttacgttaccggttggtaccgtaccgtacggttacccgggaaccggggtacccgtaaccgtaacgtaggggtacggtaactcccggtaaacgttccggttaacgtacgggggtttacggggttcccgggggttttagggggttcccggggttaaccgggggacccggggttaaacccggggtaaaccccttaaaccgggttcccgggttaaccccgggttaacccgggttacggggtaacccccgg

SEQ ID NO: 24361 - DNA, 840 bp, Homo sapiens
  misc_feature: GYAE6OF01AEQJS.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagccgtctcggggacccccgggnaggagggtcaccatctcttgttctggagcaactccaacagtcggaagtaattatgtattcgtggtatcagccaactccccgaaggtaactccggaccccccaaacttccctacactaccgaaggaacggtaaacttaactccgaacggcccggtaccccgtacggtaaccggggggttcccctaggtacccgtactttccgtcgtcggtcctaccgtaacgtccgtacggaccctacccgtaccgaccggtccccttaccccgttacgaaccccgtagttacccggtacggggttcccggggtacccgtttaccccgggggttacccgggaaaggggttaccgttacggggtaacccggggtaccgtttaaccgggttaaccttttaaacggttttacccgtacggggtttcgtaaccgttaacccggtacccgggtaaaccggggggtaacctaaacccgtaaacggttacggttacgggggtaaacttacgggaacctttaaacgtcggtaacgggggtacggtttcggggggtttacgggttccgggtttaccggggaccggggttaaaccgggtaaaccctaaacgggttcccgggaacccggtttccgggtaaaccggtcccgg

SEQ ID NO: 24362 - DNA, 665 bp, Homo sapiens
  misc_feature: GYAE6OF01AU167.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactccaggaactcggaccccaactcctcactccagaaggaataatacacgccggccctacgacggggtccctagaccgtattcctcgtcggtcctacaacgtcctcggacctaccctcgactcccttcccgtgaacccatcggaggttcgggacctccgggtccgaggacgtggacggcgtacgtaacttattacgtggtcgacctaagtcccggaacggggtaaccacgaacgagtacggggtaactacggaaccttaaagtccggtaacggtacggggttcgggggttttacggggttacgggttaccggggaaccggggtaaccggggtaaaccttaaaaccggtccgggtaaccccggttcccggtaacggggttaacccg

SEQ ID NO: 24363 - DNA, 775 bp, Homo sapiens
  misc_feature: GYAE6OF01ATWJV.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcacgcgtcgtcggggacccccgggcaggacgggtcaccatcctcgttgttcgtggaggcaacctccaacacgttacggaagttaatttattagttatttctggttaatcacgaccaacctcccgaagggaactccggaacccccctaaaacttccctactaccttaccgaaaggaacggtaaaacttaaacgtccgaaccgggtccccggtacccccgttccggtaaccggggggttacccccttacggtaaaccccggtactttcccgtacggtttacgggcccttaacccgtaaacggtttccgtccgggtaccctacccgttaccgtacccgtccccttaccccgtacggaaccctaagttcccggtaacgggttccgggtacccgtcccgggtaaccggtaggtacgtcggacgtctacgttaacttacgttacgtcgtcacgtacgtaccggtaacggaccgaactaacgtggtacggatacgtatacgtgtaggtcgggttcgggttgggttcgggtccgggaacgggtaaccgggtaaccctacgggttaccggtacccgttaacgggtcggtacccgg

SEQ ID NO: 24364 - DNA, 690 bp, Homo sapiens
  misc_feature: GYAE6OF01AYAQ9.21.22.B11.1.454.CMB.1.raw
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggaccccggnagacggtcaccatctcttgttctggacgcaacctccaanagtacggtaagtaattatgtattcgtgtatctagaccaacctccgaaggacgtccggacccccaaacgtcctcactaccaaggaacgtaataactccgacgccggtccctacggaccggggtccctacggaccgtattccgtcgtcggtcctaccgtaagttccgtcggacctacccgtaccgaccgtccctcccgtacgaccctacgtaccgtacgggttcgggtacccggtcccgggtaccggtaacggtacgtcgggtacggtcgtacgtaaccgtttacgttacgtggttcgtaccgtacgtaccggaaccggggacctaaccgtaacggtaggtacggacttacgaacctagttacggtaggtacgggttcgggttgggtcggtacgggacgggaacggtaaccgtaacggtaccggtaccgtcgtagtacccgg

SEQ ID NO: 24365 - DNA, 869 bp, Homo sapiens
  misc_feature: GYAE6OF01E1KLD.21.22.B11.1.454.CMB.1.raw
  modified_base (271)..(271): a, c, t, g, unknown or other
  misc_feature (271)..(271): n is a, c, g, or t
  modified_base (842)..(842): a, c, t, g, unknown or other
  misc_feature (842)..(842): n is a, c, g, or t
  modified_base (851)..(851): a, c, t, g, unknown or other
  misc_feature (851)..(851): n is a, c, g, or t
  modified_base (855)..(855): a, c, t, g, unknown or other
  misc_feature (855)..(855): n is a, c, g, or t
  modified_base (861)..(861): a, c, t, g, unknown or other
  misc_feature (861)..(861): n is a, c, g, or t
  modified_base (865)..(865): a, c, t, g, unknown or other
  misc_feature (865)..(865): n is a, c, g, or t
  modified_base (869)..(869): a, c, t, g, unknown or other
  misc_feature (869)..(869): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggccccaaactcctcactccagaggaataatcagccgccctcgacggggtccctgaccgtattcctcgtcggcctccgaagttccncggacctaccctccacgccccttacccgtcggaacctatccgtaggtcgggtccgttcccccggggtccggtaagggtacgttcggaacggggtcctacggtaaccttaacgttttaaccgtggttcgacccgtaagttaccggaaacccggggtaccgaacctaaaccgtaacgggttacggggtaacttacggtaaacctaaagttcgttacggtacggggtccggggtttagggggttccggttacggggaccggggtaaccggggtaaaccccgtaaaccgttacccgggtaaccccggttacccggtttaaccggggtacccgtaaacccgggtaccccccggtaaaggggttccccccgttaccccggtaccccccccggtttacgggttaccccgtaacccgttttcccccggtttacccggttttaccccccccaccccccgttttaccccgtttccccgttacccgggtttaccccttcccggttaaccggtttaccgggaccgtcccggggggtcccttaacggggaccgtaaccgggttccgaccggtaagtacccggtntacggctcncgtntaccgncgcngctn

SEQ ID NO: 24366 - DNA, 790 bp, Homo sapiens
  misc_feature: GYAE6OF01CS87M.21.22.B11.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
tcagtcgtcgctcgcacgaccggtgctcgatttagacgacagctcgaggggggggaagctcagcttcagctgtggtagagaagacaggactcaggacaatctccagcatggccgtcttccctctcctcctccaccctcctcactcactgcgcgacgggtcctcgggcccaggttctgtcgcttgacctcgacgcccacccgtnacggtccgtccggaccgggggacccccggngtaacgggacgggttacccaacctactttcgtcgtttcggttaccggtgggaacggtaccaaccgtaaccaaacgtacgttaacggtaagttaatttagttagttacttagttcggtaatcgaacgacctaacctaccggaaggtaccgtaccgacccctaactcctacactacgaagtacgaaacttacgacgacggaccgtaccgtacggtacgggtaccctacgtaccgtacttcgtaccgttcgaccgttaacgtacgttcgtaccggacctacctaccgaccgtaccctaccctacgaaccgacttaccgcgggtccggtcccgttaccggaccggagtacgtcggtaacgtacggtacgtaacgttacgttacgtcgtacgtacgtaaccggtaccggtaaccggctaacgaccggttaagtacgggaattaaccgacgttacgtaccggtaggacgggttttacggggcggtttaacgggtacggggtaccggtaacggtaaaccccgggtaacgttacccgggttaaccaccgggttccgtaacccggg

SEQ ID NO: 24367 - DNA, 834 bp, Homo sapiens
  misc_feature: GYAE6OF01BG0QO.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccgggnaggagggtccaccatctcttgttcgtggaggcaactccaaacagtacggtaaagttaatttagttgttaatttcgtaggtactcagaccaacctaccccgaggtaacgtccggaccccccaaactccctacactaccgaagaaggtaaataactacgacggccggtcccgtacggtaccggggtaccctcggaccctattccgtacgtcggtcctaccgtaacgtcgtcggacctaccctaccgtacgtcccctcccgtacgacctactcggtacgggtccgggtccggttacccgggaccggtaggtacgtcgggtaacggtaccgttacttaacgtttaactttaccggtgttcgtaaccgtaaccggttaccccgggtaacggggaaacccgtaaacggttaaaacgggtcgggtaacgtaacggtaaaccgtaaacgtttccgggtacggggttaaccggggttccgggggggtttttagggggttacccgggggtttcccggggggtaaaccggggtaaacccgggggttaaacccccggtaaaaaccgggtttcccggggttaaaccccgggtttacccgggttaaacgggggttccccggtaaaccccccgggg

SEQ ID NO: 24368 - DNA, 698 bp, Homo sapiens
  misc_feature: GYAE6OF01BEH6X.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagccgtcgtcggggacccccggnaggacgggtccaccattccttcttgttcgtggaggcaactccaacagtacggaagttaattatgtattcgtgtatcagcaacctccaggaactcgacccctaactcctcactaccagaacggaaataactcgacggccgtacccgtcggaccggggtcctaggacctattcctcgtcggaccttaccgtaaggttcctcggacctaccctacgaccgtccccttacccgtacgaacctacgtccgtaaggggttcccggaccggtaccgggtacccgaagggcgttaggaccggtcttacggtacttacgttacgtgtacgaactacggtccggaaccgggtacctaacgaacgtaggtacgggtacttacgaaccgtaaagtcggtacgggtacgggttcggggtttagggtcggttaccggggaacgggtaaaccgggtaacccgtaaacggttacccggacccggtacggttacgggacccg

SEQ ID NO: 24369 - DNA, 733 bp, Homo sapiens
  misc_feature: GYAE6OF01BC54L.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtctcgggacccccgggcagacgggtcaccatctcttgttctggaggcaactccaacatcggaagtaatttagtgtattctggtatccgagcaacctccccgaggaatcggcccccaaactccacactccagagaataatcacgccggccctacgacggggtccctagaccgtacgttcctcgtcggcctccgaagttcctgggccctaacccgtcgaccgtcccctacccgtaccgaacccgtagtaccgtaacggggttccgggtacccgttccccggggtaaccggtaaggggtacctaggggtaccggtctacgggtaccctttaagtttaccgtcgggttacacggtacgtaccgggacccgggaccgtaaccaacgggttacggtagggtaactaggtaaacccgtaacgttaccggtcggggtaaccggttcgggggttttcggggtcgggtttaccgggggaacccggggtaacgggtaaacccgtaacggttacccgggtaaaccccgtcggggttaacccggtaacccgg

SEQ ID NO: 24370 - DNA, 879 bp, Homo sapiens
  misc_feature: GYAE6OF01BO3YK.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcacgcgtcgtcggggacccccgggcacggacgggtcaccgatccttcttgttcgtggacgcaacctccaacagtacggtaattaattatgttattcgtggtatcgagacaacctcccgaaggaactccggacccccctaaactcctacctacgtaccaggaacggtaaatacgtcgacggccggtcccgtccgtacgggggtccctacggtaccgtacttcctacgtcggtacctaccgaacgttccgacggtaccctacccgtacgacccgtccccttcccgtacgtaaccccacgttccggtaacgggttccggggtaccccgttcccgggtaacccgggaagggttaccggtacgggttaacccggggttaccttttaacgtttaaccgttttaccggtaggttccggtaaccgtacgttaacccggggtaaaccccgggggacccgtaaaccgttaaacgggtaaccgggttaggggtaaccttaacgggaaaaccttaaccggttaccgggttaacggggtacggggggtttccggggggtttttaggggggttacccgggggtttacccgggggtaaaccccgggggggtaacccgaaaaccccgggttaaacccgggttaacccgggggttaacccccggtttaaccgggttaaaccggggtcccccgggttaaaaccccgggg

SEQ ID NO: 24371 - DNA, 595 bp, Homo sapiens
  misc_feature: GYAE6OF01CEQ9S.21.22.B11.1.454.CMB.1.raw
  modified_base (219)..(219): a, c, t, g, unknown or other
  misc_feature (219)..(219): n is a, c, g, or t
  modified_base (509)..(509): a, c, t, g, unknown or other
  misc_feature (509)..(509): n is a, c, g, or t
  modified_base (580)..(580): a, c, t, g, unknown or other
  misc_feature (580)..(580): n is a, c, g, or t
  modified_base (583)..(585): a, c, t, g, unknown or other
  misc_feature (583)..(585): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (591)..(595): a, c, t, g, unknown or other
  misc_feature (591)..(595): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactccgaaggaatcggaccccaaactcctcactccgagagaataancagccgcctcgacggggtccctgaccgtattctcgtcggctaccaagtctcggcacctcacgccctcctgaccatcaggtcggccgttccggaccgaggatcgaggctacgtactattacgtgcgacagtccgaacggggcacaacgagtggaatcgaacagttcgaggacggtcgggttgggtacgtcgggacgggtaacggaacctaacgtcggaccgtacgtacggtacgacgaccgaacggtccgtaccggccccgtcggttaccaccgttccgtaccgttacccnccccttcctccgttccgtctacctacgtcggacggccggtctacggacgtaacggccgtcgtaacgtcgcngcnnncncncnnnnn

SEQ ID NO: 24372 - DNA, 694 bp, Homo sapiens
  misc_feature: GYAE6OF01B6JXW.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtctcggggacccccgggnaggaggtcaccatctcttgttctggaggcaactccaacatcggaagtaattatgtattctggtatcagcaactccaggaactcggaccccaactcctcactccagagaatatcacgccgccctcgacggggtcctcggaccgtattccttcgtcggtcctaccgaacgttcctcggacctacccgtaccgaccgtccccttaccccgcgaacccctattaccgtaagggtccgggtcccgttcccgggtaccgggaaggtagtcggacgggtactcggtaacttaacgtttacgtggtacgactacggttacccggacggggaacccgtactaaaccgaggttacggggtaactaacggtaacgtaaccttaccgtaggggtaccggggttaggggtttcggggttacgggttcccggggaacggggaaccgggtaacccgtaaacgttccgggtaaccccggttacggttcggtaacccgg

SEQ ID NO: 24373 - DNA, 848 bp, Homo sapiens
  misc_feature: GYAE6OF01BS6DI.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcacgggtcctgggcccagtctgtgctgactcagccaccctcagcgtcgtcggggacccccggnagacgggtcacctagtctcttgttccgtggacggacaactccaactagtcggtaaagttaattacgtagttacttccgtaggttacttcgagtacctaaccgttaccccgaagggtaactaccgggtacccccctaaaacgttccctaactacgttacccaaggaaacggtaaactaaacgtaccgtaacggaccccggtacccgtcggtaaccggggttccctaggtaacccgtaacgtttccgtcgtacggtacccttaaccgtaacggttccgtacgggtaccctaacccgttccgaaccggtccccttaccgtaccggtaccctaaggtttcccgaaaggggttcccgggtaccgttacccggggtaaccggagggttaccgtagggtacgggtcctaacggttaacccttagtttagaccggttacggaccttacgtaaccccgggaacggggttaccaacgtaaacgtcgggtaacgggtacttaaccggaaacgttaaacttccgggtacgggtaacggggtttcccggggtttgggggtacccgttaaccgggggtaacccggggaaacccggttaaaaccgttaacgttaccccgggtaacccgttaaccgggtcggggtaaccccg

SEQ ID NO: 24374 - DNA, 768 bp, Homo sapiens
  misc_feature: GYAE6OF01D3U97.21.22.B11.1.454.CMB.1.raw
  modified_base (58)..(58): a, c, t, g, unknown or other
  misc_feature (58)..(58): n is a, c, g, or t
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
  modified_base (631)..(631): a, c, t, g, unknown or other
  misc_feature (631)..(631): n is a, c, g, or t
  modified_base (761)..(761): a, c, t, g, unknown or other
  misc_feature (761)..(761): n is a, c, g, or t
tcagtcgtcgctcgcacgaccggtgctcgatttagacgacagctcgaggggggggaanctcagcttcagctgtggtagagaagacaggactcaggacaatctccagcagtcggccggtcttccctctcctcctccaccctcctcactcactcgcgcgtacgggtccgtcgggccctagtctgtcgcttcgacctcgacgcccctaccctcgcggtccggttccggaccggggaccccccgggnagggtaccgggtccaacctnttccgttcgtttgttcggnggacgacctaactacccaagtacgtacggtaaattaacttagttagttacttacgtagttaacgtactaaccggaacctaacccgtaccgtaaacgggtaaccgtaaccccggtaaccccttaaaccgttccctacggtaacctaccgaagggtaacgtaaacgtaaccgtccgaccggtacccggtacccgtacgggtacccggttaccgacgtaaccgtcttcgtacgtcgtacgtaccgtagtccgtacggaccctacgccgtacctaccctccgaactcccgagtccggtacggtcccggtccgtaccggtacgacggtgtaccggagtctacgtacttagttcngtacgacgtaaccggtcggaaccggtaccgtaagtacgtaacgtacgggttaacaggtaacccgtagtacccggtgggtaaaccggtgggttacggacggaacgggaaccgtcggtaaacgtggtaagcngtgtacg

SEQ ID NO: 24375 - DNA, 826 bp, Homo sapiens
  misc_feature: GYAE6OF01CG9UZ.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcgacgccaccctcagcgtcctcggggacccccggnagagggtcacctatctcttgttcgtggaggcaacgtccaacagtacggtaaattaagttatacgtatttcgtggttactacgagacctaaccgtaccccgaaggaacgtccggacccccctaaactccctaccgaacgtaccgaaggtaacgaacttaaactcgaacggcccggtccccgtaccggtaccgggggttcccctacggaccccgttaacgtttcccgtacgttcggccttaacctaacggttcctcgggaccctacccgttcgaccgtcccccgttaccccttacggaaccctaccgttaccgtacggggttacccggggtaccgtaccccggggtacccggtaagggtaaccgttacgggtaaacgggtcccgttacgggttaaaccgtttaaacgtttacgtttacgggtacgtaccggtaacgtacccggtaaaccggggaccgtaccggaaacgtacggtagggacgttacggaacgtaaaggttccctaagggggtacggttcgggggtttacgggttccgggttaccggggaaccgggtaaccgggaaacccgttaaacggtacccggtaacccggttcggtttaaccgggaaccccgg

SEQ ID NO: 24376 - DNA, 672 bp, Homo sapiens
  misc_feature: GYAE6OF01E370I.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggaccccccgggnaggacgggtcaccatcttcttgttcgtggaggcaacctccaacagtacggaagtaatttatgttattctggtatcagacacctacccgaggaactccggaccccaactcctcactccgaggaagaataacgtacaggccgtcccgtcgacggggtccctacggtaccgtacttctcgtcggacctaccgtaacgtccgtcggactacccgtcaccgtcccttcccgacgtaccctagtcgtacgggtcgggtcccgtacccgggtcggaaggtacgtggtacgggtcttagaacctttacgttacgtggtacgtactacgtaccggaacgggtaccgactaacggtaagtagggactagactacgtcgtaggtacggttcggggttgggttcgggtacggggaaccgggacgggtaaacctaaccgggtacgtacccgttccggtagggtaaccccgg

SEQ ID NO: 24377 - DNA, 961 bp, Homo sapiens
  misc_feature: GYAE6OF01BSZIC.21.22.B11.1.454.CMB.1.raw
tcagtcgtcgctcgcacgaccggtgctcgatttagacgacagctcgaggggggggaagctcagcttcagctgtggtagagaagacaggactcaggacaatctccagcatggccggcttccctctcctcctccaccctcctcactcactgcgcgacgggtccgtcgggccctagtcgtgtcgcgtacgacctcaccgcccacccgtcgacggtccggttccggacccgggggaccccggacgacgggtacgggtaccaacctcttcgttcgtttcggttcggacgggacgacctaaccgtaccgaaacgtaacggttaacgggttaaaattaaacgtttagtacgtttaacgtttaccggtagggttaactaaccggaacgtaaccctaaaaccccggttaacccgggaaacgggtaaaacccgttcccccgggaaaacccccccttaaaaccgttccccgtaaacctaaccgtaacccgggtaaaagaaaaccgggttaaaataaccgtaccgggaacccggtcccggtacccggtacgggtaacccggggttaccctaacgggtaaccgttcgtttaccgtccggttaccggtaccttaacccggttaacggttccgtaccgggtaaccctacccgtaccggtaccccgtaccccgttacccgtacccggtaaccgcgttaaccgggtcggggttacccggaccgggtttacccgggaaccgggtaggtacgtaccgggtacggttaccgtaacgttaacgtttacggttagaccggttacgtaccgaccggtaaccgggaccgggtaaccgaacgtaacgggtagtacgggtaagtaacgtaacgtacggttaccggacgggtaggggtttacggggttcgggttccgggaaccggggtacccggaaacgggtaaacccgttacgggtaaccggtacccggttacggtaacggacccgg

SEQ ID NO: 24378 - DNA, 606 bp, Homo sapiens
  misc_feature: GYAE6OF01DAJ1P.21.22.B11.1.454.CMB.1.raw
  modified_base (220)..(220): a, c, t, g, unknown or other
  misc_feature (220)..(220): n is a, c, g, or t
  modified_base (248)..(248): a, c, t, g, unknown or other
  misc_feature (248)..(248): n is a, c, g, or t
  modified_base (323)..(323): a, c, t, g, unknown or other
  misc_feature (323)..(323): n is a, c, g, or t
  modified_base (521)..(521): a, c, t, g, unknown or other
  misc_feature (521)..(521): n is a, c, g, or t
  modified_base (590)..(590): a, c, t, g, unknown or other
  misc_feature (590)..(590): n is a, c, g, or t
  modified_base (592)..(593): a, c, t, g, unknown or other
  misc_feature (592)..(593): n is a, c, g, or t
  modified_base (597)..(598): a, c, t, g, unknown or other
  misc_feature (597)..(598): n is a, c, g, or t
  modified_base (600)..(606): a, c, t, g, unknown or other
  misc_feature (600)..(606): n is a, c, g, or t
tcagtcgtcgctcgcacgaccggtgctcgatttagacgacagctcagggtcctgggcccagtctgtgctgactcagccaccctcagcgtctcgggacccccgggcagagggtcaccatctcttgtctggaggcaactccaacatcggaagttaattatgttattctggtatcagccaactcccaggaactcggacccccaatcctcatccagagaataancagccgcctcgacgggtccctgaccgtnttcgctggcctccgaagtctcggccacctcacgccctcctagaccatccgaggtcggcccgtccggtcgaggtanggacgtctagacttattaccgtggtacacgtacgtcggaacggaccgtaaagtaaaggtgggtatacgaactaagtcgaggtacggtcgggttgggtcggtacgggacgggacggaaccctaggtacgaccggtacgtacggacgacgaccgacgtcccgtcccgacccgtcggtctcccgttcgtcccgtttccccnctttcccgtcttcccgtactcccgtacgcggtccggccgggttcacggtccggaacgtcgacctagcgnanngtcnngnnnnnnn

SEQ ID NO: 24379 - DNA, 622 bp, Homo sapiens
  misc_feature: GYAE6OF01CG6H9.21.22.B11.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagagggtcaccatctcttgtcgtggaggcaactccaacatcggaataattatgtatctgtatcagcaactcccaggaactcggacccccaaactcctacactccagaacggaataatcacggccgtccctcgtacggggtccctagaccgtatttccgtcttacgggccttaccgaacgttcgtcgggtacctacccgtcacgtcccctcccgtcgaaccctacgtcgacggtcggtccgttccggtaccggtaggacgtggaggtcctacgtacttaacttacgtgtcgactacgaccggacggggacgtacgaacgtagtcgggtaatcgaacgtaacgttcgtaggtacggtagggttgggtcggttcgggacggtacggaacgtaacgtcggtacccgtcgtaggtaccg

SEQ ID NO: 24380 - DNA, 785 bp, Homo sapiens
  misc_feature: GYAE6OF01B9AJO.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcacgcgtcgtcgggacccccggcagagggtcaccatctcttgttcgtggacggcaactccaacatacggaagtaattatgtattctggtatcagcaactccgaggaactccggacccctaactcctacactaccgaagagaataacgtcgacggccgtccctacgacggggtccctacggaccgtacttcgtcgtcggacctaccgtaagtccgtacggaccctacctcgtaccgtccctaccctacggtaacctacgtaccggtaacgggttccgggtacccggtttacccgggtaccggaagggttacgtacgggtaacgggtccgttaacgggttacccttttaaacgttttaccggtaggttaccggacccgttaacggttacccgggaaccggggtaaccggaaccgttaaaacccggtagggttaacgggtacggttaccgaaacggtacgtttaaccgggtacgggttacggggtttacgggggtttcgggggttacggggttacccgggggaacgggggtaacccgggtaaaacccggtaaccggttaccgggaaaccccggtttaccgggttacggggtaaaccccg

SEQ ID NO: 24381 - DNA, 687 bp, Homo sapiens
  misc_feature: GYAE6OF01EJEZA.21.22.B11.1.454.CMB.1.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (522)..(522): a, c, t, g, unknown or other
  misc_feature (522)..(522): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctcgggacccagtctgtgactgactcacgcccacctcgacgcgtccgtccggggaccccggnaggaggtcaccatctcttgtcgnggagcaactccaanatacggaagtattatagtattctaggtatcagactaaccnccaggaactccggacccccaaactcctacactaccagaagtataactcgagaccgccctacggacggtcccacgacgtacttcgacgtcgtcctacgaactccgtacggaccacccgtacgaccgtccctcccgttaacgaccctacgtacggtaaggttcccgggtcccgtacccgggtaccgaagggtacgtacggacggtactaacgtaccttaagtttaccnggttactaccgtagtacccggaaccgggtaccaacgtaaccggtagacgggttaagacgtaaacgttaacgtgtacgggtacgggttccgggggtttagggttcggtaccggggaacggtaacggaaacctaaaccggtcgtaaccccggtcgaacgttaccggg

SEQ ID NO: 24382 - DNA, 711 bp, Homo sapiens
  misc_feature: GYAE6OF01CPYBD.21.22.B11.1.454.CMB.1.raw
  modified_base (333)..(333): a, c, t, g, unknown or other
  misc_feature (333)..(333): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagccgtcgtcggggaccccccgggcaggacggggtaccacctacgttccttctttgttcgtgggaggaccaacctccaacatacggaagtaattatgttattctggtatcagcacctccgaggtactccggaccccaactccncactccaagagtaataatacacggccggtccctacggaccggggtccctacggactacttccgtaccgtggacctacgaacgtccgtaggccctacctccgacgtccccttaccctacgtaaccactccggtacgggtccgggtacccgtacccgggtaaccggaggtacgtacgggtaacgggtcctacggttaactttacttaccggttcgggtcaccgtaccggtacgggaacccggggtacacgaaacggtaggtagggacttaccgggaactaacgtccggtagggtacggtcggggtttaagggtccgggtacgggtacggggaaaccggtacccaaacggttccgggtaacccgttcggtacggtaacccg

SEQ ID NO: 24383 - DNA, 785 bp, Homo sapiens
  misc_feature: GYAE6OF01ET5V0.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccggcagagggtcaccatctcttgttctggagcaactccaacatacggaagttaattatgtattcgtaggtatcacgctaacgtcccaagggaactccggacccccctaaaactccctactactaccaaggaacggtaaataacgtcaacggcccgggtaccctacggtaccgggggtcccctacggtaacccgtacgtttccgtaccgtcggacccttaccgtaaagttccgttacggaccctaacccgttaccgacggttcccccttaccccgtacggtaacccctacgttaccgtaacggggtttcggggtcccggttaccccggggtttaccggaaggggttaccgttaggggtaacccgggtaccctttacggaaccgttttaacgttttaacccggtggttaccggaaccgttaaccgtccggggtaaccgggaacccgtacgtaaaccgaggttacgggaactaagggaaactaacgttcggttacggagggtttcgggggtttaggtccgggtccggggaagggtaaccggaacccgttaaacggtcccggtacccggtacgtaccggtaccg

SEQ ID NO: 24384 - DNA, 646 bp, Homo sapiens
  misc_feature: GYAE6OF01DX1OW.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctgggcccagtctgtgctgactcagcccaccctcagcgtcgtcgggacccccggnagaggtcaccatctcttgtctggagcaactccaacagtacggaagttaattatgttacttcgtaggtactacgacgactaacctcccgaaggaactccggaacccctaaactcctacactaccaaggtaacgaaatactcgacgccggtccctcggacggggtccctaggtaccgtactttccgtctccggactaccgtaacgtcgtcggacctaaccgtcaccgtccctaccctacgacctacgtacgtacgggttcgggtcccgtaccgggtacggaggtacgtggacggtactacgtacttagttacgtgtcacgtacgtaccggacgggtacaacacgtacggtggaactagaactacgtcgtggtacgggtcggggttggtacgggtacgggacggaccggtaacaacgtggacccgttgacggtaccg

SEQ ID NO: 24385 - DNA, 696 bp, Homo sapiens
  misc_feature: GYAE6OF01AY0LW.21.22.B11.1.454.CMB.1.raw
  modified_base (215)..(215): a, c, t, g, unknown or other
  misc_feature (215)..(215): n is a, c, g, or t
  modified_base (567)..(567): a, c, t, g, unknown or other
  misc_feature (567)..(567): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcgagggtccgtgggcccagtctgtgctgactcacgcccacctcagcgtcgtcggggacccccggnagacgggtccaccatctcttgtcgtggagccaactccaacagtacggtaagtaattagtgtattcgtaggtactcagccaacgtccgaggactccggaccccctaaactcctacactaccgaaggaagtaatactacgacggcccgacccgtcggacggggtccctacgacgtacttcgtcgtcggtacctactaacggtcctcggacctaccgtccgtaccgtccccttacccgagaccctagtccggttaacgggtccggtccctcccgggtacggaaggtacgttggacggtaccttacgtaaccctttgttccggtagtcgaccgtaagtacccggaacggggtaccncgtaaacggtgtacgggattacgaacttaacgtccggtaagggtacgggttcggggtttagggtaccggtcggggaaccggtaacgggtaaccccttagggacccgtacccggtacggtcggtacccgg

SEQ ID NO: 24386 - DNA, 862 bp, Homo sapiens
  misc_feature: GYAE6OF01E3CDN.21.22.B11.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctcggcccagtctgtgctgactcacgcccacctcacgcgtccgtccggggacccccggnaggacgggtccacctatcttcttgttacgtggacggctaacctaccaaacagtacggtaaagttaactttagtagttaacttcgtggtaactacaacgtacctaaccgtaccccgaaggtaaccgtaccggaccccccctaaaacttccctaaccacgttaccgaaggaacggtaaataaactccgaaccggtcccggccccttacggaccgggggttcccctaacggtacccggttacttccgtacgttccggacctaccgtaagtccgtccgctacccgtcgacccgttccctacccgtacgaacccgttacgttacggtacgggttccgggtaccccgttacccgggggttaccggaagggtaaccgttggggtaaccggccctttaacggtaaccgtttttaaaccgttacgtttacgggtacgtaacccggtaacgttaccccgggaaacccgggggtaacctaacccgtaaagggtacgggtttaacgggaaacgttacggaaacgtttaaccgtccggttaagggtccggggttaccgggggttttaggggtacccggggtacgggggtaaacccggggaaaccgtaacccggttaaacccgtaccggggacccgtttaaccgggtacgggtaccccgg

SEQ ID NO: 24387 - DNA, 753 bp, Homo sapiens
  misc_feature: GYAE6OF01EHGRY.21.22.B11.1.454.CMB.1.raw
  modified_base (216)..(216): a, c, t, g, unknown or other
  misc_feature (216)..(216): n is a, c, g, or t
  modified_base (621)..(621): a, c, t, g, unknown or other
  misc_feature (621)..(621): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcgacgggtcctcgggcccagtctgtgctgactcacgcccaccctcagcgtcgtcggggaccccggnaggacgggtccacctacttcttcttggttcgtggacggacctaaacctaccaaacgtaacgtaaccggtaaagttaaactttagttagttactttcgtaggtactcgaagacctaaccgtacccgtaagggtaacgtacccggaaccccctaaacttcccgactaactacgaacggaaagtaacttaacgtccgaacggtcccggtacccgtaacgggtaccggggtccccgttaacgaacccgttacgtttcctaccggtccgtacgtacccgtaaggttccgtacgggacctaaccgtcccaccggtcccctcccgtacgtaaccacgttacggacggttccgggtacccgtaccgggtaccgaagggtacgcggtaacggtctagtacgttagtactggacncgtaactacggaacggtacaacgacgagtaggatacgtaacgactggtcgggtacgttagggttcggtcgggttaccgggacgggttaaccggaaccttaacggtaccggtaacccgtcgtaaggtaacccg

SEQ ID NO: 24388 - DNA, 795 bp, Homo sapiens
  misc_feature: GYAE6OF01CLE8V.21.22.B11.1.454.CMB.1.raw
  modified_base (103)..(103): a, c, t, g, unknown or other
  misc_feature (103)..(103): n is a, c, g, or t
  modified_base (764)..(764): a, c, t, g, unknown or other
  misc_feature (764)..(764): n is a, c, g, or t
  modified_base (777)..(777): a, c, t, g, unknown or other
  misc_feature (777)..(777): n is a, c, g, or t
  modified_base (786)..(786): a, c, t, g, unknown or other
  misc_feature (786)..(786): n is a, c, g, or t
  modified_base (790)..(790): a, c, t, g, unknown or other
  misc_feature (790)..(790): n is a, c, g, or t
tcagtcgtcgctcgcacgaccggtgctcgatttagacgacagctcagggtcctgggcccagtctgtgctgactcagccaccctcagcgtctgggaccccgggnagagggtcaccatctcttgttctggagcaactccaacatcggaataattatgtattctggtatcagcaactcccaggaactcggacccccaaactcctacactccaggacggtaataactcaggccggtccctaggaccgggggttccctaggaccgtatttcctcgtacggcctaccgtaagttccgttacggcctaacccgttcgaccggtcccttacccgtaggaacccctagttccgagggttccgggcccttacccggggtaccgaggtacttcggaacggtccttaggtaacctttaagtttaccggtcggtacggacctaacgttacccgggaaccgggggaccttacgaaacgtaacggttggggaacttacgggaacctaagttccggtagggacggtttcggggtttgggttcgtacgggacggaacgggtacctaacggtcggtacccggttacgtacggttaccgaccggtacccgtaacgggtcccttaccccgggtcccccgttacgggtaccctaccgtttccgtaccccggtttcccccgtaccccgtttaccgttccccgtacggttacccttaccgtacggttaccggaccgggtcccgggtaccgttacgggaccgtaacggtcccgtacgtacgtaccggnacgtcgacgttcncgacctganacgngcacg

SEQ ID NO: 24389 - DNA, 652 bp, Homo sapiens
  misc_feature: GYAE6OF01BTXGN.21.22.B11.1.454.CMB.1.raw
  modified_base (368)..(368): a, c, t, g, unknown or other
  misc_feature (368)..(368): n is a, c, g, or t
  modified_base (633)..(633): a, c, t, g, unknown or other
  misc_feature (633)..(633): n is a, c, g, or t
  modified_base (641)..(641): a, c, t, g, unknown or other
  misc_feature (641)..(641): n is a, c, g, or t
  modified_base (646)..(649): a, c, t, g, unknown or other
  misc_feature (646)..(649): n is a, c, g, or t
  modified_base (651)..(652): a, c, t, g, unknown or other
  misc_feature (651)..(652): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcatccagaggaataatcagccggccctcgacggggtcccctgaccgattcctctggcctcaagtctggccacctcagccctcctgaccatccaggtcgggcctccgggtccgaggtatggacggctaggactattacgtgtcgctatccgaacggggtcacaaacgngtcggggatcgaactaactcgtaggacggtcggggtttgggtgttaccggggacgggaacgggtaccgtaaacgttcggtaacccgtaccgtacgggtaccaacggcccgaacggtccgtacccggtccccccgttccggtcctaccgtttcccgttcccggttaccccctaccccgtttcccctcccgtttcccgttcctttacccgttaacgtcggaccgggtcgggtccgtacgggtaccgacgggtccgacgtagtacggntcgcagtnccgtnnnngnn

SEQ ID NO: 24390 - DNA, 858 bp, Homo sapiens
  misc_feature: GYAE6OF01B5968.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcggggacccccgggnaggacgggtccaccatcttcgttgttcgtggacggccaaacctccaaacagtacgggtaaattaatttagtgttattcgtaggtactcagaccaacctcccgaaggaactccggacccccaaactcctacactaccgaaggtaacggtaaattaacgtccgtaacggccccggtaccccgttacggaaccggggggttcccctaagggtacccttaacgtttcccgtaccgttaccgtaacccgtacccgtaaacggttccgtacgggaccctacccgttaccggtacccgttccccgttaccccgtacgtaaccctacgttaccggtaacggggttcccgggtacccgtttaccccggggtaccggaagggtacgttaccggggaaccggtaccgttaccggtaacttttaacggttacgttacgggtacgtaacccgtaacggttacccgggaaaccggggtaaccgaaccgtaaacgtagggttacgggaactacgggtaaacctacgggttacgtacggggtacgggtttaccggggtttagggggttccgggttaccgggggaaccgggtaaacccgggtaacccgtaaaacccggtttccgggtaaaccccgggtttacccggtaacgggttaccccg

SEQ ID NO: 24391 - DNA, 309 bp, Homo sapiens
  misc_feature: GYAE6OF01BHF8O.21.22.B11.1.454.CMB.1.raw
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
  modified_base (297)..(309): a, c, t, g, unknown or other
  misc_feature (297)..(309): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggagggtaccaaactgaccgtcctaggtcagcccaaggctgccccctggtcatctgttccccacctcctcctcgtctctactgancgggctggcaaggcncatgnnnnnnnnnnnnn

SEQ ID NO: 24392 - DNA, 771 bp, Homo sapiens
  misc_feature: GYAE6OF01AVHU2.21.22.B11.1.454.CMB.1.raw
  modified_base (214)..(214): a, c, t, g, unknown or other
  misc_feature (214)..(214): n is a, c, g, or t
  modified_base (542)..(542): a, c, t, g, unknown or other
  misc_feature (542)..(542): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccacctcagcgtaccgtcggggaccccccggnaggtacgggtccacccagttccttctttacggttccgtagggacggacctaaaacccgttccaaaactacgtaccgggaaaggtttaaatttaagttggttaactttcgttagggttaattacgacggtacctaaacccgtaccccgaaagggaacctttaccgggaaccccccctaaaaccttccctaccaaccgttacccaagggaaacggtaaagttaaactaccgaacggcccgggtccccgtaccggtaccggggttaccccgtaccggaaccggttacttcccgtccgtcggtcctaccgtaacgttcgtcggacctacccnccacgtccctccctacgacctctcgtaggtccgggccttcccgggtaccgaaggtagtcggagtaccgttgtaaccttagtttacctggtacgactacggtaccggaaccgggtacgacctaagtagtacgggatacggaacccttagtcggttaaggcggttaaccggggtttggggtcgttaccggggacgggtaccgtaacgacgtgtaacccgtcggtagtaccg

SEQ ID NO: 24393 - DNA, 671 bp, Homo sapiens
  misc_feature: GYAE6OF01E03AY.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggccccagtctgtgctgactcagccaccctcagcgtcgtcggggacccccggnagagggtcaccatctcttgttctggaggcaactccaacatacggaagttaattatgttattctaggtatcagcaactccccgaaggaactccggacccccaaacgtccctacactccagaagaatagtcacgccggcctcgacgggtcctcgaccgtattcctcgtggtccctacgaagttccgcggtccctaccctcaccgtcccttcccctagaccctacgttcgacgggttcgggtcccgtccgggtaccggacggatcggacggtctcggttacttacgtttactggtacgcctacgtaccgggtaccggacgtacccaaaggtacggtgggtaactacgggaccttaaacgtggttacgggtacggttcggggggtttcgggttcgggtacggggaccggggtaaccggtaaaccggtaccgtaagggtaccccggttccgggtaagtacccgg

SEQ ID NO: 24394 - DNA, 700 bp, Homo sapiens
  misc_feature: GYAE6OF01BXGAV.21.22.B11.1.454.CMB.1.raw
  modified_base (211)..(211): a, c, t, g, unknown or other
  misc_feature (211)..(211): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggacccccggnaggacgggtcaccgatcctcttgttccgtggacggccaactccaaactactacggaagttaattagtgtatttcgtggttatcgagccaaccgtcccaaggaactccggacccccaaacgtcctcactcagagaatancagccgcctcgacgggtcctgaccgtnttccgtcgtcggtactccgaagttccgtacggcctaccttaccgacgtccccttccgtacgaaccctatccggacgggttacggcccgttacccgggtaccgagggtacgtacggacggtccttaggaacctttaagttccgtgttcgacctaacgtaccggaccggggtaaccgtacaaacgtgggtacgggtatcggtaacgtacgtcggttaggtacgggttcggggtttacggggttcggtaacccggggtaccggggtaaacgggttaaccccgtaaaccgggttcggaaaccccgggtttacgtaccgggtaacccgg

SEQ ID NO: 24395 - DNA, 771 bp, Homo sapiens
  misc_feature: GYAE6OF01DXMK3.21.22.B11.1.454.CMB.1.raw
  modified_base (393)..(393): a, c, t, g, unknown or other
  misc_feature (393)..(393): n is a, c, g, or t
  modified_base (763)..(763): a, c, t, g, unknown or other
  misc_feature (763)..(763): n is a, c, g, or t
  modified_base (768)..(768): a, c, t, g, unknown or other
  misc_feature (768)..(768): n is a, c, g, or t
tcagtcgtcgctcgcacgaccggtgctcgatttagacgacagctcagggtcctgggcccagtctgtgctgactcagccaccctcagcgtctcgggaccccgggcagagggtcaccatctcttgttctggaggcaactccaacatacggaagtaattatgtattcgtggtatcagacaacctccgaaggaactccggacccccaaaactccctacactccaaggaaggaataatcaagccggccctcggacgggtcccgtcgaccgtattctcgtcggcctaccgaagtcgtcggaccacctcgacgtccctcccgtacgacctagtcgtacggtcgggtccctccggggacgaggtacgttcggagtcgtacgtacttaacttcgtcggtcanacgtaccggaacggggaccaacgtaacggacgtaggggaactacgaacgtaactaggtacgggtacgggtttacgggggtcgggtttacgggtccggggacgggtaaccgggtaaccgaacggtaccggtaaccgtaccggtacggtaccgaaccgtaaccggtaccgtcccgttacccgcccccgttagtacccgttacctcccgttacccgtccttaccccccgtccctttacccgttcccgtacccgttccgttaccgttaccgggtccggtaaccggggtcccggttaccggttacgggacccggtaaacccgggtcgtaaccggtaccggttacacggccaacggttcaacgttcgcgtaccggngtcgngcg

SEQ ID NO: 24396 - DNA, 854 bp, Homo sapiens
  misc_feature: GYAE6OF01D7513.21.22.B11.1.454.CMB.1.raw
  modified_base (236)..(236): a, c, t, g, unknown or other
  misc_feature (236)..(236): n is a, c, g, or t
  modified_base (395)..(395): a, c, t, g, unknown or other
  misc_feature (395)..(395): n is a, c, g, or t
tcagtcgtcgctcgcacgaccggtgctcgatttagacgacagctcgaggggggggaagctcagcttcagctgtggtagagaagacaggactcaggacaatcctccagcagtcggcccggtccttccctctcctcctccaccctcctcactccactcgcgacgtacgggtccgtcgggccctagtctgtcgctcgtactcacgcccaccctcacgcgtcggtaccggggaccccggnaggacggtaccactactcttcgttcgtcgtaggacgacctaactaccgaacgtacgttacggtaaaagtttaatttagttcgttaactttcggttaggtacttacgaccgtaacctaaccgtaccgaggtaaccgtacccgtaccccctaaactcctanaccgtacgaaggactaaactcgtcgaccggtcccgtacccgttacgggtaccggtcccacgtaacgttcttcgtccgtcgacccttacgtaggttcccaccgtactacccgtcgtaacccgtccgtacctacgacctcgtacggtcgggttccgggtacccgtaccgggttaaccgggatttaccgggtagggaccgttaccgtttaaacgtactttacggttttacggacgaccggttacgtaaacccggccgggtaacgggaaccttaaccgaagggttacggtaagggaacccttaggtacccgtacgggtttaccgggttagggtaaccggggtttggggggttttaaacccgggcgggggttaaaccccggggaaacgggggttaaacccccgttaaacgggaaccccggtttaacggggttccccggtttaacggcccgggttaaaacccggg

SEQ ID NO: 24397 - DNA, 686 bp, Homo sapiens
  misc_feature: GYAE6OF01AZYYQ.21.22.B11.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggcagagggtccaccaccttcttggttctggacggcaactccaacatacggaagtaattatgtattctggtatcagcaactcccaaggactcggacccccaactccctanactccagaagtaataactcacgccggccctcggaccggggttcctacggaccgtatttccctacgtcggaccctccgtaagttccgtcgggaccctaccctccgacgtcccctacccgtacgacccacgtcgacgggttccgggtccctcccgggtacggaacgggtacgtacgggtacggtccttaggtaccttagttccgtagtcggacctacgtaccggaaccggggtactaccgtaaacgagttagggacttaacggacctaagtcggttgggaacgggttccggggtttaggggttcggtcgggggaacgggtaccggtaaaccctacggtcggtaaccccggtggttaacggtcccgacggg

SEQ ID NO: 24398 - DNA, 659 bp, Homo sapiens
  misc_feature: GYAE6OF01DEMRH.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggacgggtccaccatctcttgttctggaggcaactccaacatacggaagtaattatgtattctggtatcagcaacctcccaggaactccggacccccaaactcctacactccaagagtaataatcgacgccggcctcgacggggtccctaggaccgtattcctcgtcggtcctacctaagtcgtacggccctaaccctccgaccgtccccttaccccgtacgaaccctacgttccggacgggttccggggtcccttacccgggtaccggaggtactcgggacgtcgtagtaacctttattacgtgtcgactagtaccgaacggggacacgaacgtgtagggactacggaactaagtcgtagggtacgggttacggggtttgggtcgggttccgggacgggaacggtaaccctaaacggtcggtaacccggtccgttacgggtaacccg

SEQ ID NO: 24399 - DNA, 737 bp, Homo sapiens
  misc_feature: GYAE6OF01C7BJP.21.22.B11.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagacgacagctcaggggggggaagctcagcttcagctgtggtagagaagacaggactcaggacaatctccagcatggccggtcttccctctcctcctcaccctcctcactcactgcgcgacgggtcctcgggcccagtcttgtcgctcgactcacgccaccctcagcgtcgtccggggcccccggnaggacgggtccacacttctctttcgtcgtggacggacacctaccaacgtagtacggtaagttaattatgttatttccgtgttactacagacctaacctaccgaaggtaacgtcccggtaaccccccaaacttcctacctactacccggaaggtaaggtaaacttaacgtcggaacggtcccggtccccgtaggaccggggttccctacggacctacgtttcctcgtcggtacctaccgttaacgtcgtaccggaccctaccgtacaccggtacccctcccgacgtacctacgtcgtaccgggttcggtaccggttccggtaccgaggtacgtcggacgtctacgtacttcgttacgtgtacgacgtacgtacgggacggtaccgaactaggtacggtaggtacgtagtaactacgggttactggggttacggttggggtttacgggtcggttaaccggggacggttaaccgggaaccggttaaccgtaccgggttacccgtaccgggttcggaacccg

SEQ ID NO: 24400 - DNA, 300 bp, Homo sapiens
  misc_feature: GYAE6OF01DRE0H.21.22.B11.1.454.CMB.1.raw
  modified_base (295)..(300): a, c, t, g, unknown or other
  misc_feature (295)..(300): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctgtcactctgttcccgccctctcctcgtctctactgagcggctggcaaggcgcatagnnnnnn

SEQ ID NO: 24401 - DNA, 888 bp, Homo sapiens
  misc_feature: GYAE6OF01D3U2A.21.22.B11.1.454.CMB.1.raw
  modified_base (59)..(59): a, c, t, g, unknown or other
  misc_feature (59)..(59): n is a, c, g, or t
  modified_base (231)..(231): a, c, t, g, unknown or other
  misc_feature (231)..(231): n is a, c, g, or t
  modified_base (665)..(665): a, c, t, g, unknown or other
  misc_feature (665)..(665): n is a, c, g, or t
tcagtcgtcgctcgcacgaccggtgctcgatttagacgacagctcgagggggggggaanctcagcttcagctgtggtagagaagacaggactcaggacaatctccagcatggccggctttccctctccctcctccaccctcctcactcactcgcgcgtacgggtcctcgggcccagtctggtgctagacctcacgcccaccctcgaggccgtcgtaccggggacccccggnaaggacgggtccaacctacttcttcgtttggtcgtagggacgcctaaacctaccaaagtacgttaacgggaaatttaaaagtttagttagtttacgtttcgttagggtaacttaccgaacgtaccgtaaaccctccccggtaaggtaaccgtacccggaacccccctaaaaccttcctacgtaacctaccgtaaggtaaacgtaattaaacgacgacggccggtacccgtacggtaccggggtaccctacgaaccggttacttccgttgtccggtacctacccgtaagttccgcggtacctaccccgtacgaccgtcccttacccgacgtaccgtaccgtcggtaacgggttcggggtacccctaccgggggtaacgtaacgggttaactacgggtaacggggtacctacggtttaaactaaggttttacccgngggttaacgaccggttaaccgtaaccggggaaacccggtacgaaacccggtaaaggttacgttaggggactaaacggttaccaaaaggttccgtaggggtaccgggttttaccgggggttaggggttttacccgtaacgggggggaaaccggtttaaacccgggtaaaccccgtaaacggttaccccggggttaacccgggttaccgtaaagggggttacccc

SEQ ID NO: 24402 - DNA, 711 bp, Homo sapiens
  misc_feature: GYAE6OF01B7P9Z.21.22.B11.1.454.CMB.1.raw
  modified_base (210)..(210): a, c, t, g, unknown or other
  misc_feature (210)..(210): n is a, c, g, or t
  modified_base (233)..(233): a, c, t, g, unknown or other
  misc_feature (233)..(233): n is a, c, g, or t
  modified_base (527)..(527): a, c, t, g, unknown or other
  misc_feature (527)..(527): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgagggtcctgggcccagtctgtgctgactcacgccacctcagcgtcgtcgggaccccggnaggacggtcacatctcttgtcgnggacgcaactcaacatacgaagtatatgtatcgtggtatcagcaacctccgaggaacgtccgacccctaactcctcactccgaagaagtaataactcgacggccggccctacggaccgggtacctacggaccgtattcctcggtcgcctacgtaacgtcgtacggcctaaccgtcgaccggtcccctcccgttacgacctacgtaccggacgggttcgggtcccgttacccgggaccgggtaggtacgtacgggtacgggtcttaacggtactttaacgtttaccgtggtaccncgtaacgtaccgggaaccgggtacctaacgaacgtgggtaaggacttacggaactacgttacggtagggtaacgggttggggttacggggtttcgggtcccgggggtaaaccgggtaaccggggtaaacccggttaaacgttcccggggttaacccgttacccggggttacgtaaaccccgggg

SEQ ID NO: 24403 - DNA, 666 bp, Homo sapiens
  misc_feature: GYAE6OF01C3QHD.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggaccccccgggnagagggtccaccatctcttgttctggagcaactccaacatacggaagtaattatgttattctggtatcagcactccaggaactccggaccccaactcctacactccagagaatatcacgcgccctgacgggtccctgaccgtattcctctcggcctaccgaacgtcgtcggcctacctcgacgtccctccctagaccctaagtccgacggtcgggccttacccggggtaccgagggtactcgggacgggtcctacggtaaccttttacgttaccgttggttacgacctacgttaccggaccggggaccgacaaaccgtaggttcgggaattacggaaacgtacttcggtacggtacgggttcggggtttaggggttcggttaaccggggaccggggtaacgggtaaccccgtaaacggttcccggaaacccgggtttccgtaaagggtaccccg

SEQ ID NO: 24404 - DNA, 767 bp, Homo sapiens
  misc_feature: GYAE6OF01CBZZ0.21.22.B11.1.454.CMB.1.raw
  modified_base (213)..(213): a, c, t, g, unknown or other
  misc_feature (213)..(213): n is a, c, g, or t
  modified_base (565)..(565): a, c, t, g, unknown or other
  misc_feature (565)..(565): n is a, c, g, or t
tcagtcgtcgctcgcacgaccggtgctcgatttagacgacagctcaggggggggaagctcagcttcagctgtggtagagaagacaggactcaggacaatctcagcatggccggcttccctctcctcctccaccctcctcactcactgcgcgacgggtccgtgggcccagtctgtgctgactcacgccacctcagcgtcgccggggaccccggnaggaggtaccacctatcttcttggttcgtagggacggaccaaccctccgaaactagtacgggtaaaattaagtttagtagttaattcgttaggtatacacggtacctaaccgtacccgaaggtaacgtcccggaaccccctaaacctcctaccacgtaccgaaggtaacggaactaacgtacgacggaccccggtaccgtaccggtaaccgggggtcccttacggaaccgttactttccgccgttacggtccctaacgtacggttctccggacctaccctaccgacccgtcccgttacccgtacgacctacgtacgtccggtcggggtacccgtccgggtaccggaggtacngggtacggtacgttacgttaaccgttactttacgtcggtcgtaacgtaccggtacggaccgggtacgtaaccaaggtaacggtacggacgtacgtaacgtcggtaacgtgggttacgggttaggggttcggggttcggggtaccggtacggggtaaccggtaaaccgacgggtttacggacccttcgggtaaacgtacccgg

SEQ ID NO: 24405 - DNA, 838 bp, Homo sapiens
  misc_feature: GYAE6OF01BSPJT.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctacagcatggccggcttccctctcctctcaccctcctcactcactgcgcagggtcctgggcccagtctgtgctgactcagcccacctcagccgtcgtacggggaccccggnaggagggtccacctatctcttgttcgtggacgccaactccaacagtacggaagttaattacttgtattcgtaggttatcagcaaccgtaccccgaaggaactacccggacccccaaaacttccctactacctaccgaaggaacgtaaactaactccgtaacggccccgggtaccctaaccgggaccgggggttacccctaacggtaaccccggtaagtttccctcggtacgggtacccttcgaaacggttcgtaccgggaccctacccgtacgtacccgtccccgttaccccgtacgtaacccgtacgttaccggtagggtttcccggggacccggtttacccgggtaccggaagggtacgtacgggaccggttccgtaaccgttaacgttacgtttacccggtggttaccaccgttaacgtcccgggtaaccgggggtaacctaaccgtaaagtccgggtaaggggttataaccggtaaaccgttaacgtaccgggtacggggtacgggtttacccgggggtttcgggggttaaccgggttacccggggaaccggggtaaacccgggtaaaacccggttacggttaaccccggttaccggggttaacccggtaccggtaacccggg

SEQ ID NO: 24406 - DNA, 782 bp, Homo sapiens
  misc_feature: GYAE6OF01AJCEM.21.22.B11.1.454.CMB.1.raw
  modified_base (123)..(123): a, c, t, g, unknown or other
  misc_feature (123)..(123): n is a, c, g, or t
  modified_base (275)..(275): a, c, t, g, unknown or other
  misc_feature (275)..(275): n is a, c, g, or t
  modified_base (381)..(381): a, c, t, g, unknown or other
  misc_feature (381)..(381): n is a, c, g, or t
  modified_base (683)..(683): a, c, t, g, unknown or other
  misc_feature (683)..(683): n is a, c, g, or t
tcagtcgtcgctcgcacgaccggtgctcgatttagacgacagctcaggggggggaaggcgtcagcttcagctgtggtagagaagacaggactcaggacaatctccagcatggccggcttcccnctccctctcaccctcctcactcacgtgcgcacgggtcctgggcccagttctggtcgactgactcacgccctaccctcagcgtccgtcggggacccccggcaggacgggtccacctattcctcttgttccgtagggacgtacaaccgtccaanacgtcggaaagtaattagtgttattacgtggtatccagacctacctacccgaggtaactccggaaccccccaatcccgttacaacgtccgtaaggacgtaataacncgtaacggccggaccctcggaaccgggggttaccctcggaaaccgttatcccgttacggtccggtaccttacccgtaaggtcccttgggacctacctccgaccgtccctccgtacgacctagttccgacggggttcccgttacggtccccgggtaacgggacggtcgttaacggggaccgggttacctcggttaaaccggtttatttacccgggacgggtttacaccgtttaacgtccggggtaacccgggacctaaccgaacggtagggtaggacccgttagaaaccccgtggtttaccgngggtacccgggttggggtttaggggtcggttaaccgggggaaccgtaaccgggtaaccgtaaacgttacccggggtccctaccggggtaacgtacccgg

SEQ ID NO: 24407 - DNA, 660 bp, Homo sapiens
  misc_feature: GYAE6OF01BIHML.21.22.B11.1.454.CMB.1.raw
  modified_base (212)..(212): a, c, t, g, unknown or other
  misc_feature (212)..(212): n is a, c, g, or t
  modified_base (439)..(439): a, c, t, g, unknown or other
  misc_feature (439)..(439): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcacgggtcctgggcccagtctgtgctgactcacgccaccctcagcgtcgtcggggaccccggngagagggtcaccatctcttgttctggacgcaactccaacatacggaagttattattgtattcgtggtatcagtcaacctccaggaactccggaccccaaacgtcctacactccgaagaaggaatataccgacgccggcctacggacggggtaccctacgaccgtatttccgcgttcggacctaccgtaacgttccgtacggaccctacccgtacacgtcccttcccngtaacccagtaccggtagggtcccggtacccggtccgggtaccggaagggtacgtacgggagccgttagtacttaactttacgtggtcgtacacgtacccggacggggtacaacgaacgtgtacgggaatcggaacctagtacgtgggtacggttagggtttgggtcgggtacgggacgggaccggtaaccgtaacgtcggtaccgtcggtacggtaccgg

SEQ ID NO: 24408 - DNA, 892 bp, Homo sapiens
  misc_feature: GYAE6OF01ADMPZ.21.22.B11.1.454.CMB.1.raw
  modified_base (141)..(141): a, c, t, g, unknown or other
  misc_feature (141)..(141): n is a, c, g, or t
tcagtcgtcgctcgcacgaccggtgctcgatttagacgacagctcagggggggaaggcgtcagcttcagctgtggtagagaagacaggactcaggacaatctccagcatggccggcttaccctctcctactccaccctccncaactcactcgcgctacgggtcctggcccagttctgttgcttaggaccttcacggcccaccctccagccgtcctcgggggacccccggaggacggtcacccagttcctctttggttcagggacggacctaacgttccaaacgtagtaccggtaacggttaaatttacgttacgttacgtttacgtagtttacgtacgaacggtacccttaacctaacccgtaaggggtaaccgtaccggtacccccctaaacctacccgttcaaccgtttaccgaggttaaaacggactttaacgtaaccgtcggacccgtcccggaccgtaaggggttccccgtacgtaaacccgtcgtttcccgtaccgtacgggttcctaaacccggcgttacccggtaccggtaccctaacccgttcccgtaccgttacccggtacccccttacggtaacccctacgtaccggttaccgtccgggtacccgttccccgggtaccgggtaacgacgggtttacggacccgggttagttacccgtacgttaaccggtttaacctcgggttcccaagggttaccccgagggtaaacccgggtccgaaccgtacgtaacgggtaggtaccgttaaacggcctttaaccggacgtttacggccgggttacccgggtttggggtttccgtaccgggggggtaacccaaaggggtttaacccgggaaccccgtttagggtaaccccccggggttgtaacccggttaaacccggg

SEQ ID NO: 24409 - DNA, 982 bp, Homo sapiens
  misc_feature: GYAE6OF01E06LD.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcctcggggaccccccggnaggaggtcaccattctcttgttctggacggcctaactcccaaacagtaccggaaagttaaatttatgttaatttccgttagggttaatcaacgcccaaaccgttaccccgaagggtaacttccgggaaccccccccctaaaaacgttcccctaccgtaaccttacccgaaacggtaaacggtaaaacttaaaccgttccgaaacgggtcccccgggtacccccgttaccgggaccgggggtttacccccttaggaacccgttacgttttccgtacccggtttcggtaccctacccgtaaaggtttcccgtaccgggtacctaccccgttacggtaacccggtcccctttaacccccggtacgtaacccgtacccgttacggttaaaccccggggtttacgggggtccccgtttacccccggggtacccgggtaaacggggtagtttacccgggaaccggggtttcccgtttaaccgggtaaccctttaaaggtttttaaaccccggttcgggttaccggtaactttacccggtaacccgggtaaacccggggggaacctaacccgtaaacggtagggttaaccggttaaacggacgtaaaaccgttcgtaaccgggttacggggtaaaccggggttttcgggggttttacgggggggttaccgtttaccccgggggggaacgggttaaaacccgggggtaaacccccgttaaacgggttaccccgggttaaaaccccgggttttccccggtaaaggggttaaccccccgg

SEQ ID NO: 24410 - DNA, 712 bp, Homo sapiens
  misc_feature: GYAE6OF01DE2Y5.21.22.B11.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcggggaccccccggnaggagggtcaccatctcttgttctggagcaactccaanatacggaagtaattagtgttattctggtatacagacaacctccccaaggaacgtaccggacccctaacctcctaccacgtcccaaggaggaaataactcgacgccggaccctcggacggggttccctaggacccgtattcctacgtggtacctccctaagtccgttacggcctaacccgttccgacgtcccccgttaccctaccgtaacccgtactacggtacgggttccggggccttaccccggggtaccgagggtacgttacggacggtacctggtaaccttacttacgtcgtcgactacgtacggaaccggggtacgactaacgtagtcggggaactacggtaccaaagttccgttaagggtacggttcggggtttcggggttacgggttaccggggaaccgggttaacgggtaaaccctaaacggttcggttaaccccggtccggttacggtacccgg

SEQ ID NO: 24411 - DNA, 772 bp, Homo sapiens
  misc_feature: GYAE6OF01CTVXX.21.22.B11.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgagggtcctgggcccagtctgtgctgactcgacgcccacccgtcacgccgtccgtccggggacccccggnaggacgggtccacctattcttcgtttgttcgtggacggaccaaacctccaacgagtaacggtaaagttaacttagtagttaattccgttaggtactccgaacgtacctaaccgtcccgaaggtaaccgtcccggtaacccccaaacttcccgtacacgtacccgaagaacggtaaactacgtcacggccgccctacggtccggggtaccctcgaccgtacttcctcgttggaccttaccggaacgttcccgtcggacctacccgttacgacccgtccccttacccgaccgaaccgtacgttcggacgggttcccggtaccgttcccggggtacgaggtacgtcgggtacgacgtacgtacttacgttacgtcgtcgtactacggtacccggaaaccgggtacgactaaccggtaggtacgggtaactaacgtaacctacggttacggtacgggttacgggttcgggggtttagggtaccggggttaccgggtaacggggtaaccgtaaaccgggtaacggtcccggttaacgggtcccgtaagggtaacccg

SEQ ID NO: 24412 - DNA, 903 bp, Homo sapiens
  misc_feature: GYAE6OF01DCGKR.21.22.B11.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcgacgggtcctgggcccagtctgtgctgactcagcccaccctcagcgtcgtccggggacccccggnaggacggtccacctatcttcgttgttccgtggacggccaacctaccaactagtaccggtaaagttaatttagtgttaattcgttaggtaactcgaacgacctaacctaccccgaagggtaactcccggaaccccctaaaaccttccctactaacgtcccgaaaggtaacggtaaattaacgtacgaccggtaccccggtccccgtaccgggaccggggttcccctacggtaacccgttactttcccgtcggtacggtcccgttacccgtaacgttccggtaccggacccctaacccgttccgaacccgtccccccgttaccctaaccggtaacccctagttacccggtacgggggttacccgggtaccccgttacccgggggtaacccggtaaggggttacgttacggggaaccgggtttcccgttaacggttaaacccgttttacgtttaacccggtgggtaacccgtaccggttaaccggtaacccggggtaaccgggggtaacccgtaaaccgtaacggttagggtacggggtaaacttaccggtaaaccgttaccgtcggggttacgggtaaccggggtttcgggggtttacgggggttaccgggttacccggggaacggggtaaacccggtaaacccgtaaaccgttccgggtaaccccggttacgggtcggtaaaccccgg

SEQ ID NO: 24413 - DNA, 643 bp, Homo sapiens
  misc_feature: GYAE6OF01A5TO1.21.22.B11.1.454.CMB.1.raw
  modified_base (320)..(320): a, c, t, g, unknown or other
  misc_feature (320)..(320): n is a, c, g, or t
  modified_base (323)..(324): a, c, t, g, unknown or other
  misc_feature (323)..(324): n is a, c, g, or t
  modified_base (625)..(625): a, c, t, g, unknown or other
  misc_feature (625)..(625): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggccccaaactcctcatccagagaataatcagcgcctcgagggtccctgaccgtattctctggcctcaagtctggcaccgtcacgtccctcctgaccatcgagtcggctccggtcgagatgagctgactattacngtnnatcgaggacacacagtggatacgacaatcgaggagtccgggttgggtgttaccgggagggtaacgggaacctaaacgtcggtacccgtacgtaacgggttaccaaccggacccgtaaacgggtcccgtacccgtaccccccgttacgggtaccctaaccgttccgttccccgtttcccccgggtcccctttcccgttcccgttcccggttacctaccgttaacccggttcggtaaccgggtacccgggacggttaccggaccggtaaacgggtccgaaccgtacgttacgacgcacgctanccggatccgacncngngc

SEQ ID NO: 24414 - DNA, 728 bp, Homo sapiens
  misc_feature: GYAE6OF01ANJKI.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccacctcagcgtcgtcggggacccccgggnaggacgggtcaccatctcttgttctggacggcaactccaacagtacggaagtattatgtattctggtatcagacaacctccgaaggactccggaacccccaactccctacactacccgagaaggtaaacttaacgtccgacggtaccgggtccccttacggaaccgggggttccccctacggacccgttaacgtttcccgtacgttcggtaccctaccgtaacggttccttacgggaccctaaccccgttccgaaccggttccccccttaccccgtaccggtaacccgtacgttacccggtacggggttacccgggtcccgtttacccggggtccggaaagggtacgtacgggtacgtaccgtacgtacgttacgttacgcgtagtcctagtaccgacgggtacgcaacgtgtacggatacgactacgcggtggtacggtggggtttacgggcggttcccggggacggtaaacgggtacccaaacggtcccggtaaccggtccgtcgggtaacccg

SEQ ID NO: 24415 - DNA, 748 bp, Homo sapiens
  misc_feature: GYAE6OF01AXHQ0.21.22.B11.1.454.CMB.1.raw
  modified_base (56)..(56): a, c, t, g, unknown or other
  misc_feature (56)..(56): n is a, c, g, or t
  modified_base (226)..(226): a, c, t, g, unknown or other
  misc_feature (226)..(226): n is a, c, g, or t
tcagtcgtcgctcgcacgaccggtgctcgatttagacgacagctcagggggggaanctcagcttcagctgtggtagagaagacaggactcaggacaatctccagcatcggccggtccttccctctcctcctccaccctcctcactcactgcgcgacgggtcctcgggccctagtctgtcgctgactcgacgcccaccctcgacgtcgtccgtccggggaccccggnaacggtcggtcctacctcttccgttcgtttcggttcgtagggacgaccaaccttccaaacctagtaccggtaaattattagttgttacttcgtaggtactccgacgtaccaaccgtaccgagtaccgtacccgaacccctaacgtcctacacctaacgaagtaacgtaactaacgtccgacggccgtccgttacggccgggttccctacgtaacccttgttacccgtcgtacgtccgtaacgtcgttaccgcgaccgtacaccgtccgtcccacctacgtaccagttcggacgggtccggtaccgtacgggtacgaaggtcgtggtaccgtacgtacgttacgttacgtagtcgacgtacacggtaccggtacggacctacgtaagtacggtaggtactacggtaactacgggttaccggtagggttaccgggttggggttaccggttaccggggaacggtaaaccggggtacccgttaaaccgtaccggttcccggaaccgggttacgtaaccgtcccggg

SEQ ID NO: 24416 - DNA, 771 bp, Homo sapiens
  misc_feature: GYAE6OF01DJBRR.21.22.B11.1.454.CMB.1.raw
  modified_base (590)..(590): a, c, t, g, unknown or other
  misc_feature (590)..(590): n is a, c, g, or t
  modified_base (630)..(630): a, c, t, g, unknown or other
  misc_feature (630)..(630): n is a, c, g, or t
tcagtcgtcgctcgcacgaccggtgctcgatttagacgacagctcgaggggggggaagctcagcttcagctgtggtagagaagacaggactcaggacaatctccagcagtggccggcttccctctcctctccacctcctcactcactgcgcgacgggtcctcgggccctagtctgtgctcgactcaccgccaccctcgacggtccggtccgtccggggaccccggagacggacgggtaccacctacttcgtcgtttagtcgtagggacggacctaacctaccaacgtacggtacggtaaagttaattgtagtttacttcgtaggtactcgaactaccgtaaccgtcgaaacgtaccgtacccggaaccccctaacgttcctactaacgtaccggaaagaacggtaaattacggaccggaccgtaccgggtcccgtaacgggtacccggggtttccctaacgggacctttacctttaccgcggtaccggtaccctacgtaaaggttcccgtacgacccttacctaccgacccgttcccgtacccgtacgacctacgtacgtacgggtaccgttaccggtccgggtaacggnggtacggtacggacgtcgtactaccgttattacgtagacncgtacgtaccggacgtaaccacgtaacgtagtagggtactaacgacgtacgtacggtcggtacgggttggggttacggtcgggtacggggacgtaaccgggtaacgtaacgtacgggtaacccgtacggtacgtaacccgg

SEQ ID NO: 24417 - DNA, 828 bp, Homo sapiens
  misc_feature: GYAE6OF01CNHX5.21.22.B11.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcgagcgtcgtcggggaccccccgggnaggacgggtccacctacgttccttcgtttcgttcgtagggacggtacctaaacctcccaaactagtaccgggtaaaagttaaatttagtgttaatttccgttagggttaacttccgaacggtacctaaacccgttccccgaaagggtaaaccgtaccccggaaaccccccctaaaccttccccgtaccaactacccgaaaggaacggtaaaacttaaaaccgtccgaacgggtccccgggtcccccgtacgggtaacccgggggttccccgtacggtaacccgttacgttcccgtacgtccgggtaacctacccgtaacggtccgtacgggaccctaccctccgaccgtccctccctaacgaccctacgtcgtacgggtccggtcccgtccggggtacggaggtcgtaggacggtctacgttacttaagttaccgtaggtcgtaccgtaaccggtaccgggaaccgggtaccgaacgtaaacggtgtacgggtaactacggaactacgttcggtaggggtacggttacggggtttggggtacggttaccgggggaacgggtaaccggtaaccggtaaccgtacgggaaccccggttcggtaacggtcccgg

SEQ ID NO: 24418 - DNA, 719 bp, Homo sapiens
  misc_feature: GYAE6OF01CK5D1.21.22.B11.1.454.CMB.1.raw
  modified_base (258)..(258): a, c, t, g, unknown or other
  misc_feature (258)..(258): n is a, c, g, or t
  modified_base (579)..(579): a, c, t, g, unknown or other
  misc_feature (579)..(579): n is a, c, g, or t
  modified_base (707)..(707): a, c, t, g, unknown or other
  misc_feature (707)..(707): n is a, c, g, or t
  modified_base (711)..(713): a, c, t, g, unknown or other
  misc_feature (711)..(713): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaacctcccaggaactcggacccccaaactcctcactccagaggaataatcagccggcctcgacgggtccctcgaccgtattctcncggctaccaagtctcggccacctcacgtcccttccctacgaccatcgacggtcgggcctccgggtccgagggtctcggacggctacgaacttattaacgtcgtacgactacgtaccggaacgggtaccgacgaaacgtacggtacggggtaagtacgaacctaaagttccgtagggtacgggttccggggtttgggggttcgggtttaccggggacgggtaaccggggtaaccctaaacggtccggtaacccggttaccgtacgggtacctaccgggaacccgtaacgggtcccgtacccgtcccccggttccggtacccnccgttcccgttacccggttccccccgtaccccgtttcccgttcccgttaccgttcccgttaccgttacgtccgggtacgggtccgggacgtacgggaccggtacgggccgtactaaggtcgatcagcnacgnnncngngc

SEQ ID NO: 24419 - DNA, 590 bp, Homo sapiens
  misc_feature: GYAE6OF01EFU7C.21.22.B11.1.454.CMB.1.raw
  modified_base (210)..(210): a, c, t, g, unknown or other
  misc_feature (210)..(210): n is a, c, g, or t
  modified_base (351)..(351): a, c, t, g, unknown or other
  misc_feature (351)..(351): n is a, c, g, or t
  modified_base (462)..(462): a, c, t, g, unknown or other
  misc_feature (462)..(462): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagaggtcaccatctcttgttctggagcaactccaacatcggaagtaattatgtattctggtatcagcaactcccaggaactccggacccccaaactcctacatccaggaagaataatcagccggccctcgacggggtcccngaccgtattctctggctaccgaagtctcggccacctcacgtccctccctagacccagtcgaggttcgggcctccgggtacgaggactggacggtctagtaacttatttacnggtcactacgtacgacggggaccacgaaactggtcgggataggaactaagtcgtggtaggttccggggtttgggtggtaccgggcggtaaacgggacctaaaggtccgacccgttccgtaggtacccg

SEQ ID NO: 24420 - DNA, 771 bp, Homo sapiens
  misc_feature: GYAE6OF01DS2R3.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccacctcagcgtcgtcggggaccccggnaggacgggtccaccatcttcttagtctaggacggaccaactcaacagtacggaataattatgtattcgtaggtatcacgacaacctcccgaaggaacgttccggaaccccctaaatccctacactaccgaagaacggaaataacgtacgaacggcccggacctacggaccggggttccctggtaacccgtacttcccgtacgtacggacctaccgtaacgttcccgtacggtacccacccgttaccgaccgtaccccgttccctacggaaccctacgtacggtacgggttcccggtcccgttacccggggtacgtaacgggtactacgggacggttactacgttaacttaacgtttacgtcggtacgccgtaacgtacggggtaaacccggacgttaacccgaacggtaggttaccgggaacttacggtaacctaaagttccgggtaggggtaccggggttacgggtttacgggggttacccggttaccggggggaacgggtaacccgggtaaaccttaaaccggttccgggttaacccggttacggtacgggtaaccgg

SEQ ID NO: 24421 - DNA, 704 bp, Homo sapiens
  misc_feature: GYAE6OF01CUHPY.21.22.B11.1.454.CMB.1.raw
  modified_base (106)..(106): a, c, t, g, unknown or other
  misc_feature (106)..(106): n is a, c, g, or t
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
  modified_base (372)..(372): a, c, t, g, unknown or other
  misc_feature (372)..(372): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
  modified_base (659)..(659): a, c, t, g, unknown or other
  misc_feature (659)..(659): n is a, c, g, or t
  modified_base (690)..(690): a, c, t, g, unknown or other
  misc_feature (690)..(690): n is a, c, g, or t
  modified_base (696)..(696): a, c, t, g, unknown or other
  misc_feature (696)..(696): n is a, c, g, or t
  modified_base (698)..(699): a, c, t, g, unknown or other
  misc_feature (698)..(699): n is a, c, g, or t
  modified_base (701)..(701): a, c, t, g, unknown or other
  misc_feature (701)..(701): n is a, c, g, or t
  modified_base (703)..(704): a, c, t, g, unknown or other
  misc_feature (703)..(704): n is a, c, g, or t
tcagtcgtcgctcgcacgaccggtgctcgatttagacgacagctcagggtcctgggcccagtctgtgctgactcagccaccctcagcgtcgtcgggacccccgggnaggagggtcaccatctcttgttctggaggcaactccaacatcggaataattatgtattctggtatcagcaactccaggaactccggaccccaactcctacactaccgagaaggaaactatcgacggccggtccctacggacgggtcccagaccgtacttctcgngcctacgagtcgtcggccacctnaccgtcctaccacgaccacgtcgtagggtcggtccgtccgggtacgaggactggacggtctaggtacttacgtttacgngtacgctaacgtacggaacggactacgaaacgnggtacggganagaaactcgttcgagggttacgggttcggggtttacggggttggtaccggggacgggaaccggtaaaccgtaacggtccggtaccggttacggtaacggtaccgaccgaccggtacgtccgtcccgtacccgtcgactaccctaccggttccctttaccccgaccctttcccggtacccttcgtaccccgtttacgtccgcgggtacccgggtaccgggtcgtaaccggacccggtaaccgggngtaaaccgttcgtaacgggccacgtccgcgncgtacncnncngnn

SEQ ID NO: 24422 - DNA, 842 bp, Homo sapiens
  misc_feature: GYAE6OF01BGL2S.21.22.B11.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
tcagtcgtcgctcgcacgaccggtgctcgatttagacgacagctcgaggggggggaagctcagcttcagctgtggtagagaagacaggactcaggacaatctccagcatggccgcttccctctcctctccaccctcctcactcactgcgcgagggtcctcgggcccagttctgtgctgactcacgccaccctnagtccgtcgtccggggaccccggnaggtacggtaccacctattcttctttgttcgagggacgtaccaacctccaaacgacgttacggtaaagttaatttagtagttagtttcgtacggtactcgaacgactaaccgtcccgaaggtaaccgtccgaacccctaacgtcctacacgtaccgaaggtacgaatacgtcgacggtccgtacccgtacggtaccggggtaccctacggtaaccgttacgttccgtcgtacgggtacccttaacggtaacgttccggtacgggtaccctaccccgtacggtacccggttccccttccgtaaccggaccttaacggttccgggtaaacggggtttccccggggtacccggtttaccccggggttaaggaacgggttacggtcggtaccgtacgtttacgtaacgttttacgtacggtaggtactaccggtaacgtaccggggaacgggaaccttaaccggaaggtaagggttcggtaacgttaaccgaaaccgttacgggtacggtttcggggaccggggttttacgggggttacgggttacccgggttaacgggggaccgggtaaaacccggtacccttaaccgggttaccggacccggtttaaacgggtcccggaaacccggg

SEQ ID NO: 24423 - DNA, 368 bp, Homo sapiens
  misc_feature: GYAE6OF01ASBNS.21.22.B11.1.454.CMB.1.raw
  modified_base (307)..(307): a, c, t, g, unknown or other
  misc_feature (307)..(307): n is a, c, g, or t
  modified_base (314)..(316): a, c, t, g, unknown or other
  misc_feature (314)..(316): n is a, c, g, or t
  modified_base (321)..(321): a, c, t, g, unknown or other
  misc_feature (321)..(321): n is a, c, g, or t
  modified_base (323)..(323): a, c, t, g, unknown or other
  misc_feature (323)..(323): n is a, c, g, or t
  modified_base (325)..(368): a, c, t, g, unknown or other
  misc_feature (325)..(368): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgacaacagtggggattgaacaatctaggagtcgggtttgggtgttcgggacggaagggaccaaaacgtgaccgtctaggtcagccaaggctcgcccctggcactctcgtcccacctcctcctcgtctctactgagcggctggacgaaggcganacgtagnnngcatncngnnnnnnnnnnnnnnnnnnnnnnnnnnnnnnnnnnnnnnnnnnnn

SEQ ID NO: 24424 - DNA, 882 bp, Homo sapiens
  misc_feature: GYAE6OF01BDZIQ.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgagggtcctcgggcccagtctgtgctgactcacgcccaccctcagcgtcgtccggggaccccggnaggacggtcacctatccttcgttgttcgtggacggacctaacctccaaacgagtacggtaaagttaattatgttaatttcgttaggtatacgaacgaccaacctacccgaaggaacgttaccggaacccccctaaaaccttcccctaccgtaccgtacccgaaggtaaacggtaaacttaaacgtccgtaaccgggaccccgggtacccccgttaccgggtaaccgggggttcccctacggtaaccccggttaacttcccgttaccgtccgggttacccttacccggtaaacgtttcccgttaccgggaccctacccgtacctaccggtccccctttacccggtacgtaacccctacggttcccgtaacgggggttccggggtaccccgttcccggggtaacccggaagggtaaccggtcgggtaaccggttaccttaaccgggttaaccttttacggttaccgtttggtccgtaaacgttacggtaaccccgggaaacgggaccctacgttaaaacgtcgggttaaggggactaactaacggttacgtacggttacggggttagggttcccggggttttaggggaccggggttaacccgggggaaccggttaaccgggaaacccgttacgggttaccccggtacccggttcggtaacggaacccgg

SEQ ID NO: 24425 - DNA, 764 bp, Homo sapiens
  misc_feature: GYAE6OF01B4MAB.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcacgggtcctgggcccagtctgtgctgactcacgcccaccctcagccgtcgtccggggacccccgggcacggagggtccaccgatccttctttgttcgtggaggaccaactccaacagtacggaaattaattatgttattctaggtactcagccaacctccgaggaactccgacccctaaactccctacactaccgaaggtaagtaaatactacgacgccggaccctacggaccggggtcctcgacgtacttcgtcgtcgccttaccgagtcgtcggtaccacccgtcaccgtccctacccgtcgaaccctacgtccgtacgggtcccgggccgttaccgggtacggtacgggtacgtcgggtaacggtcctttaacggtaacctttacgtttaccgttgggtcgaccgttaacgggccggtaaccggggtaacgaaccgtaagacgggttacgggtaacgtaacggtaaacctaacggttacgtaccggggtaacggggtttcgggggtttacggggtacgggtttacccggggggaacgggtaaacccgggtaaaccccggttaaacgggttcccggggaacccggtttaccgggtacccggggtaaccccgg

SEQ ID NO: 24426 - DNA, 801 bp, Homo sapiens
  misc_feature: GYAE6OF01E3O8D.21.22.B11.1.454.CMB.1.raw
  modified_base (213)..(213): a, c, t, g, unknown or other
  misc_feature (213)..(213): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggacccccgggnaggacgggtccacctatccttcttgttcgnggagcaactccaanatcggaaagttaattatgttattcgtgtatcagccaacgtccaaggtactccggacccccaaactcctacactaccgaagaaggtaaataactacgacggcccggccctacggaccggggttccccacggaacccgttatttcccgtacgttccgggtacccttaccgtaacggtttcccgtacgggtacccctacccgttccgaacccgtcccccgtttacccacggtaacccctagttacccgggtaacggggttcccgggtcccggttaccccgggtacgggaaacgggttcgtacgggtacggtccgttaacgttaaccgtttaaacttttcggtgggtaccgtacctaacgggtacccgggtaaacgggtaaccgaacgttaaacccggtggttacggggtaactaggtaaccccgttagttacccggtaggggtaccgggttcggggtttacggggttcggggttacccggggacggggtaaacccggtaaacccgtaaacgttaccggggtccccttaaccgggttcggtaacccgg

SEQ ID NO: 24427 - DNA, 708 bp, Homo sapiens
  misc_feature: GYAE6OF01AQ3OZ.21.22.B11.1.454.CMB.1.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (319)..(319): a, c, t, g, unknown or other
  misc_feature (319)..(319): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctcgggcccagtctgtgctgactcacgccaccctcacgcgtcgcgggaccccggnaggacgggtcacctntctcgttcgtctggacgctaactccaaactagtacggaaattaattatgtattctggtatcagtcaactcccaggaactcgaccccaactccncatccgagagaactatcagccgaccctcgacgggtcctagaccgtctctcgtcggcctacgaagtccgtacggaccctaccgtccacgtccccgtaccgtacgaaccctacgtaccgtggggaccggtcccgtaccgggtaccgtaaggacgttcgggtacgcgttaacgtaacgtttaacgttacgtacggtacgtcgtaaccggtaccggaaaccggggtaccttaacgaaacggttagggtacgggtaacttaaacggaccgtaacttaccggggtaggtacgggtttaccgggtttcgggggttacggttacccgggaaccggggtaaacccgggtaacttaaacccggggccgttaccccggtacccggttaacggtaaccggg

SEQ ID NO: 24428 - DNA, 680 bp, Homo sapiens
  misc_feature: GYAE6OF01DHBW2.21.22.B11.1.454.CMB.1.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
  modified_base (665)..(665): a, c, t, g, unknown or other
  misc_feature (665)..(665): n is a, c, g, or t
  modified_base (670)..(670): a, c, t, g, unknown or other
  misc_feature (670)..(670): n is a, c, g, or t
  modified_base (673)..(678): a, c, t, g, unknown or other
  misc_feature (673)..(678): n is a, c, g, or t
  modified_base (680)..(680): a, c, t, g, unknown or other
  misc_feature (680)..(680): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagagaataatcagcgcctcgagggtccctgaccgnttctnggctccaagtctggcacctcagcctccngaccatcagtggctccggtccgaggatgagctgactattactgtgcatcgacgggcgacaacagtcgggatgaaccaatcgtaggaggtccggggtttggggtcgtttccggggacgggtaacggggaacccgtaaggtccgttacgggaaccccggttacccggttaacgggttaccgaaccgggtaaccccgtaaacgggtcccgtacccggtcccccccggttaccgggttaccctaccccgtttcccgttcccggtttaccccccctacccccgttccccgttaccccgggaacggtaccccgggtaaccggtacccgttacgggaaccgggtcccggggtaccggttaccgggaccggtaaaccgggcccgacgtaacgtaggcngacgncgnnnnnngn

SEQ ID NO: 24429 - DNA, 824 bp, Homo sapiens
  misc_feature: GYAE6OF01D5S9F.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtccggggaccccggnaggagggtccaccatctcttgttcgtgggacgacaacctacaacagtacggaagttaattatgtattcgtggtatacagacctaacctccgaaggtaactccggaccccctaaactccctacactacccgaagaacggtaaattaaactcgacggtacccgggtcccccttacggtaaccgggggttaccccctaggtaaacccgttacgttttcccgtcggttccggtaacccgttacccgtaaaacggttcccggtccgggtaacccctaccccgttaaccggtaccggtaccccccttcccgtaaccggaacccccttagttacccggtaacgggtttcggggtaccccccgttaaccgggtaccccggtaggtacgttacgggaccggtacgtttacgtaaaccgtttaactttaaccggtgttacggccttaacgaccgggtaacccggacgtaccgaaaccgtgggtacggggtactaaccgaaacgtacgttcggtaacgggttcgggtgggggttttacgggtaccgggttacccggggaggggtaaaaccgacccccgggtaaaagtccccggttaacccgggttagtaaccggtaaccccgg

SEQ ID NO: 24430 - DNA, 756 bp, Homo sapiens
  misc_feature: GYAE6OF01BR6RR.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnagacggtcaccatctcttgttcgtggacggcaactccaacatcggaataattatgtatcgtggtatcagacaacctccgaaggtatccggaccccaaactcctcactaccgaaggtaacgaaataactcaacggccggcccctaggaccgggggttccctaggaccttatttccgtacgtcggtacctacgtaacgtcgtcgtacctaccgtcaccggcccttaccgtacgaaccctaagttccgtacgggtccgggtaccgttacccggggtacggacggtacgtcgggaaaccggtctacggtaaccgtttaacttaccggtacgttacggacccgtaacgtaccccggggtaacgggaaacccgacttaaacccggaagggtttcgggaaacgtttacggacctttaaaacgttcgggtaagggtaccgggtttaggggggtttacggggttccgggttaaccggggggaacggtaaacccggggtaaacccgttaaacgttcccggggtaaccccgtttaaccgggtcgggttaaaacccgg

SEQ ID NO: 24431 - DNA, 708 bp, Homo sapiens
  misc_feature: GYAE6OF01AN1GX.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagacgggtcaccatctcttgttctggaggcaactccaacatacggaagtaattatgtattctggtatcagcaactccaggaatcggacccccaatcctcatccagagaatatcacgcgcctcgacggggtccctgaccgtattccgtctcggacctaccgaagtcgtcggacctaccgtcaccgtccctccgtacgacctatcgtacggtcgggccttccgggaccgaggtactggacggtctacggtaacttacgttacgtcggtacgtccgtaacggttaccggaacccgggggtaccaccgtaaaccggtagggttacgggaacttacggtaaaccgttaacggttaccggttaggggtaaccgggtttccggggggttttaggggttcccgggtttacccggggggaacccggggtaaaccggggttaaaaccccgttaaaccggttccggggttaaaccccccgggtttccgggttaaacgggtaacccccggg

SEQ ID NO: 24432 - DNA, 638 bp, Homo sapiens
  misc_feature: GYAE6OF01CTN6M.21.22.B11.1.454.CMB.1.raw
  modified_base (410)..(410): a, c, t, g, unknown or other
  misc_feature (410)..(410): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (629)..(629): a, c, t, g, unknown or other
  misc_feature (629)..(629): n is a, c, g, or t
  modified_base (632)..(638): a, c, t, g, unknown or other
  misc_feature (632)..(638): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagccggccctcgacgggggtccctggacccgattcctcgtcggcctccgaagtctggccacctcacgccctccctcgaccatcgacggtcgggccgtccccgggtaccgagggattggaggctgtactattactgtgcagtacgacggacacgaaagtggaatgaactaagtgaggacggtgggtttgggnggttccggggagggtacgggaccgtaaacgtccggtacccggtaccgttacgggtacgaccggacccgacggtccgtcccgccccgtaccggtccctaccgttcccgttcccgttccccctaccccttcccgttcccgttccgttaccgttaccgtacgtcggtaccggtccggggtccgtacggtccgaaccggtccgcgtaacgtgtcngncncgancgnnnnnnn

SEQ ID NO: 24433 - DNA, 786 bp, Homo sapiens
  misc_feature: GYAE6OF01DUQGO.21.22.B11.1.454.CMB.1.raw
  modified_base (181)..(181): a, c, t, g, unknown or other
  misc_feature (181)..(181): n is a, c, g, or t
  modified_base (206)..(206): a, c, t, g, unknown or other
  misc_feature (206)..(206): n is a, c, g, or t
  modified_base (656)..(656): a, c, t, g, unknown or other
  misc_feature (656)..(656): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcacctcactgcgcgacgggtccgtcgggccctagtctggtnacgtcgactcacgcccacccgtacncggtccgtccgggtacccggggaccccggaggaacggtaccggtaccaccgttacgttccgttcgttttcggttacggacggacgtaaccctaaccgtacgaaaccgtaaggttaacggttaaagttaactttgttacgtttacgttacgttagtaccgtactaccgaaccgtaccggtaacgtaacgggtaccgtaccccccgaaaccccttaacttccactaaccggtaaccgaaggtaaacgtaactaacgtaccggaacccggtcgtacccggtacgggttacccggtccacgtacgttactccgtcgcgtacctacgtacggttccgaccgtacctaccgtctacccgtcccgttacgaccgtaccgtacgtccggtacggggtcccgtccgggtaccgtacgggtagacggttcgacggttacctaagttacgtcctttagggntccgttacgaacgtcgggtaaccgaacctacgtaggtacgagtactacgtactagtcgggaaggtcgggtttcggacgggtcggtaacgggcgtaaaccggtcgaacgtcccgtacggtcgccggtaacg

SEQ ID NO: 24434 - DNA, 896 bp, Homo sapiens
  misc_feature: GYAE6OF01BPEE7.21.22.B11.1.454.CMB.1.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
tcagtcgtcgctcgcacgaccggtgctcgatttagacgacagctcaggggggggaagctcagcttcagctgtggtagagaagacaggactcaggacaatctccagcatggccgcttccctctcctcctcaccctcctcactcactgcgcagggtcctcgggcccagtctggtgctgacctcacgcccaccctnacgtcgtccgtccggggaccccccggnaggtacggtccacctattcttcgtttgttccgtagggacgaccaactccgaatagtacggtaaagttattagttgttaacttcgtaggtatacgagacctaaccgtaccgaaggtaaccgtcccggtaacccccctaaagttccctacgtactacccgaaggtaagtaaactaacgtaccgacggcccgtacccgttaccgggtaccggggtcccccttaggaacccgttacgtttccgtacggttacccggtacccttaaccggtacgggttacccgttaccggacccctaaaccccggtttccgaaccccgttccccgttaaccccttacccgggtaacccttaaccggttaccggttaaccgggggttccccgggaaccccggtttccccgggggtaaaccgggtaagggtaccggttaccgggtaggttaccccggttaacgtttaacccgggttttactttaccgggttaccgtacgtaaccgttacggtacccgggtaaccgggtaacgaccgtaacgttaaggcggttaacacgggtaactaaccggttggtacgggtacgggtttccggggtcggggtttaacgggtaccccgggaaagggtttaaacccgggaacctttaacccgggtaccgggtttaacccccgtcgggtaaacccggtaaccggg

SEQ ID NO: 24435 - DNA, 786 bp, Homo sapiens
  misc_feature: GYAE6OF01BIB54.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatgaccggcttccctctcctcctcaccctcctcactcactgcgcgagggtccgtcgggcccagtctgtgctgactcgacgccaccctcagtcgtccgtccggggaccccggcgaggacgggtcaccattctcgttcgttcgtgggacggacctaacctaccaaacgacgtacggtaagtaattattagtattcgtagtatcacgacctaacgtccgaaggactccggaccccctaaacgtcctacacgtaccaaggtaacggaactaacgtcgacggcccggccgtccggtacgggtcccgtacggtaccgtattccgtcgtacgtcctaccgaacgtcgtcggtaccctaacccgtccgtaccgtccccttacccgtacgtaaccctacgtacggttacgggtcccgggtaccgttacccggggaccgtacgggtaacgtcgggtaaccggtcgttacgtaacgtttaactttccgggtacggttcgaaccgtaaccggttacccgggaacggggtaccccgtaacgaaaccgttagggtacgggttaactaacggtacgttaaaccgttacgggtacgggtaaccgggttgggggtttacggggttcgggttaaccggggaccggggtaaacggtaaacccgtacgggtaccgttacccgggtacgtacgggtacccg

SEQ ID NO: 24436 - DNA, 742 bp, Homo sapiens
  misc_feature: GYAE6OF01EVTI2.21.22.B11.1.454.CMB.1.raw
  modified_base (257)..(257): a, c, t, g, unknown or other
  misc_feature (257)..(257): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcgggacccccgggcagagggtccacctatcctcttgttctggaggaccaactccaanatcggtaagtaattatgttaattctggtatcgagaccaactccccgaaggaactccggacccccaaacttccctaccaactccgaaggaagtaaactaacgtcacggcccggtcccgtaccggtacggggtccctacggaaccgtacttcgtcgtcggcctaccgaagttccgtcggacctacctccgacgtccccttaccgacgtacccagtccgtacgggtccgggtccgtaccccgggtaccgtagggacgtacgggacgggtccgttacgttaacctttacgtttaacggttcgttacgaccgttacgttacccgggaaccggggtactaaccgaacgtaggttacgggaatacggaaccttaaacgtccggttagggtacggggttacggggtttcggggtcggggtttaaccgggacccggggtaaacgggtaaacccgtaacgggttaccggtcccggttaacgtccgggtaacccgg

SEQ ID NO: 24437 - DNA, 737 bp, Homo sapiens
  misc_feature: GYAE6OF01DGJOV.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcgagggggggggaagctcagcttcagctgtggtagagaagacaggactcagacaatctccagcatggccggcttccctctcctctcaccctcctcactcactgcgcgacgggtcctcgggcccagtctgtgctgactcacgccaccctcagcgtcgtcggggaccccggnaggacgggtccacctatcttcgttcgttcgtggacggtacaacctaccaactaagtacgggtaaagttaaatttagtagttactttacgtaggttactacgaacgtacctaaaccgtccccgaagggtaaaccgtcccggaaccccctaaaaccgttcctaccaactacccgaaggaacggtaaaattaacgacgacggacccggtcccgtacggtaccggggtccctacggaccgttattccgtcgtacgtcctaccgtaacgttcgtacggacctacctcgaccgtacccgttacccgtacgaccctagtccggtaacgggttcccgggtaccgttacccgggtaacggacggtacgtggacggtacctagttaccttaacgttcgtagtacgactacgtaccggacggtacgacaagtggtagacgtagactacgtcggaggtacgggttgggttacgggtcggttaaccgggacgggaacggtaaccctaaggtccgggtaaccctggtaccgtaacgg

SEQ ID NO: 24438 - DNA, 788 bp, Homo sapiens
  misc_feature: GYAE6OF01EQ2RU.21.22.B11.1.454.CMB.1.raw
  modified_base (181)..(181): a, c, t, g, unknown or other
  misc_feature (181)..(181): n is a, c, g, or t
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctcgggcccagtctgtgctgactcngcccacctcagcgtctcgggacccccggnagaggtccacatcttcttgttcgtggacgcaactccaacatacggaagtaattatgttatttctaggtatcagcaacctcccgaaggaactccggaacccccctaaacttccctacactaccgaaggtaaggaaactaactcacggccggtaccccgtaccggacgggggttccccctggaaccccgtatttcccgtacgttcggtacccttaaccgtaacggtttcctccgggtaccctaccccgttacgacccgtcccccgtttacccgtaaccgtaaccccgtaagttccgtaacgggggttcgggtacccgttccccgggggtaacggtaacggggtatcccggggtaaggtccgttaacgtaaccgttttaacgtttacggtgtacggtcgtaacgtcccggaacggggtaccgaccgtaaacgttggtacggggaatacggtaactagttccgttaggggtccggttacggggggtttcgggtcgggttaaccccggggacgggtaaacccggggtaaacccttaaacgggacccccggttaaccgggttaccgttacggggggtaaccccc

SEQ ID NO: 24439 - DNA, 867 bp, Homo sapiens
  misc_feature: GYAE6OF01CTYVP.21.22.B11.1.454.CMB.1.raw
  modified_base (59)..(59): a, c, t, g, unknown or other
  misc_feature (59)..(59): n is a, c, g, or t
  modified_base (142)..(142): a, c, t, g, unknown or other
  misc_feature (142)..(142): n is a, c, g, or t
  modified_base (243)..(243): a, c, t, g, unknown or other
  misc_feature (243)..(243): n is a, c, g, or t
tcagtcgtcgctcgcacgaccggtgctcgatttagacgacagctcgagggggggggaanctcagcttcagctgtggtagagaagacaggactcaggacaatctccagcatcggccggtcttccctctcctctccaccctccncactcactgccgcgacgggtcctcgggccctagtctggttcgctggacctcgaccgtccctaccctcgacggtccggtcgtacccgggggacccccgggtntaagggaccgggttaccaacctagtttccgttaccgtttcggttacggaccgggacggaccctaaaccgttcccaaaggtaagttaccggggtaaatttaagtttgtacggttacttcggttaacggtactaccaacggtaccctaaccgtccgaaaggtaccgttaccccgaccctaactccaactacgtaccgaaggacgtaaactacgacgcgccggtacctcgggtaccggtccacgtaccgtattccgtcgtacggaccctaagtaccggtcgtacgaccctacctaccggtacccgtacccgttacccgtacgaacccttaggtaccggtacggggttcccgggtacccgggttacccgggtaacggcggttaagttacccgggacgttaccgttaaccgttacgttaacgtttacggttcggtaccttaacggtacccggacggtaaacgggtcccgtaacgaacgggttagtaccgggtacgttaacccgaaacggttcggttacggtaacggggttggggttaacccgggtttgggggtacccgggtaacccggggtaacgggaacgttaaccccgttaaaggtccccggttaaccggtggtacccggtaaaccg

SEQ ID NO: 24440 - DNA, 645 bp, Homo sapiens
  misc_feature: GYAE6OF01E2Q4V.21.22.B11.1.454.CMB.1.raw
  modified_base (209)..(209): a, c, t, g, unknown or other
  misc_feature (209)..(209): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (394)..(394): a, c, t, g, unknown or other
  misc_feature (394)..(394): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtcgtcgggacccccggnagaggtcaccatctcttgttctggagcactccaacatcgaagtaattatgtattctgtatcagcaactccaggatcggaccccaatcctcatccaagagtaataatcacgccggcctcgacgggggtcctcgaccgtnttccgtcgtcggcttccaagttcgnggtcncctcgacgtccctcccngtacccatcacgggttcggaccgtccggtaccggagacgttaggacggtcgtacgtacggttactttacggtcgtacgccgtaacgtccggaaccggggccgtaccaaacgtacgttaggggactacggtaaccgtaaagtccgttgggaacggttcgggggtttaggggtcggtttaacccggggggacgtaaccgggggtaaaccctaaacggttacccgggtaccccggttgttaacccgggtacggg

SEQ ID NO: 24441 - DNA, 880 bp, Homo sapiens
  misc_feature: GYAE6OF01BZDA0.21.22.B11.1.454.CMB.1.raw
  modified_base (780)..(780): a, c, t, g, unknown or other
  misc_feature (780)..(780): n is a, c, g, or t
tcagtcgtcgctcgcacgaccggtgctcgatttagacgacagctcaggggggggaagctcagcttcagctgtggtagagaagacaggactcaggacaatctccagcatggcccggcttccctctcctcctcaccctcctcactcactgcgcagggtcctgggccccagtccgtgtcgtcgtacgtacctacgaccgaccccctcccctacgaccggtccggttccgggtacccccgggggaccccccgggagaagggtacgggtacccaacctcgttcctttcgtttcggttaccggtagggaccgacctaaccgtaccaaacgtacggttaacgggtaaatttaacttagttacgttaactttcggtagtaacctacgaaccgtaccaaaccccgttacggaacggtaaccgtcccccggaaaacccccttaaccttccctacgtacctaacccggaaggtaaacggtaaacttaccgacggaccgggtcccccgttacccggtaccggggtacccggggtttccctaaccgggtacccgttacgtttcccgtcggtacccgggttaccccttaacggtacgttcccggggtacaaaccccggttccctaaccgcccgttccccccttaacgtaaccgaaccctcgtaacggtcgggtcccggtccggttaccccggggaggtacgtaccggtaggtaccggtacttacggtaactttacggttagtcggtacaacgtacgtacccgggacggtaacctcgaacgtggtaggaacgtanacgttactgggtggtaccggggttggttacggggtaccgggtcggaaacggggaccgttaaaccgtcgggtaacccggcttaccggggtaacgaccccgg

SEQ ID NO: 24442 - DNA, 751 bp, Homo sapiens
  misc_feature: GYAE6OF01AFB4I.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcggggacccccgggnaggagggtcaccatctcttgttctgggaggcaactccaacatacggaaagttaattatgttattcgtaggtatcagacaacctcccgaaggaacgtccggacccccaaactcctacactaccgaaggaaggtaaataacgtcacggccggccctacggtaccggggtccctggtaacccgtattccgtcgttcggaccctacgtaacgttcccgtacgggtaccctacccgtccgtaccgtaccccttccccgtagaaccccttacgtccgtaacggggttcccggtcccggttacccggggtaccggaaggtcggtacggacgggtcctacgtaaccgttttaacgttcgtaggtcctacgtaacgcccgggtaaacgggtccgtaacgaacgtagggttacgggactaacggtaacttacggtcggtacgggttcgggttcgggggttacggggttccgtaccgggggaaccggggtaaacgtaacccggttaaacggtccgggttaacccccggtttcggaaccggtaacccgg

SEQ ID NO: 24443 - DNA, 653 bp, Homo sapiens
  misc_feature: GYAE6OF01EQKRT.21.22.B11.1.454.CMB.1.raw
  modified_base (226)..(226): a, c, t, g, unknown or other
  misc_feature (226)..(226): n is a, c, g, or t
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
  modified_base (547)..(547): a, c, t, g, unknown or other
  misc_feature (547)..(547): n is a, c, g, or t
  modified_base (579)..(579): a, c, t, g, unknown or other
  misc_feature (579)..(579): n is a, c, g, or t
tcagtcgtcgctcgcacgaccggtgctcgattttagacgacagctcaggggggggtaagctcgagcttcagctgtggttagagaacgacaggactcaggacaagtctaccagcatggccgcttcctctcctctcaccctccgtctactcactgcgcgtacgggtcctgggccctagttactgtcgctgactcgagcccacctcaggcgtcgtcggggacccccggntaggacgggcacccggattctacgttgtctggaggcaactccaacntcggaaattattatgtacttcgtaggtactcgatactaactcccgaggtaacnccggtaacccccaaacttccgaacgatccaagggaacgtaaatacgtcacggtccgtaaccctacgaacggggttcccctaggaaccgtacttccacgttaggtccaccgaaagttccgcggaccgaacctcgaacggtccctccgtgaaccctatccgttaagggcgggaccctacccggggtacaggtagtcggacggtacctcgtaacgtttattcggngtaagccaagtccggacggacctacaaacggngtacggatcgaatatcgtggacgtgttagggctaccgggcggaacgtaacctaagtccgtacgtgtaacggccc

SEQ ID NO: 24444 - DNA, 640 bp, Homo sapiens
  misc_feature: GYAE6OF01DW8P6.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggnaggacgggtcaccatctcttgttctggaggcaactcaacatcggaagtaattatgtattctggtatcagcaactccaggaatcggaccccaaactcctcactccagagaataatcagccgcctcgacggggtccctgaccgtattcctcgtcggtcctccgaagtctacgggcctacctacgacgtcccttacccgtagacccctaagtccgaacgggttcgggccgttaccccgggtacggaggtactcgggaacggtcccgttaagtacctttagttaaccgtggtacgcctaaggttacccgaaccgggggtacactaacgaggttcgggaatacggaaactagttcgtaggtacggtcggggtttggggtgttaccggggacggaacggtacctaaacgtcggtaacccgtcggtgtaacccgg

SEQ ID NO: 24445 - DNA, 851 bp, Homo sapiens
  misc_feature: GYAE6OF01AR54F.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgacgggtcctcgggcccagtctgtgctgactcacgcccacctcagcgtcgtccggggacccccgggcaggacgggtccacctacttccgttctttcgttcgttgggaggacctaaacctaccaaactagttaccgggtaaaagtttaatttaagttgttaactttcgttagggttaactacgacgacctaaaccgttccccgaagggtaaccgttcccggaacccccctaaaccttcctacctaccgttaccgaacggtaaaggtaaacttaacgtaccgaaccgggtcccggtaccccgttaccgggaaccgggggttccccttacgggaacccgttctttccgttcgtcggtaccctaccgtaacggttccgcggtaccctacgtcctacccgtccccttccgtaaccgaccctaacgtacggtacgggtacccggggtcccttacccgggggtacgtaaggtacgttacgggacggttaccttacggtacctttaacggtttccgtacgggttacaacccggtacggtacgggaacccgggtcgtaaacctaacggacgggttaacggagtacggtaaaccgtacggttacggtagggttcgggttacggggtttacggggtacggttaaccgggggaccggtaaacccgggtaaacggtaacccgttccgggacccgttaacggggtcgtaacccgg

SEQ ID NO: 24446 - DNA, 305 bp, Homo sapiens
  misc_feature: GYAE6OF01A83YP.21.22.B11.1.454.CMB.1.raw
  modified_base (295)..(295): a, c, t, g, unknown or other
  misc_feature (295)..(295): n is a, c, g, or t
  modified_base (301)..(305): a, c, t, g, unknown or other
  misc_feature (301)..(305): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctcgttccccgccctcctcctcgtctctactgagcggctggcaaggcncatagnnnnn

SEQ ID NO: 24447 - DNA, 811 bp, Homo sapiens
  misc_feature: GYAE6OF01AGHGC.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggnaggagggtcaccatctcttgttcgtggaggacaactccaaactatacggaaagtaatttatgttaattcgtggtactcgagacctaaccgtcccgaaggtaacgtccggacccccctaaaactccctacactacccgaaggaacggtaataactccgacggtccggtaccccgtacggaccgggggttcccctacggacccgtacttccgtacgtcggtacccttaccgaacggttccgtacgggtaccctacccgttacgacccggtccccttaccccgtacggaacccctacgttacccgtacggggttccggggtacccgttccccggggtaccggagggtacggtacgggacggttccgtacgtactttacgttaacgttcgggtaccgccgtaacggtacccgggaaccgggggtacctaacccggaaacgtagggttacgggaattaccggaaactacgtttccgggtagggtaccgggggtttacggggggttttaggggttccggggttaccgggggggaaacccgggtaacggggtaaacccctaaaccgggttccggtaaccccggtttaccgggtaacggtaacccggg

SEQ ID NO: 24448 - DNA, 307 bp, Homo sapiens
  misc_feature: GYAE6OF01AW95E.21.22.B11.1.454.CMB.1.raw
  modified_base (297)..(307): a, c, t, g, unknown or other
  misc_feature (297)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggagggaccaaactgaccgtcctaggtcagccaagctgcccctcggtcactctgttcctaccctcctcctcgtctctactgacgcgggctggcaaggcgcagtgnnnnnnnnnnn

SEQ ID NO: 24449 - DNA, 756 bp, Homo sapiens
  misc_feature: GYAE6OF01A9S1K.21.22.B11.1.454.CMB.1.raw
  modified_base (183)..(183): a, c, t, g, unknown or other
  misc_feature (183)..(183): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctgggcccagtctgtgctgactcanccacctcagccgtcgtcggggacccccggcaggaggtcaccatctcttgttctggagcaactccaacagtacggtaagtaatttatagttattctggtactacagtaccaacctacccgaaggaacgtccggaaccccctaaacctccctactaacgtccgaaggtaacggtaaactaatccgacggccggtaccccgttacggaccgggggttacccctacggtaaccgtacgtttcctcgtcggtacctaccgtaacgttccgtacggacctacctaccgaccgtcccgtacccctacgacccacgttccgaacggggttccgggaccccggttaccgggtaaccggacgggtaactcggggtaacgtacgttacgtaacttacgtttaccggtggttaccactaccggtacgaaccggggtaccacgaaccgtaggtacgggtactaacgtaacgtagtcggtacggtagggggttccgggtttggggttcgggttaacccgggggaggggttaacccgggaaacccgtaaacggttacccggtacccggttaaaccgttcgggaacccg

SEQ ID NO: 24450 - DNA, 711 bp, Homo sapiens
  misc_feature: GYAE6OF01CI3V0.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcggggacccccgggnaggaggtccaccatctcttgttctggaggaccaactccaaacagtacggaaagttaattatgttacttcgtaggttatcagacaacttcccgaaggaacgtccggaccccctaacgtcctacacctaccgaaggagtaaataactacgacggccggcccgtacgtaccggggtccctacggtaccgtacttcgtcgtcggcctaccgtaacgtcgtcgacaccctccgacgtaccctcctacgacctagtccacgggtcggtcccgtccggtacggaggtacgacggtacggtactgttaacttatttacgtcgtacgctaacgtccggaacgggaccgaccgtaaacgaggtacgggtaaactcggaaactacgttacgggttaggtaccggggttgggggtttacggggttccgggttaacggggggtaccggaaccggggtaaacccgtaacggttaccgggaaccccggttaccgggtacggtaaccccggg

SEQ ID NO: 24451 - DNA, 618 bp, Homo sapiens
  misc_feature: GYAE6OF01EZB8U.21.22.B11.1.454.CMB.1.raw
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (387)..(387): a, c, t, g, unknown or other
  misc_feature (387)..(387): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnaggaggtcacatctcttgtctggagcaactccaanatcggaagtaattatgtattctggtatcagcaactccaggatcggaccccaatcctnactccagagaatatcagccgcctcgacggggtccngacctnttctcgtcgtcctacaacgttcacggcacctcgactccctccncgaccagtcgtaggtcggtccgtcgggacgaaggtataggaggtcctacgtaacttaacgtttacgtgtacgtactaagtcccggacggggtaaccacgtaacgtaggtacggggaactacgggaactaaagtccggtaggtacggttcggggtttagggtcgggttaccgggaacgggaaaccgggtaaacccgtaacgttaccgggaacccgttcggtacggtacccgg

SEQ ID NO: 24452 - DNA, 925 bp, Homo sapiens
  misc_feature: GYAE6OF01BS1W8.21.22.B11.1.454.CMB.1.raw
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (917)..(917): a, c, t, g, unknown or other
  misc_feature (917)..(917): n is a, c, g, or t
tcagtcgtcgctcgcacgaccggtgctcgatttagacgacagctcagggtcctgggcccagtctgtgctgactcagccaccctcagcgtcgtcgggacccccgggcaggagggtcaccatctcttgttctggaggcaactccaacatcggaagttaattatgtattctggtatcagcaactccgaggaactcggacccccaaactcctcactccagagaataacncaggccgccctcgacgggttccccngaccgtattcctcgtacggcctaccgaacgtccgtacggacctacctccgaccgtccctcccgtacgacctactccgaacggtcggtacccgtccgggtccggaaggtacgtcggacggtcgtacgtacttacttacggttcgtacgtacgtacggtccggaacgggtaccgaaccgaacgtaacgggtaacgggtaacgttaacgaacgtaaccgttcgggtacggttaaacggggggttcggggttttacgggggttaccggggttacccgggggaacggggtaaccccggggtaaaccggttaaacccgggttaccccgggttaaccccggggttaaccggttaaaccggggtttaccccgaaacccgggtaacccggttaaaccgggtcccccggttccccgggtaccccccggtttaacccggggtacccttaccccggtttacccgtttacccccccgttttacccccccggtaacccccgttttcccccgttaccccgtttacccgggtttccccctttaacccgggtttacccggttaacccgggggtaccccggttacccggggttaccgggtaccggtaaacccggggtaccggttacccggaacggttaacgccggttaaggccttcgaccgttcgtaacggccttcgaacggccncgcgtacg

SEQ ID NO: 24453 - DNA, 314 bp, Homo sapiens
  misc_feature: GYAE6OF01C9LM0.21.22.B11.1.454.CMB.1.raw
  modified_base (302)..(302): a, c, t, g, unknown or other
  misc_feature (302)..(302): n is a, c, g, or t
  modified_base (308)..(314): a, c, t, g, unknown or other
  misc_feature (308)..(314): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcgggttgggtcgttcggcggagggaaccaaacgtgaccgtcctaggtcagcccaaggctacgccccctggtacactctcgttccccacctcctcctcgtctctactgacgcggcgtgacacggcncatagnnnnnnn

SEQ ID NO: 24454 - DNA, 757 bp, Homo sapiens
  misc_feature: GYAE6OF01A6ZJX.21.22.B11.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtccgtccggggacccccgggnaggacgggtccaccattccttcgtttgttcgtgggacggccaacctaccaacagtacggtaaagttaattatgttattcgtaggtactcagacctaacctcccgaaggtaactccggaacccccctaaactccctacactacccgaaggaacgtaaatacgtaccgacggtccccggtccctacggtaccgggggtcccctaggtacccgtattccgtacgtcggtacctaccgtaaggttccgtacggaccctacccgtaccgaccgttcccctaccgttacgaaccctagttaccggacgggttccgggtacccgtcccgggtacggaggtacgtacggacggtccgtaacgttacgtttaactttaccgtggtcgacgtaaccgtaccgggaaccgggtaccgaactaaacgtgggtaccggatacggaactaggttcggtagggtcgggttcggggttcggggttccgggtaccggggaacgggtaaacggtaacccgtaacggtaccggtaaccccggttcggtacgggtacccg

SEQ ID NO: 24455 - DNA, 867 bp, Homo sapiens
  misc_feature: GYAE6OF01D5DF4.21.22.B11.1.454.CMB.1.raw
  modified_base (838)..(838): a, c, t, g, unknown or other
  misc_feature (838)..(838): n is a, c, g, or t
  modified_base (855)..(855): a, c, t, g, unknown or other
  misc_feature (855)..(855): n is a, c, g, or t
  modified_base (862)..(862): a, c, t, g, unknown or other
  misc_feature (862)..(862): n is a, c, g, or t
tcagtcgtcgctcgcacgaccggtgctcgatttagacgacagctcagggtcctgggcccagtctgtgctgactcagccaccctcagcgtcgtcgggaccccgggcaggagggtcaccatccttcttgttcgtggaggacaacctaccaacagtacggtaaagttaattattgttattcgtaggtatacacgacaacctacccgaaggaaacgtccggaaccccctaaactcctacactaccgaaggaaggaaacttaacgtacgacggacccggtcccgtaccggtaaccgggggtccctacggaaccgtcttctcgtcggacctacgtacgtcgtacgaccacctacgaccgtccctacctacgaacctacgtacggtacgggtccggggtcccgtacccgggggtaccggaacggtacggtacggtaccgggtctttacgtactttaacgtttacgttacggtacaccgtaacgtaccggaaccgggtacctaacgaacggtacgggtaaggtacggttaacgaacgtaacgttacgggtcggttaacggggggttcggggttttcgggggtttaacggtacccgggggtaacggggaacccggtaacccggtaacggttaccggtaacccgggttaacgtacgggtaccgaccggtaccccggtacggtccccgtaccccgtcccggttaccgttacccgttaccgtacccgtttacccctcccccggtaaccctccggttaacccgacggtacccggtaacgggtacccgtaggggtcccgtacgggggtaccgcgggtaaacccggacggtaaccggacgtacggtaaacggnacctcgtcgacgcgtcncgactgngcgcg

SEQ ID NO: 24456 - DNA, 656 bp, Homo sapiens
  misc_feature: GYAE6OF01CGN25.21.22.B11.1.454.CMB.1.raw
  modified_base (213)..(213): a, c, t, g, unknown or other
  misc_feature (213)..(213): n is a, c, g, or t
  modified_base (391)..(391): a, c, t, g, unknown or other
  misc_feature (391)..(391): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcggggacccccggnaggacgggtcaccatctcttgttcgtggagcaactccaacagtacggtaagtaattatgtattcgtggtatcagacctaacctcccgaaggaacgtccggaacccccaaacttcctacactaccgaagaagtaataactcgacggccggccctacgaccggggtccctacggaccgtnttcctcgtcggtacctacgtaacgtcgtcggacctaccgtcaccgtccctcccacgacctactcgtaagggtcggtcccgtaccgggtacgagggtactcgggtacggtcttacgtacttaacgttctaggtcacgtactacggacgggacacgtaacgtagtcggaatcgaactacgtcggtaggacgggtgggttgggttacgggtaccgggacggggtaacggaaccttacggaccggtacccggttacgtacgggtacccg

SEQ ID NO: 24457 - DNA, 812 bp, Homo sapiens
  misc_feature: GYAE6OF01A3PML.21.22.B11.1.454.CMB.1.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (412)..(412): a, c, t, g, unknown or other
  misc_feature (412)..(412): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctnacggcgtcgcggggaccccggnaggagggtccaccntcctcttgtctgggagaccactccgaaacntacggtaagtaattatcgttattcgtaggtactcagactaacctaccgaggaactccgggaccccctaaactcctactacgtaccgaacgaacggtaaataacgcgaccggaccgggtaccctaccggtaaccggggtccccttaggaacccgtnttaccgttcggtacgtccgtaaccgtaagtccgtacggacctaacccgtaccgtaccgtccccgttacccgtaccggtaaccctacgttaccgtaacggggttcccgggtcccggttcccccggggtaacgggtacggtaacgggtcggtaaacggtcccgtaacggttaaccgtttacttaccggttacgggtacgtaacgtaaccgggttacccgaaccggggtaaccgtaccgaaacggtaggtacgggtactaacggtacttaaaccgttccggggtaacggtaccggggttaccgggggttacggggttacggggttacccggggaacggggtaaacccggtaaccggtaaacccggttacccggacccgggtttaaccgtaggggtaacccccg

SEQ ID NO: 24458 - DNA, 810 bp, Homo sapiens
  misc_feature: GYAE6OF01DU88V.21.22.B11.1.454.CMB.1.raw
  modified_base (58)..(58): a, c, t, g, unknown or other
  misc_feature (58)..(58): n is a, c, g, or t
  modified_base (231)..(231): a, c, t, g, unknown or other
  misc_feature (231)..(231): n is a, c, g, or t
  modified_base (385)..(385): a, c, t, g, unknown or other
  misc_feature (385)..(385): n is a, c, g, or t
tcagtcgtcgctcgcacgaccggtgctcgatttagacgacagctcgaggggggggaanctcagcttcagctgtggtagagaagacaggactcaggacaatctccagcagtggccggtcttccctctccctcctccaccctcctcactcactgcgcgacgggtcctcgggcccagtctgtgcctgacctcgacgccctaccctcgagccggtcgtcccggggacccccgggnaacggacggtccacctagttccttcgtttgtccgtagggacgacctaaaccgtaccaacgtagtacggtaagttaattagtgttacttgtagtactacagaccacctaccgagtaacgccgacccctaactccacactacgaagaagtaatacncgacgccggtccgtaccggacggtaccctacgtaccgtacttccgtacgtccgtaccgtacgtaacgttccgaccggtaccctacccgtaccgtacccgtccccctacccggtaccgtaacccgtaacgtcccgggtaacggttcccgggtaacccgtcccgggttaaccggaggtacgtacggtacggtaccgttagtaaacccgtttacgttacgtaccgttacgtaacccggtaaccgtacccggggaacccgggtaccaaaccgtaacgggttaggttaacgggaactaacgtaaaccgttcggtagttccgggggtacggggttttacggggttccggggttacgggtaaccggggaaccgggaaccggttaaccccgtaacggtaccccgggtaccggttaaccggtcggtaaccccgg

SEQ ID NO: 24459 - DNA, 671 bp, Homo sapiens
  misc_feature: GYAE6OF01BBNQO.21.22.B11.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctagactcagccaccctcagcgtctcgggaccccggnagaggtcaccatctcttgtctggagcaactccaanatcgaaggtaattatgtattctggtatcagcaactccaggactcggaccccaaactcctcactaccagaggtaactaatcagcgcctcgacgggtccctagaccgtacttccgtctcggtcctaccgtaacggtccgtcgggacctacccgtaccgacggtaccccttaccctacggtacccctactaccgtaacggggttccgggtcccgttaccccgggtaccgggaacggttacgtcgggtacggtaccgtcgtaaacgtttacgtttacgtacgttcgaaccgtaccgttaccggaacgggtaccgtaccaacgtagtcgggaaatcgaactaagtcgtaggtagggttccgggttgggtcggttccgggtacggggaacgggtaaccaaacggtacggtacccggtacgtacgggtaacccg

SEQ ID NO: 24460 - DNA, 779 bp, Homo sapiens
  misc_feature: GYAE6OF01DBF5N.21.22.B11.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (280)..(280): a, c, t, g, unknown or other
  misc_feature (280)..(280): n is a, c, g, or t
tcagtcgtcgctcgcacgaccggtgctcgatttagacgacagctcaggggggggaagctcagcttcagctgtggtagagaagacaggactcaggacaatctccagcatggcccggcttccctctcctcctcaccctcctcactcactgcgcagggtcctgggcccagtctgtgctgactcacgccaccctcacgcgtcncgggaccccggngaggcggtcaccatctctgttctggagcaactcaacagtacggtaagtaattatgttattcgtggtatnagacaactccaaggaactaccggaccccaaactcctacactaccgaagacggtaaatacacgtacgaccgtcccgtacgggaacggtcccgtagaacccgttattccgtctacggtacctacgtaacggtccgttcggacctaccctacgaccgtccctacccgtacgaacctacgtacgtagggtcgggtcccgttaccgggtaccgaggtaactcgggtacgtacgtacgtaaccgtttagtttaaccgtacggttacaccgtttaacggaaccgaaacccggggggactaaaccgtaaccgtagggttaacgggtaaccgttacggtaaacgtaaaccgggtttacgttacggggtaaacggggtttaccgggggttttaggggggtttcccgggtttaaaccggggggacggggtaaaaccccggggtaaacccgttaaacccgggttaacccgggttaaccccggttaaccgggtttacccgggtaaaccccgg

SEQ ID NO: 24461 - DNA, 749 bp, Homo sapiens
  misc_feature: GYAE6OF01AOEZL.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctccctcctccaccctcctcactcactgcgcgaggtcctgggcccagtctgtgctgactcagccaccctcagccgtcgtcgggacccccgggcagagggtcaccatctcttgtctggacggcaactccaacagtacggaagtaattatggtattctggtatcagcaactccaggaactccggacccccaactccctcactaccgaagaaggtaaataacgcctacggcccggtccccgtacggtaccgggggttccccctggtaacccggtactttaccgtccggttacggcccttaccgtaaggtccctcgggtacctacccgtaccaccgtcccccttccccgtacgacccacgtccgtaagggttcccggggcccgttcccgggtacccgggtaagggtaacgttacggggaccggtccgttacggttaaccttacgttttaccgtggtaccgtaacgtaccgtaccgggaacccgggtaacgtaccgaaacgttacggttacggggaattaccgaaacgtttaacgttacgtcgggtacggggttcgggtttagggggttccggttacgggggacggtaacgggtaaaccctacgtaccggtacccgtccggttagggtacccg

SEQ ID NO: 24462 - DNA, 880 bp, Homo sapiens
  misc_feature: GYAE6OF01AUB8E.21.22.B11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgagggtccgtcgggcccagtctgtgctgactcacgcccaccctcacgccgtccgtccggggaccccccggngaggacgggtccaacctatccttcttgttccgtagggacggacctaacctaccaaacgtagtaccggtaaagttaatttagtacgttacgtttcgtaggttaactccgaagtaccctaacccgtaccccgtaagggtaaccgttaccccggaaccccccttaaaaccttccccgtaacctaacctacccggaaaggtaaacggtaaacttaacgtacccgaacgggtccccggtccccgtaccgggttaccggggttacccctacggtaaccctacgtttcctacggtacggtaccctaaccgtaacgttccgtacggaccctacccgtactcccgtaccctcccgtacgaccgtacgcgttacggggtccggtcccgtaccggggacgtagggacgtcgggtaccgtcgttaacgtaaccgttacgttcggtcgacgtaaccggtacgttaacccgggaaccccggggttaaacaaccgtaacgggttacggtaagggtaacccttaaggtaaacccgttagttccggggttaggtaaaccgggggtttccggggggtttaggttcccgggggtaaccggggaacgggtaaaacccgggtaacccttaacccgggttacgggttacccccgggttaaagggtcccgggtaaccccggg

SEQ ID NO: 24463 - DNA, 721 bp, Homo sapiens
  misc_feature: GYAE6OF01CA4XB.21.22.B11.1.454.CMB.1.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctnacgcgtcgtcgggacccccggnacgngggtcaccatctcttgttcgtggagcactcaacntcgaagtattatgtattcgtggtatcacgactaacctccgaggacgtaccggacccccaacgtcctacactaccgaacggaagaaactaacgtcacggccggtcccgtcgaccggggtcccgtagtaccgtacgttctacgtcggccttaccgaagtccgtacgggacctacccgtcaaccgtccctcccgtacgaccctacgtacgtacggtccgggtcctaccccgggtacggaggtacgacgggtcgtaccgtacgttaaccggttattaccggttgtactcggtaactaccgggtaaccgggtacgaaccgtaagtacggtagggtacgtaacggtaacctaggtacggtacggttacggggttggggtttaggggtccggggttaccggggtaccggggaaaccgggtaaaccgtaacccgggttaaccgggtacccccgggttagggttacccggttaacccggg

SEQ ID NO: 24464 - DNA, 909 bp, Homo sapiens
  misc_feature: GYAE6OF01C8C0F.21.22.B11.1.454.CMB.1.raw
  modified_base (58)..(58): a, c, t, g, unknown or other
  misc_feature (58)..(58): n is a, c, g, or t
  modified_base (224)..(224): a, c, t, g, unknown or other
  misc_feature (224)..(224): n is a, c, g, or t
  modified_base (521)..(521): a, c, t, g, unknown or other
  misc_feature (521)..(521): n is a, c, g, or t
tcagtcgtcgctcgcacgaccggtgctcgatttagacgacagctcgaggggggggaanctcagcttcagctgtggtagagaagacaggactcaggacaatctccagcatggcccggcttccctctcctcctccaccctcctcactcactgcgcacgggtcctggcccagtctgtcgctgacctcacgcccaccctcgacgccgttccgaccggggacccccggnaaggacgggtccacctacttccttgtttacgtcgtagggacgaccaacctaccaactagtacggaagttaattatagttattcgtaggtactacacgacctaaccgtccgaaggtaacgtacccgaaccccctaacttccctacgtaacctaccgaaggaaacggtaaactaacgtaccggaaccggtccccggtacccgtaacggtaccggggttaccccttacggaacccggtttacgttccgttacggtaccgttacctaccgtaacggtccgttacggaccctccgttaaccnccggttacccctaccggtaccaacccgtacgttacggtaccgggttcgggtaccccggtccgggtaacggtagggtaccgttacgggtacggttaccgttaacggttaccgtttaaacggtccgttaacgggtcggtaaacccgtccgggttaacccgggaaacccggggttaacgaacccgttaacgggtacggggtaacggtaaccgttaaccggtaaaccgttaaaccgggtttcggaaccggggtttacgggggtttaggggtttacccgggggtttaccggggtaacccgggggtaaacggggttaaacccgggtaaaaccccggtttaacccgggtacccgggttaacccccggttagggttaaccccggtaaaccccgggg

SEQ ID NO: 24465 - DNA, 738 bp, Homo sapiens
  misc_feature: GYAE6OF01BVMA7.21.22.B11.1.454.CMB.1.raw
  modified_base (56)..(56): a, c, t, g, unknown or other
  misc_feature (56)..(56): n is a, c, g, or t
  modified_base (173)..(173): a, c, t, g, unknown or other
  misc_feature (173)..(173): n is a, c, g, or t
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (441)..(441): a, c, t, g, unknown or other
  misc_feature (441)..(441): n is a, c, g, or t
tcagtcgtcgctcgcacgaccggtgctcgatttagacgacagctcagggggggaanctcagcttcagctgtggtagagaagacaggactcaggacaatctccagcattggccggcttccctctcctcctccaccctcctcactcactgcgctagggtcctgggcccagtctgngctgactcacgccaccctnagcgtcgcggggccccggnaggtaggtccactntcttcgttgtcgnggagaccaactccaagatcggtaagttattatgtattcgtggtactcagacaaccttccgaaggtaactccggacccctaaacttccacgacaaccgaggaacgtaaattaacgcaacggccgtcccgtacggacggggtttaccccaggacccgttagttcccgtagtccggaccttacgtaagtcgttaccggcctaaccnccgacgtccccttaccgcgtaccagtaccgaggttcggcccgtacccgggtaccgagggtacgtacggaggtaccgttacggtaactttacgttaacgtccgttaaggccctaaccgttaaccgggaaccggttaccggaaccgttaacggaccggttaagggccttaaacggaacgttaccggtcgttaacgggggcgtttaggggttaccggggttacgggttaccgggaaccgggttaacccgggaaaccctacgggttaccggttaccccgtaaggttcccggtaaaccccgg

SEQ ID NO: 24466 - DNA, 875 bp, Homo sapiens
  misc_feature: GYAE6OF01C9ZJV.21.22.B11.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagacgacagctcgaggggggggaagctcagctttcagctgtggtagagaagacaggactcaggacaatctccagcatggccggcttccctctcctcctccaccctcctcactcactgcgcgagggtcctgggaccctagtctgtcgactgactcacgcccaccctcgagcgtccgtcggggacccccggnaggacggtccacgtactcttcgtttgttaccgtaggacgtaccaacctaccgaacgagttaccggtaaagttaacgtttatcgtttacttcgttacggtacttccaacggtaacctaacccgtccccgtaaaggtaaccgttacccgggaaacccccctaaaactttccccgaactaaccgtaacccgaaaggtaaaccggttaaaactttaaaccgtccggtaaccggtccccgggtacccgtttaccggtaacgggggtttcccccctaggttaaccccgttagtttcccgttaccggtacgggttaccctaacccggttaagtcccgttacggaaccctaacccgttcgaccgttaccccgtcccgtacgtaaccgtcgtacggtacgttacccgggtccttaccggggtaccgaggaccgttgtaacccgggtcttaacgttacgtttaacgttaccggttgtaccgactaaccgttaccgggaccgggtaacttccggaacgttaaggcggttaacgtaaacgtaccgttacgttggtaaccggggtccggggttggggtttaaacggggttcggttaacccggggaaggttacccgggaaaaccttacggtaccgtaaccccgggttggttaaccccgtaccgggg

SEQ ID NO: 24467 - DNA, 660 bp, Homo sapiens
  misc_feature: GYAE6OF01CL675.21.22.B11.1.454.CMB.1.raw
  modified_base (325)..(325): a, c, t, g, unknown or other
  misc_feature (325)..(325): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggcagacggggtccaccgatctctttcgtcgtggaggccaactccaactagtacggaagttaattagtgtattctggtatcacgcaactccaggactaccggccccaactcctacnctccgaagagaataatcagccgcctacgaccgggtcctacgaccgtattctcgtggtcctacgtaacgtcgacggcctacctcacgtccctcccgtacgaccctagtcgaggtcggtccgtccggtacggagtacgtcggacgtctacgtaaccttattacgtcgtataccaacggttaccgaaccgggggtactaaccgaacgttaaggtcggtaactaccggaataacgtcgttaacggggacgtttgggggttcgggttaacgggtccgggggtaacggtaaccggtaaccgtaaaacggtgttaaccccggtcggttaaaccgggtacccg

SEQ ID NO: 24468 - DNA, 721 bp, Homo sapiens
  misc_feature: GYAE6OF01A88AR.21.22.B11.1.454.CMB.1.raw
  modified_base (217)..(217): a, c, t, g, unknown or other
  misc_feature (217)..(217): n is a, c, g, or t
  modified_base (264)..(264): a, c, t, g, unknown or other
  misc_feature (264)..(264): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctccctcctccaccctcctcactcactgcgcacgggtcctcgggcccagtctgtcgctgactcacgcccaccctcagcgtcgtcggggaccccggnacggagggtccaccattctcgttgtcgtaggacgacaacctaccaanacgtacggaaagttaattatgttaacttcgtcggtatcagtactaacctaccgaaggtactccgacccctaacgtccacactacgaacgtaagtaatactccgacggtccgccgtacggtaccgggtccctagtaccgtattccgtcgtacgtcctacgtaacgtcgtacggacctaccgttcaccgtcctacccgtacacgtctaccggtaggtccggtacgtcccggtacggagtaacgtcgtacggtactacgtaactcttacgtcgcgtactaacggccggtaaaccggtcgaaccgtaacgtaacggtacggtaaaccgttagaacccgtaaagttccgggaacggtacgggggtttcgggttaggggtttaaccggaccgggggttaaccggaaacggtaaccccgttaacggtacccgggttacccgttaccgggttaacgaaccccggg

SEQ ID NO: 24469 - DNA, 838 bp, Homo sapiens
  misc_feature: GYAE6OF01BZFA6.21.22.B11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagacgacagctcaggggggggaagctcagcttcagctgtggtagagaagacaggactcaggacaatcctccagcatggccggcttccctctcctcctcaccctcctcactcactcgcgcacgggtccgtcgggcccagtctgtgctcgacctcacgcccaccctcacgcgtcgtccggggaccccggnaggacgggtccacctattcttcgttcgttcgtggacgaccaacctccaacagtacggaagttaacttagtcttattcgtggtactacgaccgtaccaacctcccgaaggtaaccgtaccccgtaaccccctaaactccctacgactaccgaaggtaaacgtaaactacgtacgaccggacccggacccgttacgggaccgggttcccgtacgtaaccgttacctttccgtaccggttacgtaccgttacccgtaaacggtttcccgtaccgggtacccctaacccgttcccgtaccgttcccccgtttacccgacgaacccgttaccggttaaccggtacgggggttaccccgggttacccggtacccggggtacgggtacgggtacggtacggttaacgggtccgttaacgttaaccttttaacgtttcgacggttaaccgccgtaacgggtaacccggacggtaaacccgagttaaccggaggtaacgggtcttaaacggaaccttagggtaacggtcggggtttacgggttagggggtttcgggccgggttaccggggacccggtaaacggtaaccgtacggtaacccggtcggttacccgtacggggtacccg

SEQ ID NO: 24470 - DNA, 432 bp, Homo sapiens
  misc_feature: GYAE6OF01D1883.21.22.B11.1.454.CMB.1.raw
  modified_base (409)..(432): a, c, t, g, unknown or other
  misc_feature (409)..(432): n is a, c, g, or t
tcagtcgtcgctcgcacgaccggtgctcgatttagacgacagctcgaggggtccctgaccgattctctggctccaagtctggcacctcacgcctccctgaccatcaggtgggcctcccggtccgaggatggaggctgacttattactgtgcatcgaacgggacgacaacgagtgggatgaactaagttcgtggagggtcggggtttggggttcggttccgggacggggaacgggaaccctaaacgtccggtacccgttaccggtacggtaccgaccgaccccgaaggcccttcccggccccccgttcggtcctaccttccgttcccgttccccgtcccttccctccgttccgttctcctacgtcggacgggtccgggtacgtcggaccgaacgggcccgtactataggnnnnnnnnnnnnnnnnnnnnnnnn

SEQ ID NO: 24471 - DNA, 569 bp, Homo sapiens
  misc_feature: GYAE6OF01E3QHH.21.22.B11.1.454.CMB.1.raw
  modified_base (210)..(210): a, c, t, g, unknown or other
  misc_feature (210)..(210): n is a, c, g, or t
  modified_base (394)..(394): a, c, t, g, unknown or other
  misc_feature (394)..(394): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgttctggaggcaactccaacatcggaagtaattatgtattctggtatcagcaactcccaggaatcggcccccaaactcctcatccagaggaataatcagccggccctcgagggggtcccctgaccgtattcctctcggctccaagtctggcacctcacgccctccncgaccatcaggtcggctccggcgagatgcgctagacttattacgtgtcgcaactcgacgggaccacaacgagtagggactgactaagtcgtaggtcggtcgggttgggtcggttccggggaccgggtaacggggtaaccctaaacggtcggtaaccccgttccgtacggtacccg

SEQ ID NO: 24472 - DNA, 743 bp, Homo sapiens
  misc_feature: GYAE6OF01EKUZO.21.22.B11.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (358)..(358): a, c, t, g, unknown or other
  misc_feature (358)..(358): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcactccaanatcggaagtattatgtattctggtatcagcaactccaggaatcggacccccaaactccctacactaccgagaaggtaaataactcgacgccgggccctcgacgggggttcccnggacccgtattcctcgtcggccttacccgaagttcctcgggcctacccgtcgacgtcccctcccgttacgaccctacgttccgaggttccggggtaccgtcccgggttaccggaacgggtagttcgggaacgggtccgtacggttaaccgtttacgtttaaccgttgggttacgacctaacggttacccggaaccgggggtaacccgtaaccgaaacttagggtacggggtaactacgggaaacttacgtaccggttgggtaacggggttccgggggttttagggggtccgggttttacccgggggaaccggggggtaaccgggggttaaaccccaaaccggtttcgggggtaaacccccgtttccgggttacggggtaacccgg

SEQ ID NO: 24473 - DNA, 869 bp, Homo sapiens
  misc_feature: GYAE6OF01D3WJW.21.22.B11.1.454.CMB.1.raw
  modified_base (219)..(219): a, c, t, g, unknown or other
  misc_feature (219)..(219): n is a, c, g, or t
  modified_base (265)..(265): a, c, t, g, unknown or other
  misc_feature (265)..(265): n is a, c, g, or t
  modified_base (364)..(364): a, c, t, g, unknown or other
  misc_feature (364)..(364): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgacgggtcctcgggcccagtcctgtgctgactcacgcccaccctgacgccgtcggcccgggaccccggnaggcggtccactatcttcgttcgtacgtaggacgacaacgtccaanacgttacggtaattaacttagttgttacttcgtaggttactacgacgacctaaccgtacccggaaggtacgtaccccggaacccctaaacgttccctanaacccgtacgaaggaaacgtaacttaaccgcgaaccggtccccggtaccgtacgggtacccggggttccctaccgaccggtttacttccgtacgtccgtacctacgtaacgtcgtaccggacctaacccgtctaacccgttcccgacccgttaagaaccctagttccgggttaacgggggttacccccggccgggttaacccggggtaacgggaacggtacgttaacggggtaccggttaccgttaacgttaaaccgtttttaacgttccggtaagggtaccctacgttaaacccgggaccgggtaaaccccgggacgtaacgtaacgttagggtaccgggtaataaccggtaacctacggtttcggggaaacggttccgggggttttagggggttaccgggtccgggggttaaccccgggaagggtttaaaaccccgggaaaacccccgtttacccgggttaccgggtttaacccccggttaccggtaacccgggtaacccggg

SEQ ID NO: 24474 - DNA, 685 bp, Homo sapiens
  misc_feature: GYAE6OF01ETLNV.21.22.B11.1.454.CMB.1.raw
  modified_base (218)..(218): a, c, t, g, unknown or other
  misc_feature (218)..(218): n is a, c, g, or t
  modified_base (265)..(265): a, c, t, g, unknown or other
  misc_feature (265)..(265): n is a, c, g, or t
  modified_base (498)..(498): a, c, t, g, unknown or other
  misc_feature (498)..(498): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcgagcgtccgtacggggaccccccggnaggtacggtcacccattcgtctttgttcgtggacggcaactccaaanacgtacggaagtaattatgtattctggtatcgagcaacgtccaggtaatccggaccccctaactcctcagtaccagaacgaaataagtcacggaccggccctcgaacggggtccctacgacgtacttctcgtcgtactccgaagttcgtggaccacctcacgtacctcctcgacctaatccgtaagggtcggtaccgtccgggtacggaagtacgtagggaccgtcgtaacgntttaacttacgtagtcgacgtagtaccggacgggtaccgaccaaagtacggtgggaatacggtaactaaacgtcgtacggtaaccgggggttggttacgggggttcttacggggggtaaccccgggaaacggtaaaccccttaaaacggttaccccggaacggggtttccggtaaacgggaaccccg

SEQ ID NO: 24475 - DNA, 792 bp, Homo sapiens
  misc_feature: GYAE6OF01BIQHC.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcgagggtccgtcgggcccagtctgtgctgactcacgccaccctcagcgtcgtcgggaccccggnagagggtcacctatctcttgttcgtggagacaactccaactagtacggtaaagttaattagtagttaattcgtaggtactcagcctaactcccgaagtaacgtccggaccccctaaacttcctacacgtaccgaaggaacgtaataacgtcgaacggccggtaccctacggaccggggttccctaggtaccgtattccgtcgtacggtacctacctaacggttccgtacggaccctaacccgtcgaccggtccccttaccgacgtaaccctacgttacggacgggttcccgggtaccgtccgggtaccggaggtacgtggaccggtcttacggtaactttacgttacgtcgtacgtaccgtaaccggttaaccgggaacgggtacccaacgtaaacgtacgggttacgggaaactaacggtaaccctaaggttaccgggttaggggtaaccgggttcccggggggtttttaaggggtcccgggtttaaccgggggaaacccggggttaaaaccgggtaaaccccttaaaacccggttcgggtttaaacccccggttccgggtaacgggtaaccccggg

SEQ ID NO: 24476 - DNA, 744 bp, Homo sapiens
  misc_feature: GYAE6OF01B3SLD.21.22.B11.1.454.CMB.1.raw
  modified_base (374)..(374): a, c, t, g, unknown or other
  misc_feature (374)..(374): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctctcaccctcctcactcactgcgacgtagggtcctcgggcccagtctgtcgctgactcacgtccacctcacgcgtcgtccgggaccccggaaggcggtcacctattctcgtttgtaccgtgggacgtcaacctaccaacgtagtacgggtaaattaatttagtacgtttacttcgtaggtaactcgaacgtccaaccgtaccgaacggactccgacccctaaatcctacataccgaagtagtaactaacncgtacgccgtccctaggaccggtctacgtaaccgtttccgtcgtcgacgtaccgtagtcctacgacctacctacggccctccgttcctaaccgtacctagtaccggtacggttcccggaccgttaccgggtaccgtaagggtacgtaccgggtacgtaccgttaacgtaccgttttaaccgcggttacgtaccgtacgtaacccggttaccggaacccgggttacaaccgtaaggtacgttacgggaacttacgtaaacgttcgttacgggtaacgggtccgggtttaaggggtcgggttaccggacggggtaaccggtaaacggtaaaccctacgggtaaccgttaccgtaccggtacggtaacccggg

SEQ ID NO: 24477 - DNA, 874 bp, Homo sapiens
  misc_feature: GYAE6OF01CD0PX.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtccgtcggggaccccccggnaggtacgggtccaacctatccttctttagttcctgggacggccaacctccaacatacggaaagttaattatgttattcgtaggtactcagccaacctcccgaaggtaactccggtaccccccaaaactccctactacgtaccaaggaaggtaaactaacgtccgaacggccccgggtaccctacgggtaccgggggttacccctacggtaacccgtacgttcccgtcgtcgggtaccttaacccgaacgttccggtaccggtccctaacccgttaccgtaacccggtccccgttaccccgttacggaaccccttaaacgtccgggtaacgggttcccgggtcccggttacccggggtaaccggtaggggtactagggaccggttacgtacgtaacctttacgtttaccgtggttaccgaccgttaacggttacccgggaaccggggtaaccgtaaccgtaaaccggttagggtacgggttaaccggttaacggtaaaccggttaacgtaccgggttacggggaaccggggtttcgggggtttttaacgggggttcgggttaccccggggggtaacgggggttaaacccggtaaaccccgggttaaaccggttaacccgggttaaccccggggttaaccggtttaaaccgggggtaccccg

SEQ ID NO: 24478 - DNA, 714 bp, Homo sapiens
  misc_feature: GYAE6OF01BC4VA.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagagggtcaccatctcttgttctggagcaactccaacatacggaagtaattatgtattctgtatcagacactcccgaggtaactccggaccccctaaactcctacactaccaggaagtaactaatcgagccggtccctacggaccggggtcccaggaccgtattcctcgtcggcctaccgtaagttccgtacggccctaccctccgacgtcccctcccgtacgaccctatcgtacgggtcgggtcccgttcccgggtaccggaagggtacgtcgggtaacggtaccgttaggtaacctttacgtttaccgtggttacgaccgtagtacccgggaaccggggtaccaccgtaaacggtaggtagggtaacttacgaaacgttaacgttccgtagggccgggtttagggggtttcggggttacgggtttacccgggggaaccggggtaacgggtaacccgtaaaccggttccgggtaacccccggttccgtaaccggggtaacccg

SEQ ID NO: 24479 - DNA, 841 bp, Homo sapiens
  misc_feature: GYAE6OF01C9T11.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgacgggtcctcgggcccagtctgtcgctgactcacgccaccctcacgcgtcgtcgggaccccggnaggacgggtcacctattctcgttcgtcgtaggacggaccaacctaccaaacgtacgtacgggtaaagttaatttacgtagttaactttcgtagggttactacaacgtacctaaccgtaccggaaggtaacgtcccggaaccccctaaacctcctacctaactaccgaacgaaacggtaaactaactccgtaacggccccggtacccgtccggtaaccggggtccccgtacggaacccgtaacgtttccgtacgtcggtaccctacggttaacgtccggtacggaccctaccgtaccgtaacccggcccctttacccgaccggtacctacgtaccggtacgggttccccgggacggttccccggggtacggtaaggtacgtacgggacgtcgtaacgttaaccctttaagttcgttacgggtctacgttaaccggaccgggtaaccgggacctaaacgtacggtaacgggttacggaaacgttacgaaaccgttacggttaccggttacggggtacggggtttaaccggggttcgggggtttacgggttaccgggggaaaaccggtaacccggggtaaaacctacgggtacccgggttaaccggtaacggttaaccgggtaccccgg

SEQ ID NO: 24480 - DNA, 668 bp, Homo sapiens
  misc_feature: GYAE6OF01A7QBF.21.22.B11.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaacntcggaagtattatgtattctggtatcagcaactcccaggtactcggacccccaaactcctacgatccagaggaataatcagcggccctgacggggtccctagacccgattctctggcctccaagtcctaggccctaccgtccgacgtcccctccctggaccctagtccgaggtacgggcctaccggggttccgaagggactacgggaaggccgtagtaaccttaagttaccgtggtcgacctaagttccggaaacccgggggttaccacccgtaaacgacgttacggggaactacggtaaccctaaaacgttcgttaaccggggaggttacccgggggtttcggggtcggtttaccgggggaccgggttaacgggaacccgaaaacgttccgggaacccgttacccggtaacgggttaacccg

SEQ ID NO: 24481 - DNA, 845 bp, Homo sapiens
  misc_feature: GYAE6OF01CZ31A.21.22.B11.1.454.CMB.1.raw
  modified_base (240)..(240): a, c, t, g, unknown or other
  misc_feature (240)..(240): n is a, c, g, or t
  modified_base (647)..(647): a, c, t, g, unknown or other
  misc_feature (647)..(647): n is a, c, g, or t
  modified_base (691)..(691): a, c, t, g, unknown or other
  misc_feature (691)..(691): n is a, c, g, or t
tcagtcgtcgctcgcacgaccggtgctcgatttagacgacagctcgaggggggggaagctcagcttcagctgtggtagagaagacaggactcaggacaatctccagcagtggccggtccttccctctcctcctccaccctcctcactcactgcgcgacgggtccgtcgggccctagtctgtgctcgacctacgaccgcccaccctcgacggtccggtccggtacccggggacccccgggngacggacgggttaccacctacttccgttctttcggttcgtacgggacggacctaacctaccaacgtagtaacggtaaagtttaattacgttagttacttcgtaggttacacgacgtacctaaccgtaccggtaacggtaaccgtcccgtaaacccctaccgttcctacgaccgtaaccgaaggaacggtaaacttacgaccggtaccgggcccggtacccggttacgggtacccggggttaccctacgggtaaccctttacggttccgtttccggtacgttaccccgtaccgtaacggttccggtaccggtacccttacccgtaccgtacccgtccccctttaacgaccggtaaaccttggtacccgtacggggtccccgggttcccgtaacccgggtagtaacggngttaccggaaggtcccttaggtaacttttaccgtgtcgggtacnccgggtaacggtacccgggaacgggtaccacgaagttacgggttagggaacctaagtacctggttacgggtacgggttcggggttcggttaggggttaccggacggggaaaccgacggttaccctaagccccgggtaacttcgggtacgaccgg

SEQ ID NO: 24482 - DNA, 770 bp, Homo sapiens
  misc_feature: GYAE6OF01A83F9.21.22.B11.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (272)..(272): a, c, t, g, unknown or other
  misc_feature (272)..(272): n is a, c, g, or t
tcagtcgtcgctcgcacgaccggtgctcgatttagacgacagctcaggggggggaagctcagcttcagctgtggtagagaagacaggactcaggacaatctccagcatggccgcttccctctcctcctcaccctcctcactcactgcgcagggtcctgggcccagtctgtgctgactcacgccaccctcagcgtctcggggaccccggnaggaggtcaccatctcttgtctggcgcactccaanatcggaagtaattatgttattctggtancagccaacctaccgaggaacgtccggacccccctaaaacgtccctacacttacccgaggaacggtaaactaactccgacgcccgggtaccctacggaacggggtccctacggaccgtactttccgacgtcggtaccctaccgaacgtttccggtacggtacctacctccgaaccgtcccgtacccgtacgtaacccgtacgtacgtaacgggttcccgggtaccgtacccgggttacgggaacgggtacgtacggtaccgggttacgtacgggttaacctttaacgttttacgtacggttacgaaccgtaccgttaccggaccggggtaaccaccggtaacgtacggtacgggtagtaaaccgtataaaccgttcggtacgggtaacgggttccggggtttaggggttacccgggttcgggggtaacgggtaaacccgggttaacccgttaaaacggttccgggttaaccccttacccggggttaagggacccccggg

SEQ ID NO: 24483 - DNA, 788 bp, Homo sapiens
  misc_feature: GYAE6OF01DAWPP.21.22.B11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgcgcacgggtcctcgggcccagtctgtgctgactcacgccaccctcgacgcggtcgtccggggacccccgggnaaggacgggtaccaccgtactcttcgtttcggttcgtacgggacggaccaacctaccaactagtacggtaaagttaattagttattacttcgttaggtactcacgtacctaaccgtaccgaaggtaaccgttccggaacccctaaactcctacactacgagaagtaatacgtcgacgccggtcctaggcggtaccctacgaccgttacttccgtacggtcgtacctaccgtaacggttccgtacggacctacccgtacgacccgttccccgtacccgtacgaacccgtaacgtaccggtacggggttccgggttccccggtaaccggggtacggaacgggtacgtacggtaacggtaccttaacggttacctttaacggtacgtcggttacgaaccgtacggtacccgggtaacgggacctaaacggtaaccgtagggtacggtaacgtaaccgtaacgtacgttacgggtacgggttacggggttcggggttacggggtccggttaacggggaccggaaacggtaacccgttacggaccggttacccgtcgtaacgggtaccccgg

SEQ ID NO: 24484 - DNA, 838 bp, Homo sapiens
  misc_feature: GYAE6OF01DPFDS.21.22.B11.1.454.CMB.1.raw
  modified_base (189)..(189): a, c, t, g, unknown or other
  misc_feature (189)..(189): n is a, c, g, or t
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctnagcgtccgtcgggaccccggnagacggtcacctatctcttgtcgtggacgacaactccaacagtacggaagttaattgtgttattcgtggtatcacgactaacctcccgaaggtaactcccggaaccccctaaacgttcctaccgactacccgaagggtaacggtaaaacttaacgtccgaacggccccggtaccccgttacggaccggggggttcccctacggaacccgttagttcccgttacggtaccggtccctaaccgtaacggttccgtaccgggtaccctaacccgttcgaacccgttccccgttaacccccgttacgaaccccgttaacgtaccggtaaccggggttccgggtacccggttacccggggtaccgggtacggtacggtacgggaacgggtaccgttacgttaaccgtttaagtttaccggttaggtacgaccgtacgtaccgggaacccgggtacgtaacccgtaaagttacgggtacgggtaacttacggaaccgttaacgttacggtacgggtaacgggtttcggggtttacgggggttcccgggttaacggggtaaccggggttaaacccggtaacccggttaaaccggttcccgggttaacccggtcccgggttaaacgggtaccccgg

SEQ ID NO: 24485 - DNA, 856 bp, Homo sapiens
  misc_feature: GYAE6OF01DZBQF.21.22.B11.1.454.CMB.1.raw
  modified_base (58)..(58): a, c, t, g, unknown or other
  misc_feature (58)..(58): n is a, c, g, or t
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (757)..(757): a, c, t, g, unknown or other
  misc_feature (757)..(757): n is a, c, g, or t
tcagtcgtcgctcgcacgaccggtgctcgatttagacgacagctcgaggggggggaanctcagcttcagctgtggtagagaagacaggactcaggacaatctccagcagtggccgtctttccctctccctcctccaccctcctcactcacgtgccgcgacgggtccgtcgggaccctagtcttgtcgctacggacctcaccgcccaccctgcgcggttaccggccgggggaccccgngaaggaccggtaccacctnttccttcgtttcgttacggagggaacgtaccaaaccgttcaaaacgtacgtacggtaaagtttaacttagttacggtttattaccggttgtaacgttcgacgtacctaaacccgtaccggtaacgtaaccgtaccccggtaaccccccttaaaaacccttcccgttaaacctacccgtaaccgttaaacgggaacgttaaaacgtaacgttaccgaacccggtacccgggtcccgttaccgggtacccggggttacccgaaccggttaccgttacgtttccgtcggttacgtcccgtaaccgttaacggtcccgtacggtaaccctacccgtaccgtaccctacccgtccccgtaccgaaccgttaccgtacggttaccgggtccgggtcccgtaccgggtacggacggtgtacggtacgtaacgtacgttaacgttcgttacgtggtaccacgtaccgtaccggaccggtacgtaagaacgtacggtcgaacgtacgaanacggttcgacgggttacggttcgggttagggttaccgggacgggacgggtaaaccggtaccgtaacgtaccgggttaacgtacccggtgtaaccccggg

SEQ ID NO: 24486 - DNA, 799 bp, Homo sapiens
  misc_feature: GYAE6OF01DUF9H.21.22.B11.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
tcagtcgtcgctcgcacgaccggtgctcgatttagacgacagctcgaggggggggaagctcagcttcagctgtggtagagaagacaggactcaggacaatcctccagcatcggccggcttccctctcctctccaccctcctcactcactgcgcgagggtcctcgggcccagtctgtgctgactcacgccaccctnacgcgtccgtccggggacccccgggngacggtacgggtccaacccngttccgttcgtttcggtttcgtgggacggacctaaaccgtaccaacacgttacgggtaaagttaagtttaacgttggttactttcgttagggttactcacgacctaaccgcccgtaaggtaactacccggtaacccccaaacttccctacaccgtaccgtaaggaacgggtaaacttaacgtcgacggcccggtcccgtaccggtaccggggttccctacgtaccgttacttccgtcgtcggtacttaccgtaacgtcggtacgtaccgaccttcgaccgtcctcccgtacgacctacgttcgtacgggttccggtaccggttccggtcggtaacgtacgtcggtaacgtccgtaacgtactttacgtttaccgtgttacgtaccgaacgttaccgggaacggacgtacccaaaggtggtaaccggtagttaaacggtacctaacggttcggtacgggtacgggtttacggggttcggggttaccgggttacggggaacgggtaacgggtaacccgtaaccgggttaccggttacccggttccggtaggtaccccggg

SEQ ID NO: 24487 - DNA, 746 bp, Homo sapiens
  misc_feature: GYAE6OF01CFS91.21.22.B11.1.454.CMB.1.raw
  modified_base (189)..(189): a, c, t, g, unknown or other
  misc_feature (189)..(189): n is a, c, g, or t
  modified_base (210)..(210): a, c, t, g, unknown or other
  misc_feature (210)..(210): n is a, c, g, or t
  modified_base (450)..(450): a, c, t, g, unknown or other
  misc_feature (450)..(450): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccacctnacgcgtcgtcgggaccccggnagaggtcacatctcgttgttcgtggacggacaacctaccaaacagtacggaaagttaattatagttacttgtggtatacagtaccaaccgtccaaggtaactccgaaccccctaactcctacactacagaacgaatacgcacgcgccctaggcggggtaccctaggtaccgtattccgtcgtacggacctaccgtaagttccgtccggaacctccctacgacccgtccctaccccgttanaacccgtacgtaccggtaagggttcccgggtaacccgttcccggggtaaccggtaagggtacgtttccggggaaccggttacccgttaaggttaaccttaaccggttttacgtgggttaaccgaccgttacgggtaacccgacgggggtaaaccctaccgaaacgttacgggagggtaacttaagggaaccctaaggtttcggacgggtaggttcccggggtttaggggttcggttaccgggaaccgggtaacgggaaaccctacggttacgtaacccggtcggtaacggtaccgg

SEQ ID NO: 24488 - DNA, 1073 bp, Homo sapiens
  misc_feature: GYAE6OF01B8LOZ.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcacgcgtcgtcggggacccccggnagacgggtcaccatctcttgttcgtggacggacaacctcaacagtacggaagtaattatagtattcgttggtactaccagacctaacctcccgaaggtaactcccggacccccctaaacttccctacaacttacccgaaaggaacggtaaaacttaacgtaccgaaccggcccggtaccccgtaccggtaaccgggggttccccgtagtaaaccccggttactttacccgttcgtaccggggttaccctaacccggtaaacggttccgttacgggtaccctaacccgttaccgtaccgtacccccgttaccccgtaccggaacccgttaccgttacccgggtaaccggggtttacccggggtaaccccgggtttaccccggggttaacccggggtaaaccggttaacggggttacgggttaaccggggtacccgtttaaccggggtttaaacccgtttttaaaccgggttttaacccggttacgggtttaaccggttaacccggttaacccgggtttaaaccccggggtaaccggggttaaaccccccggtaacccgggtttaaaaacgggttaaaccgggggtttaacgggggttaaaccgttaaacccgggggttaaaaccgtaaacccggtttaccgggggttaaaccggggtttaacccggggggtttaccgggggggtttttaacccggggggttttaaccccggggggtttaccccggggggggtaaaacccgggggggtaaaacccggggttaaaaaccccccggtttaaaacggggggttaacccccccgggtttaacccccgggggtttaaaaccccggggtttaaccccggggttaaaacccccgggggg

SEQ ID NO: 24489 - DNA, 582 bp, Homo sapiens
  misc_feature: GYAE6OF01DS1NY.21.22.B11.1.454.CMB.1.raw
  modified_base (569)..(570): a, c, t, g, unknown or other
  misc_feature (569)..(570): n is a, c, g, or t
  modified_base (573)..(578): a, c, t, g, unknown or other
  misc_feature (573)..(578): n is a, c, g, or t
  modified_base (580)..(582): a, c, t, g, unknown or other
  misc_feature (580)..(582): n is a, c, g, or t
tcagtcgtcgctcgcacgaccggtgctcgatttagacgacagctcagggtcctgggcccagtctgtgctgactcagcccaccctcagcgtctgggacccccgggcagagggtcaccatctcttgttctggaggcaactccaacatcggaagtaattatgtattctggtatcagcaactcccaggaatcggcccccaaatcctcatccagaggaataatcagcggccctcgacgggtccctgacccgattcctctggcctccaagtctggccacctcacgccctccctgaccatcaggtcgggtcctccgggtaccgagggatggacggctgacttattactgtgctatcgacgggacgcaacgagtgggatagaactaatcgtagaggtcgggttggtcggttcgggacgggacgggaacctaacgtcgaccgtcgtacggtacgacgacccgaaggcctccgccccctcggtccacgttccgtcgttccccgtcccctccctccgttcccgtctaccgtctcggacggtccgggtccgcgggtaccgaaggtcccgacgtagtacgtnncgnnnnnncnnn

SEQ ID NO: 24490 - DNA, 751 bp, Homo sapiens
  misc_feature: GYAE6OF01C812N.21.22.B11.1.454.CMB.1.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (272)..(272): a, c, t, g, unknown or other
  misc_feature (272)..(272): n is a, c, g, or t
  modified_base (611)..(611): a, c, t, g, unknown or other
  misc_feature (611)..(611): n is a, c, g, or t
  modified_base (634)..(634): a, c, t, g, unknown or other
  misc_feature (634)..(634): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcacctcctcactcactgcgcgacgggtccgtcgggcccagtctgtgctgactcacgccaccctcagcgtcgtccgggaccccggnaggnggtcaccatctcttgtctggaggcaactcaacgtagtacggaaagttattagtnttatttcgtaggtactcgaacgtaccaaccgtcccgtaaggaaactcccggaaccccctaaactccctacactaccgaaggaacgtaaataacgtcgaccggtaccgtcccgtacggtaccgggggttacccctaggtaacccgttattccgttaccgtcggtacctaaccgtaacggtttccgcggtaccctacctaccgaccgtaccccgtccgtaccgtacctaacggttcgacgggtcgggtcccgttaccgggacggaggtacgtacgggtaacgtcgttaacgtaacgtttacgtacgttcggcgtaaccttaggaccgggtaacccgggaanaccgtaaacggtaggtaacgggntaaccgtaaacgtacgtacggttcgggacgggttggggtttaccggggtcgggttagggaaccgggtaacgggaaacccgttacggacgggtaaccccgttcgggtggaaaccccgg

SEQ ID NO: 24491 - DNA, 977 bp, Homo sapiens
  misc_feature: GYAE6OF01D2Y88.21.22.B11.1.454.CMB.1.raw
  modified_base (58)..(58): a, c, t, g, unknown or other
  misc_feature (58)..(58): n is a, c, g, or t
  modified_base (262)..(262): a, c, t, g, unknown or other
  misc_feature (262)..(262): n is a, c, g, or t
tcagtcgtcgctcgcacgaccggtgctcgatttagacgacagctcagggggggggaanctcagcttcagctgtggtagagaagacaggactcaggacaatctccagcatcggccgcttccctctcctctccaccctcctcactcacgtgcgcgtacgggtccgtcggggaccctagtcgttggtcgaccttacggaaccttccgacgtacccctacccgttcgacgggtcccgttaccggtcccgggggggaaccccccggngtaacgggtaacggggttccctaaaccgtactttccgtttcgtttacgggttttcggacgggggaaccggtacccctaaaccttacccgaaaacgtacggttaacgggtaaaggtttaactttagttacggtttaacttcggttagtacgtacgacggtaccaaccgtaccgaaacggtaaccgtacccggaacccctaacgttcctactaaccgtaccgaagtaaacggtaataaccgtcgtaaaccgggcccgtacccggtacgggtaccgggttacccgtacggtaacccgttcgtttaccgtccggttaccggtaccgttaccggtaaaccgggttccgaacccggtacccctacccgttaccgtaacccggttccccttaaccccggtacggtaaccctacgttaacgggtccgggttaccccgggtccggttaccccgggtacgggtaaacggtccggggtttacgggaaccgggtttaccgtaaccggtttaacgttaccggtttaaccggtttaccggaacggttacccgtaaccgggttcccggggaaaccggggttaccaaacggttaacggtacggtacggggtaacttaacggaaacgttccgggtagtaacggggtcgggtttaggggttccgggtacgggttacccggaacggggtaaccgaaccgttacggaccggttacccggttcgacggtaaccggg

SEQ ID NO: 24492 - DNA, 705 bp, Homo sapiens
  misc_feature: GYAE6OF01AUCIJ.21.22.B11.1.454.CMB.1.raw
  modified_base (224)..(224): a, c, t, g, unknown or other
  misc_feature (224)..(224): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (542)..(542): a, c, t, g, unknown or other
  misc_feature (542)..(542): n is a, c, g, or t
tcagtcgtcgctcgcacgaccggtgctcgatttagacgacagctcagggggggggaagctcagcttcagcctggtggtagagaagacagggactcaggacaatctccagcatggccggcttccctctcctcctccaccctcctcactcacctgccgcgacgggtccgtcgggcccagtctgtgctgactcacgcccacctcagccgtcgccggggacccccggnaggacggccacctacttctctttgtccgtgggacggacctaacnccgaaanacgtacggaaattaattatgttacttgtggtatcaagcctaactccgaagtaacgtccgaccccctaactcctactactaccgaaggaagtaaatactacgaccgccggtaccctaccggaccggggttaccctacgaccgttacgttccgtcgtaccggtcttaccgacgttccgtacgcctacctccgacctccctcctacaccatccgagggtccggtccggtcccggacggagtcgtaggcggtctaacgagttactttacgngtcgtacctaggaccggtacgggacgtacaaagtggggtagtactaacggacgtaccgttggtaccgggtgggttcccggggtttaggggttccgggtaccggggtacggaaaaccgggtaccgttaaacgggccgttaccccggttagtacggtaacccggg

SEQ ID NO: 24493 - DNA, 838 bp, Homo sapiens
  misc_feature: GYAE6OF01DKTR1.21.22.B11.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcgagggtcctcggcccagtctgtgctgactcacgccaccctcgacgtcgtcgtccggggacccccggntaggacgggtcacctattccttcgtttcggttcgtgggaacggaccaaacctccgaaactagtacggtaaagttaattagttgttattacgtagtactcagaccacctccgaaggacgtccgaccccaacctccgtacactacgagacgtaatactacgacgccgtaccgtacgtacggggtacttccgtacgtacccgtacgttcctacggtccgtacctaccgtaaacggttccgtacggtaccctacccgttaccgtaccccgttaccccgtaccccgttacccgacccgtacgttaccggttaccggggtaccgggtccccggtaacccgggttccggtaacggtacgtacgggtaccgtaacggttaccgttaacgttaacgtttcgttacggtaccgtaacgttaccggtaaccggggtaaccgggtaacccgtaacgtaaccggtagggtaacgggttaaccggtaacttaaacccggtaacgtttacgggttaccgggttacgggggttacggggtttccggggttaccggggtttaacccgggtacgggggtaaacccgtaaaccggttaacggggttaaccggtaacccgggtttaaccgggtaaacccggg

SEQ ID NO: 24494 - DNA, 603 bp, Homo sapiens
  misc_feature: GYAE6OF01E5MHI.21.22.B11.1.454.CMB.1.raw
  modified_base (582)..(582): a, c, t, g, unknown or other
  misc_feature (582)..(582): n is a, c, g, or t
  modified_base (587)..(587): a, c, t, g, unknown or other
  misc_feature (587)..(587): n is a, c, g, or t
  modified_base (596)..(597): a, c, t, g, unknown or other
  misc_feature (596)..(597): n is a, c, g, or t
  modified_base (599)..(603): a, c, t, g, unknown or other
  misc_feature (599)..(603): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcgccctcacggggtccctgaccgtattctctggctccaagtctggccacctcacgccctcctgaccatcaggtggcctccggtccggaggactggaggctaggactattacgtgtgctatcgaacgggaccgaacaaaagtgggatgaacaatcgtggagtcgggttgggtggttcgggacgggacgggaacccaacgtcgtacccgtccgtaaggtccgacggacccgaaggtccgtccgccccccgtcgggtcctaccgttccgttaccgttcccccgcccttcccgtcctccgttccttaccgtacgtggaccggccgggtccgtcgggaccgtaacgggccgtaccgtaagtacggntacgntcgatcganncnnnnn

SEQ ID NO: 24495 - DNA, 745 bp, Homo sapiens
  misc_feature: GYAE6OF01EI6VY.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnagagggtcaccatctcttgttctggagcaactccaacatcggaagtaattatgtattctggtatcagcaactcccaggaatcggacccctaactcctcactccaggaaggtaataatcacgccgcctcggacgggtccctagaccgtacttccgtactcggtcctaccaacgttctcggtacctaccgtcaccggtccccttaccgtacgaccctagtaccgacgggttcgggcccgttacccgggtaccggaagggtaacgttcgggtaacggtccgtacgggtaacctttaactttaaccggtcgggttacacccgtaacggttacccgggaacccggggggtaaccgtacccgtaaacggtacggttacggggaactaccggtaaactaaacggttccgtaaggggtaccggggtttcgggggttttacgggggttcgggtttacccgggggaaccgggggtaaacggggttaacccctaaaacccggttcgggttaacccccgggttaccggttaacggggtaaccccgg

SEQ ID NO: 24496 - DNA, 702 bp, Homo sapiens
  misc_feature: GYAE6OF01C0FZL.21.22.B11.1.454.CMB.1.raw
  modified_base (680)..(680): a, c, t, g, unknown or other
  misc_feature (680)..(680): n is a, c, g, or t
  modified_base (695)..(695): a, c, t, g, unknown or other
  misc_feature (695)..(695): n is a, c, g, or t
  modified_base (699)..(699): a, c, t, g, unknown or other
  misc_feature (699)..(699): n is a, c, g, or t
  modified_base (702)..(702): a, c, t, g, unknown or other
  misc_feature (702)..(702): n is a, c, g, or t
tcagtcgtcgctcgcacgaccggtgctcgatttagacgacagctcagggtcctgggcccagtctgtgctgactcagccaccctcagcgtcgtcgggaccccgggcaggagggtcaccatctcttgtctggaggcaactccaacatcggaagtaattatgtattcgtggtatcagcaactcccgaggaactccggtacccccaaactcctactactaccaaggaacggaaataatcaacggccggtccctacggacgggggtccctacgaccggtattccgtcgtcgggtcctaccgtaacggttccgtcggaccctaccgttacgacgtcccttcccgtagaccctactcgtacgggtccgggcccgtaccgggtccgaagtacgtaggacgtcgacgtaacgttagtagtcgtgacgtacgtcgaaccggtacaacgtaaagtggactaggaactagtcgtagtcgggttacggtggtacggtcggacggtacgtaaccgtacgtcgtaccgtacgtacgtcgacgtaccgacggtcccgtcgtccccggtagtaccgtacccgtcgttacccgtccccgtacccttcccgtacccgtcccgttacctaccgttaccgtaccggacgggtccgtaccggtggaccgtacggccgtaacgtacgtgtacgtccatccggnagtccgaatccgacncgtntgn

SEQ ID NO: 24497 - DNA, 1018 bp, Homo sapiens
  misc_feature: GYAE6OF01BWYF6.21.22.B11.1.454.CMB.1.raw
  modified_base (59)..(59): a, c, t, g, unknown or other
  misc_feature (59)..(59): n is a, c, g, or t
  modified_base (247)..(247): a, c, t, g, unknown or other
  misc_feature (247)..(247): n is a, c, g, or t
tcagtcgtcgctcgcacgaccggtgctcgatttagacgacagctcgagggggggggaanctcagcttcagctggtggtagagaagacaggactcgaggacaatcctaccagcatggcccggtccttccctctcctcctccaccctcctcactcactgcgcgacgggtccgtcgggcccagtctggtcgctcgacctcgaccgcccaccctacgacggtccggtccggtacccgggggaccccccggngacgggtacgggttacccaacctacttccgtttcggtttcgttacggacgggtaccggacctaaaccctacccgaaaacgtacggttaaacggtaaatttaacgttagtttacgttaacgtttccggttaaggttaacctacgtaaccgaaccttaaccccgtaacccggtaaacgggtaaccccgttacccccgggaaacccccccttaaaaccgttcccccgtaaccgtaaccgttaaacccggaaaacggggttaaaacgtaaaacctaaaccgggttacccggtaacccgggaccccgggtttaccccggttaacccgggtaccgggggtttaccccccgtaaacgggttacccttaacggtttcccggttacccggtaacggtacccttaacccggttaaccggttccggtaacccgggttaccctacccgttacccggtaaccccgggttccccgttaacccgtaccgtaaccccgttaacggtaccggttaccgggggtacccggttaccccgggtttccgggaaaccggtagggttacgggtaacggtacgggtaccgtttaacgtaaccgtttacgtttaacggttacgtacgaacgtaccggttaccgggaaccgggtacaacgtacgtaaggtagggactaaggactacggtacggtggttacggggttgggttcgggttaccgggaaccggggtaaccgggtaaccggtaaaccgttaaccgggtacccggttaccggtaacccggtcgtaaccccggg

SEQ ID NO: 24498 - DNA, 690 bp, Homo sapiens
  misc_feature: GYAE6OF01BYODW.21.22.B11.1.454.CMB.1.raw
  modified_base (215)..(215): a, c, t, g, unknown or other
  misc_feature (215)..(215): n is a, c, g, or t
  modified_base (684)..(685): a, c, t, g, unknown or other
  misc_feature (684)..(685): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcacgcgtccgtcggggacccccgggnaggacgggtccaccatctcttgttctggaggcaactccaacagtacggaagtaattatgtattcgtggtatcagccaactccaggactccggaccccaaactcctacactccgaaggaacgaataatcagcccggacctacggacggggtccctacggacccgtactttcctacgtcggacctacccgaaggttcctacgggacctaaccccgtcgtacccgtccccttacccgaccggtaacccacggttaccgaccggggtccgggtacccgttacccggggtaccgggagggtacgtacgggtacggtacctagggtaacctttacgtttacgtcgtacgactaaccgtaccggaaccggggtaccaaccgtaaacggtcggtacgggtactacggtaaaccgtaagttcggacggtacggggaccgggtcgtacgggaccgaaacgggtccgaacggtataaggnngtgag

SEQ ID NO: 24499 - DNA, 690 bp, Homo sapiens
  misc_feature: GYAE6OF01CSF6T.21.22.B11.1.454.CMB.1.raw
  modified_base (670)..(670): a, c, t, g, unknown or other
  misc_feature (670)..(670): n is a, c, g, or t
  modified_base (678)..(680): a, c, t, g, unknown or other
  misc_feature (678)..(680): n is a, c, g, or t
  modified_base (682)..(690): a, c, t, g, unknown or other
  misc_feature (682)..(690): n is a, c, g, or t
tcagtcgtcgctcgcacgaccggtgctcgatttagacgacagctcagggtcctgggcccagtctgtgctgactcagccaccctcagcgtctcgggaccccgggcaggagggtcaccatctcttgttctggaggcaactccaacatcggaagtaattatgtattctggtatcagcaactcccaaggaactcggacccccaaactcctcactccaagaaggaaataaagtcaacggccggccctacggacggggtccctgaccgtattctcgtcggctaccgaagtccgtcggacctaccgtcgacgcccttcccacgacctatccgaggtcgggcccgtccgggtccgaaggagtcggacggtctacggtaacttacgttaccgtggtcgacgtaacgtaccggacggggaaccacgaaacgtagggtagggaattacggaaactaacgttacggtagggtacggggtcggggtttacgggggttacgggttaccggggaaccggggtaacggaaccgtaaacggtccggtaaccggttacgtacggtacgaaccgaccgtaccgccgtccccgtccccgtacggtcctacgtcccttcccgtccctcccctcccttccttcgtcctacgtccgtaggacgtccgggacgtacggaccggtacgaccgganacgtgcgnnngnnnnnnnnn

SEQ ID NO: 24500 - DNA, 613 bp, Homo sapiens
  misc_feature: GYAE6OF01A6C99.21.22.B11.1.454.CMB.1.raw
  modified_base (210)..(210): a, c, t, g, unknown or other
  misc_feature (210)..(210): n is a, c, g, or t
  modified_base (388)..(388): a, c, t, g, unknown or other
  misc_feature (388)..(388): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattcgtggtatcagcaactccaggactcggaccccaactcctcactccaagaggaatatcagccggcctacgacggggtccctgaccgtattcctctcggtctcgaacgtctggccacctcacnccctccctgaccatcgaggtcggccgtccggtaccggaggctagggacgtctaggtaaccttagttactggtcgactaacggtccggaaccggggacgtacaacggagtacgggaatcgtaaactagttaccgtgggtaacgggttggggttgggttccgggtacgggaccggggaaacggtaacccgtaaaccggtcgtaacccggttacgtagggtaaccccg

SEQ ID NO: 24501 - DNA, 726 bp, Homo sapiens
  misc_feature: GYAE6OF01D56TT.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctgggcccagtctgtgctgactcagcccaccctcacgcgtcgtcggggacccccgggnaggagggtccacctatctcttgttcgtggacgcaactccaacagtacggaagttaattagtgttattcgtggtatcgagacctaacctcccgaaggaacgtccggaccccctaaactcctacactaccgaaggaaggtaactaacgtcacggtccggtcccgtacggaccggggttccctaggacccgtacttccgtcgtcggtcctaccgtaacgtccgtacgacctaccctccgtacgtcccctcccgtagaaccctagtccggtacggtccgggtccgtcccgggtacgaacggtcggtaggtaccggtacgttagtaccgtttaacgtttacgcggttacgtaacgtaccgtaccgggaaccgggtaacaaccgtaagtacgggtcgggtaactacggtaacctagttccggtagggtacgggtttcggggttacgggtcgggttaccggggacgggtaaccggtaaccgtaaaccgttggaaccccgttcggtaacgggtaacccg

SEQ ID NO: 24502 - DNA, 705 bp, Homo sapiens
  misc_feature: GYAE6OF01BS5C9.21.22.B11.1.454.CMB.1.raw
  modified_base (423)..(423): a, c, t, g, unknown or other
  misc_feature (423)..(423): n is a, c, g, or t
  modified_base (457)..(457): a, c, t, g, unknown or other
  misc_feature (457)..(457): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggcaggagggtccaccgatctcttgttcgtggaggcaactccaaacataccggaaattaattatggtaatttctagggttatcgagaccgaacctaccccgagggaactccgggaccccccctaaaacgttcccttacactaccggaagtaacgggtaaataacgtcaacggcccgggtacccttacggaacggggttcccctaacggaaccgtnttaccgtctagggcccttaccgaaacggttccgngggtaccctaccctccgtacgcccttaccctacgaacccacgttacgacggttcgggtccgttacccgggccgaggtacgtcggacggtcttacggaactttagttccgtgtacgactacgtacggaccggggacgccaaacgtggtacggtatacggactacgtcgtggtacggttgggttcggggttcgttaccggggaggtaaccgggaacgttaaccggaggttaacccgtgtaacccgggtac

SEQ ID NO: 24503 - DNA, 766 bp, Homo sapiens
  misc_feature: GYAE6OF01BCJBJ.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagtccgtcgtccggggacccccgggcgaggtacgggtccaccctattccttctttggttcgtgggacggacctaaacctaccgaaactacgtacggtaaagttaaatttagttggttaactttcgtaggtaacttcaacggacctaaaccctaccccgaaggtaacgtcccgggtaacccccctaaaaccgtccctactaccgtacaaacggtaaggtaaactaaacggttccgaacggtcccggaccccgtacggtaccgggggttacccacggtaccgtacttccgtacggtcgtaccgtacctaacgttccgcggtacctaccgtccgaccgtccctacccgtcgtaaccctagtccgtacgggtcgggtcccgttacccgggtacgaggtagtacgggacgtcttacggtaccttagttcccggtagtcggacctacgtaccggaccgggacaccgtaagtaggacggtatacggtaactacgtacggtaggtaccgggttggggttcgggttacggttccgggaacgggaccgtaaacctacggacccgtacccggtcggaccgtaccgg

SEQ ID NO: 24504 - DNA, 830 bp, Homo sapiens
  misc_feature: GYAE6OF01CIQT7.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgagggtcctcgggcccagtctgtgctgactcacgcccacctcagcgtcgtcggggacccccggnaggacggtccaccatcttcttgttcgtggacgcaacgtccaacagtacggaagttaattagtgttattcgtggtactcgagacctaacctccgaaggtaactcccggaacccccaaaccttccctactaacgtaccgaaggaacggtaaactaacgtacgaacggtcccggtaccccgtacggaccgggggttcccctacggtaacccgtacgtttccgtaccgtcgggtacccttaacccgtaacggttcccgtacgggacccctacccgttaccgtaccgtcccccttacccgtaaccgtaaccctacgttaccggtacggggttcccgggtacccgttaccccggggtaccggaacggtacgtacgggtacggtaccgttacgttaaccgtttaacgtttaccgttggttacgtaccgtaacgtacccgggaaccgggtaaccgtaaccgaacggttaagggtacgggtaacgtacgtaaccgttaacgttaccggtaggggttaccgggttacgggggtttggggttaccgggttacggggtaaccgggaaacgggtaaaccccgttaaaccggttccgggtaaccccggttaccgggtaccggtaacccgg

SEQ ID NO: 24505 - DNA, 369 bp, Homo sapiens
  misc_feature: GYAE6OF01B5I13.21.22.B11.1.454.CMB.1.raw
  modified_base (324)..(324): a, c, t, g, unknown or other
  misc_feature (324)..(324): n is a, c, g, or t
  modified_base (327)..(328): a, c, t, g, unknown or other
  misc_feature (327)..(328): n is a, c, g, or t
  modified_base (330)..(330): a, c, t, g, unknown or other
  misc_feature (330)..(330): n is a, c, g, or t
  modified_base (333)..(369): a, c, t, g, unknown or other
  misc_feature (333)..(369): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgaacaatctgagcgggttgggtgttcggcggaggaccaaacgtcgaccgtccgtaggtcagcccaaggcctcggcccccctcggtccaccgttctccgttccccgcctcctcctcggtctctaccgtgacgcgggactggcgtaaggcgaccaagtgntcnncnatnnnnnnnnnnnnnnnnnnnnnnnnnnnnnnnnnnnnn

SEQ ID NO: 24506 - DNA, 711 bp, Homo sapiens
  misc_feature: GYAE6OF01AHPZ7.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccacctcagcgtcgtcgggaccccggcgagacggtcacctatctcttgtcgtggacgaccaactccaacacgtacggaaattattatgttattcgtggtatcacgcaaccgtccaggtaactccggaccccctaactcctacatccgagagtaataatcgagtccgccgacggtccgggtacctacgtaccgtattccgtcgttacggacccttacggaacgttccgtacggaccctactaccgaccgtcccctccgtacgtaacctcgtaccgtacgggtaccggtcccgttccgggtaccggaaggtacgtacggtacggtcgtaaccgtaacgttccgtttaacgtcggtacgtacgtaaccgtaccggtaaccggggaactaacgaacgtaggtacgggtacgtaacgaccgtaaagttcggtacgggtacggtttacggggtttgggtaccgggttaccgggaacgggttaccgggtaaaccgttaccgttaaccgggaccctttccgggtaacggtaacccgg

SEQ ID NO: 24507 - DNA, 860 bp, Homo sapiens
  misc_feature: GYAE6OF01AJSQ6.21.22.B11.1.454.CMB.1.raw
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
tcagtcgtcgctcgcacgaccggtgctcgatttagacgacagctcgagggggggggaagctcagcttcagctgtggtagagaagacaggactcaggacaatctccagcatggccggcttccctctcctctccaccctcctcactcacgtgcgcgacgggtccgtcgggccctagtctgtcgcgtgactcgaccgtcccaccctcgacggtccggtccggtccggggaccccccgggnaacggacgggttaccaccgtnttccttcgtttggttccgtagggaccgtacctaacctaccgaaacgtaggtacggtaaactttaagtttacgttcgttactttcgttaggtaacttccgaacgtacctaacccgtaccgaaagggtaccgtacccggtaaccccctaaacgtcctaccgacgtaccgtaaaggaaacgtaactaaccgtcggaaccggtccccggtaaccgtcgggtaaccggggttcctaaccgtacgttctctaccggtcggtacctacgtaacggtcctacggacccttccaaccggtacccgtcccgtacctacgtaacctacgtaccggttcgggtacccggttacccggttaccggtacggaaaggtccgtacgggaccttaacgtacgtttacgttacggttactagggtccaaggtaaccggtccggaaccgggtaacctaagttacggtacgttagggtaacctaacgtcggtaacgttacggtacgggtttccggggttacgggttacggggttccggggtaacccggtaaccgggtaaaccggttaaccccggttaacgggtccccggtaaccggttaaccgggttaaccgggtaccccgg

SEQ ID NO: 24508 - DNA, 660 bp, Homo sapiens
  misc_feature: GYAE6OF01EK4IC.21.22.B11.1.454.CMB.1.raw
  modified_base (213)..(213): a, c, t, g, unknown or other
  misc_feature (213)..(213): n is a, c, g, or t
  modified_base (427)..(427): a, c, t, g, unknown or other
  misc_feature (427)..(427): n is a, c, g, or t
  modified_base (500)..(500): a, c, t, g, unknown or other
  misc_feature (500)..(500): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctccaccctcctcactcactgcgcgaggtcctgggcccagtctgtgcctgactcagcccaccctcagcgtcgtccggggaccccggnaggagggtccacctatctcttgttcgtggaggcaactccaacatcggaagtaattatgtattctggtatcagccaactccgaaggaactccggacccccaaactcctacactaccgagagaactatcacgccgcctcgacggggtccctagaccgtattctcgtcggcctacgtaacgtcgtacgcctacctcacgtccctcccgtacgaaccnctaccggtaggtccggtccgtcccgggtaccggaacggtagtacggacgggtctaggtaccttaagtttaccnggtacgtacctacgtaccggaccgggaacctacgaaaccggttggtacggtaattacgaaacgttagtccgttagggaacggtttcgggggttagggttccgggtacgggcgggaaacccgtaaccgtaaacgtaccggtaccgttccgaaggtacccgg

SEQ ID NO: 24509 - DNA, 310 bp, Homo sapiens
  misc_feature: GYAE6OF01ECVYD.21.22.B11.1.454.CMB.1.raw
  modified_base (156)..(156): a, c, t, g, unknown or other
  misc_feature (156)..(156): n is a, c, g, or t
  modified_base (302)..(310): a, c, t, g, unknown or other
  misc_feature (302)..(310): n is a, c, g, or t
tcagtcgtcgctcgcacgaccggtgctcgatttagacgacagctcaggggtccctgaccgattctctggctccaagtctggcacctcagcctccctgaccatcagtgggctcccggtccgaggatgaggctgactattactgtgcatcacgggacncaacatgggatgacaatctgagcggttgggtgttcgggcggagggaccaaactgaccgtcctaggtcagcccaaggctcgccccctcggtcactctcgtcccgccctcctcctcgtctctactgagcggctggcaaggcgcatagnnnnnnnnn

SEQ ID NO: 24510 - DNA, 779 bp, Homo sapiens
  misc_feature: GYAE6OF01D3XKF.21.22.B11.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagacgacagctcgagggggggggaagctcagcttcagctgtggtagagaagacaggactcaggacaatctccagcatggccggcttccctctcctcctccaccctcctcactcactgcgcagggtcctgggcccagtctgtgctagactcagcccaccctcagtccgtcgtccggggacccccggntaaggagggtccaaccctatccttctttgttccgaggaggccaactaccaacgatacgggtaataaattacttagttattacctggtactacgaacgcctaaacctcccgtaaggaacgtcccggaccccctaaaaccttccctactaactccaacggagtaaacttaacacgacggccgtacccacggaacgggtcccgtagaacgtacttccgtcgtcggtaacctaccgaaacgttccggtacggtacctaacccgtcccgtaaccggtcccccttaccccgtaaccggtaccctaacgtaccggtaacgggttcccggggtacccgtaacccggggttaccggaacgggtaacgtttaccgggaacggtccggtattaaaccggttaattacgttacggttgaaccttacggaacggaaccgggtacgaaccgaaacgttaggacgggtacaacggtaactacgtgtacgggtaaggttacggggttcgggttacggggttacgggaccgggtaaacggtaccctaaaacgtccggtaaccgtccgtacggtaccg

SEQ ID NO: 24511 - DNA, 788 bp, Homo sapiens
  misc_feature: GYAE6OF01CZISH.21.22.B11.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctgggccctagtctgtgctgactcacgcccaccctcagccgtcgtaccggggacccccgggnaggacgggtcacctatccttcttgttcgtaggtacggcctaaactccaaacagtacggtaaagttaacttagtagttattccgttaggtactcgacgtacctaacctccgaaggaacgtcccggaaccccaacttcctacactaccgaaggtaacgtaaacttaacgccgaacggtccggaccctacggtaaccggggttcccctaacggtaccgttacgtttccgttacggtcggtccctaacgtaacggttccgtacggaccctacccgttacgaccgtccccgttaccgttaacgaccttaacgtcggaacgggttcccgggtaccttaccggggtaccgaagggttactaccggggtaacgttctaaccgttaacgtttaacttacccggtgtaccgaacgtaccggtaccggaaccggggtacgtaccaacgggtgttacgggaacttaacgaagtacccgttgggtacgggtacgggttcgggggttaggtttcccgggacgggtaaacggtacccgggtaaaaccctaacgttcgggtaccccggttagttcgggaaacccg

SEQ ID NO: 24512 - DNA, 882 bp, Homo sapiens
  misc_feature: GYAE6OF01EUOS7.21.22.B11.1.454.CMB.1.raw
tcagtcgtcgctcgcacgaccggtgctcgatttagacgacagctcgaggggggggaagctcagcttcagctgtggtagagaagacaggactcagacaatctccagcatggccggcttccctctcctcctcaccctcctcactcactgcgcgacgggtccgtcgggcccagtctggtcgtctgacctcacgcccaccctcgacggtcgtccggtccggggaccccggcaggacggtacacctattcttcgttgtcgtggagacctaacctaccaactacgtacggtaaagttaacttagttagttacgttacgtaggttactacgacgtaaccctaacccgtacccgtaacgggtaaccgtaccccggtaaaccccccctaaaccttaccccgtactaaccgtaccggaaggtaaaggtaaaccttaacgtacggacccggtacccgggtcccgttaccgggtaccggggttaccccgtacggtaccgttactttccgtacgtaccggtaccctaccgtaacgttccgaccgacccgtaccctacgtacccggtcccttacccgtaccgtaaccctacgttaccgggtacggggtcccggtcccggttaacccgggtaccgggtaacgtagggtccgggtacggtacgtcgttaaccgtttagtttaccggtacgtcggtaccggtacgtaacccggggtaacgggtaacccgtaacgtaaaccgggtggttaaccggtagtaaccgttaacgtaccgttagggtaacgggttcgggggttagggggtttccggggttaccggggttaccggggaacccgggtaaaccggtaaaccgttaacccgggtccggtttacccggttacgtaacgggtaaccccggg

SEQ ID NO: 24513 - DNA, 691 bp, Homo sapiens
  misc_feature: GYAE6OF01C1VP1.21.22.B11.1.454.CMB.1.raw
  modified_base (217)..(217): a, c, t, g, unknown or other
  misc_feature (217)..(217): n is a, c, g, or t
  modified_base (675)..(675): a, c, t, g, unknown or other
  misc_feature (675)..(675): n is a, c, g, or t
  modified_base (679)..(679): a, c, t, g, unknown or other
  misc_feature (679)..(679): n is a, c, g, or t
  modified_base (681)..(682): a, c, t, g, unknown or other
  misc_feature (681)..(682): n is a, c, g, or t
  modified_base (684)..(691): a, c, t, g, unknown or other
  misc_feature (684)..(691): n is a, c, g, or t
tcagtcgtcgctcgcacgaccggtgctcgatttagacgacagctcagggtcctgggcccagtctgtgctgactcagccaccctcagcgtctcgggacccccgggcagaggtcaccatctcttgttctggaggcaactccaacatcggaagtaattatgtattctggtatcagcaactcccaggaatcggacccccaaatcctcatccagagaataancagccgccctcgacgggtccctgaccgtattctcgtggcctccaagtcgtggccacctcacgcctccctgaccatcaggtcgggccttccgggtaccgaggatcggacggctgtaacttacttaacttggcgacaacgtccggaacgggaaccgaataaaaaggtggggtaaactagaaacctaaagttccgtaggacgggttccggggttttggggttaccggttcggggacgggaacgggtaaccctaaaacggttccggacccggttaccggtaaccgggttccgaacggtaccccgaagggtcccgttacccggtcccccccgtacgggttaccctaccgttccgttccccggtttaccccctaccccgttccccttcccgttacccgttccttacccgttaccgtcggtaccgggacgggttccgtcgggaacgaacggccgacgtagtacgnacgncnngnnnnnnnn

SEQ ID NO: 24514 - DNA, 828 bp, Homo sapiens
  misc_feature: GYAE6OF01ACC7O.21.22.B11.1.454.CMB.1.raw
  modified_base (223)..(223): a, c, t, g, unknown or other
  misc_feature (223)..(223): n is a, c, g, or t
  modified_base (354)..(354): a, c, t, g, unknown or other
  misc_feature (354)..(354): n is a, c, g, or t
tcagtcgtcgctcgcacgaccggtgctcgatttagacgacagctcagggggggaagctcagcttcagctgtggtagagaagacaggactcaggacaatctccagcatggccgtcttcctctcctcctcaccctcctcactcactcgcgcgaggtcctcgggcccagtctgtgctgacctcgacgcccaccctcgacgtccgtccggtccggggacccccgggngacggacgggtccacccgtattccgttcgtttcggtaccgtggaacggtaccctaaccgtacctaaaacgtacggttaaccggtaaagtttaaactttagttacggtttaacgtttcggttaacggttacnccgtaaacggacccttaaacccggtaccccgaacggtaaccgtttccccggaacccccctaaaccttccctacgtacctaaccgtaaaggaaacgtaaactacgtccgaacggtcccggtacccgtccgggtaccggtaccgttacggtaacccgtttcttaccgtcgtaccgggtacccttaacggacgttccgtaccggacccttaccggacctaccgtccccttacccgtacgaccgtacgtaccgcgggttaccgtccggtaccggtacgtacggacgtacggtcgacgtacttacgttacgttagtcgtacgacgtaccgaccggtacgaccgtaactaacggtacgtacggtaactacgtacgttacgtacggtagggtacggttacgggggttacggttcgggtacgggaccgggtaacggtaaaccgttaccgtacccggtaaccccgttaggtacccggtacccg

SEQ ID NO: 24515 - DNA, 804 bp, Homo sapiens
  misc_feature: GYAE6OF01C2GZT.21.22.B11.1.454.CMB.1.raw
  modified_base (785)..(785): a, c, t, g, unknown or other
  misc_feature (785)..(785): n is a, c, g, or t
  modified_base (791)..(791): a, c, t, g, unknown or other
  misc_feature (791)..(791): n is a, c, g, or t
  modified_base (795)..(795): a, c, t, g, unknown or other
  misc_feature (795)..(795): n is a, c, g, or t
  modified_base (799)..(799): a, c, t, g, unknown or other
  misc_feature (799)..(799): n is a, c, g, or t
  modified_base (801)..(801): a, c, t, g, unknown or other
  misc_feature (801)..(801): n is a, c, g, or t
  modified_base (803)..(803): a, c, t, g, unknown or other
  misc_feature (803)..(803): n is a, c, g, or t
tcagtcgtcgctcgcacgaccggtgctcgatttagacgacagctcagggtcctgggcccagtctgtgctgactcagccaccctcagcgtcgtcgggacccccgggcaggagggtcaccatctcttgttctggagcaactccaacatcggaagtaattatgtattctggtatcagcaactcccaggaactcggacccccaaactcctcataccaaggaaggtaaataactcgacgccggtccctacggtacggggtccctaggaccgtatttcgtacgtcggcctaccgtaacgttccgtcggacctacccgttccgaaccgtccccgttacccgtacgaaccctagttccgacgggtccgggtcccgtaccgggtaccggaagggtacgtaggaacggtctaacggtacttaacgttacgttggcgacctaacgtacccggaacgggtaaccaacgtaaacgtaggtacgggattacgaaacgtaacgtcggttacgggacgggttcgggtttacggggtcggttaccgggacgggtaaccgggaaaccgtaaccgtaccggtaaccggttacgtaaacgggtacccgaacggtacccggtaaccggtacccggtacccgtccccggttacgggtaccctaccgtttcccgttaccccgttcccctacccccttcccgttccccgttccttacccgtaccgttaccgtacggtacccgggttccgggtcggtacccgggtaacggaaccgggtaccggtacctaaggtccgacgtcgcgtaccgngtacgntcgngcgngngng

SEQ ID NO: 24516 - DNA, 337 bp, Homo sapiens
  misc_feature: GYAE6OF01B21QS.21.22.B11.1.454.CMB.1.raw
  modified_base (154)..(154): a, c, t, g, unknown or other
  misc_feature (154)..(154): n is a, c, g, or t
  modified_base (318)..(318): a, c, t, g, unknown or other
  misc_feature (318)..(318): n is a, c, g, or t
  modified_base (325)..(337): a, c, t, g, unknown or other
  misc_feature (325)..(337): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggcncaacatgggatgacaatctgaggtcggttgggtggttcggcgggagggaccaacgtcgaccgtcctaggtcagcccaaggcctcgtccccctcggtctactcctcgttccccaccctcccttcctccgttctcctacttgaggcgggcttcggacgacggccgnagtacgnnnnnnnnnnnnn

SEQ ID NO: 24517 - DNA, 739 bp, Homo sapiens
  misc_feature: GYAE6OF01BR4GP.21.22.B11.1.454.CMB.1.raw
  modified_base (717)..(717): a, c, t, g, unknown or other
  misc_feature (717)..(717): n is a, c, g, or t
  modified_base (724)..(724): a, c, t, g, unknown or other
  misc_feature (724)..(724): n is a, c, g, or t
  modified_base (732)..(733): a, c, t, g, unknown or other
  misc_feature (732)..(733): n is a, c, g, or t
  modified_base (735)..(735): a, c, t, g, unknown or other
  misc_feature (735)..(735): n is a, c, g, or t
  modified_base (737)..(737): a, c, t, g, unknown or other
  misc_feature (737)..(737): n is a, c, g, or t
  modified_base (739)..(739): a, c, t, g, unknown or other
  misc_feature (739)..(739): n is a, c, g, or t
tcagtcgtcgctcgcacgaccggtgctcgatttagacgacagctcagggtcctgggcccagtctgtgctgactcagccaccctcagcgtctcgggacccccgggcaggagggtcaccatctcttgttctggaggcaactccaacatcggaagtaattatgtattctggtatcagcaactcccaggaactcggaccccaaactcctcatccagaaggaataatcacgccgccctacgacggggtccctagaccgtattcctcgtcggcctaccgaagttccgtcggaccaacccgtcaccgtccccttaccccgacgaacccttacgtaccggtagggtccggggtcccgttacccccgggggtacggaacggtaagtcgggaaccgggttccttaacggtaacctttaacggttttacgtacggttcgacgtaacggtaccgggaacgggtaccgaacaaacggtaggtagggaacttacggaactaaacgtcgtagggtacggtacgggggtttgggacgggttccgggaacgggaaccgggaaaccgtaacgtacggtaccgtaccgtacggtaccgtacggacccgaacgtcccgtacccgtccccgtcgtccgtaccctccgttccgttcccccacccttccctccgttccgtccgttacgtaccgtaggtccggccggtcgtaacggacgtacgggcctaccgtagtacgtnacgctancgtgcganncngngn

SEQ ID NO: 24518 - DNA, 742 bp, Homo sapiens
  misc_feature: GYAE6OF01AUPOZ.21.22.B11.1.454.CMB.1.raw
  modified_base (218)..(218): a, c, t, g, unknown or other
  misc_feature (218)..(218): n is a, c, g, or t
  modified_base (737)..(737): a, c, t, g, unknown or other
  misc_feature (737)..(737): n is a, c, g, or t
  modified_base (741)..(741): a, c, t, g, unknown or other
  misc_feature (741)..(741): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgccgcagggtccgtcgggcccagtctgtgctgactcacgcccaccctcacgcgtcgtcgggacccccggnacggacgggtcaccatcttcttgttcgtggacgcaacctaccaacgtagtacggtaaagttaacttagtacgttacttcgttaggtactcgacgaccctaacctacccgtaacggtaacgtccggaacccccctaaacgttcccttaccgaacctaccgaaggtaaacggtaaactaacgttaccgaacggtcccgggtaccccgttaccgggtaccggggttaccccgttaacggacccgttacgtttccgtaccggttcggtacccttacccgtaaacggttccgtaacggtaccctacccgtacctaccgtacccctcccgtacgtacccgtactcggttaacgggtccgggtcccgttacccggtacggtacggtacgtacggacggttcgtaacgtacctttacgttacgtcgtacgaccgtaacgtccggaaccggtaccgacgtaacgtggtacggtactacgaactcgtacgtaggccgggtgcggacgtcgaggacgtacgtagtagcgngtgng

SEQ ID NO: 24519 - DNA, 890 bp, Homo sapiens
  misc_feature: GYAE6OF01A9OO5.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgacgggtcctcgggcccagttctgtgcttgactcacgcccaccctcacggccgtccgtccggggacccccgggcaaggacgggtccaacctatccttcgtttgttccgtggacgccaacctaccaacgagtacggtaaacgttaatttagtgttactttcgtaggttactcgaagtacctaacctacccggtaaggaacgtacccggaacccccctaaactccccgtaccacgtaccgaaggaaacggtaaactaactccgtaacggccccggtacccttaccggaaccgggggtccctaacggtacccgtaactttccgtccgtacggtacctaccgtaacggtcccggtcgtacccgtaccctacgtacccgttcccctacccgttccgaaaccctacgttccggtaacggttcccggggtacccgtaacccgggggttaccgaacggtaaccgggtagggtaacccggtagttacccggttaacctttaacgtttaccgtacgggttcgtaccgtaaccggttaccgggaaacccgggtaccgaaccgtaaaccgtagggtacgggtaacgtaacggtaaccaacggtttccgtaagggggttaaacgggttccggggggtttaacggggtttccggggttaccgggggtaaacggggtaaccccggtaaaaccggtttaaccgggtaaccccggttaaaccccgggtttcccgggttaaccgggtaaacccccgg

SEQ ID NO: 24520 - DNA, 695 bp, Homo sapiens
  misc_feature: GYAE6OF01CM65U.21.22.B11.1.454.CMB.1.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (249)..(249): a, c, t, g, unknown or other
  misc_feature (249)..(249): n is a, c, g, or t
  modified_base (327)..(327): a, c, t, g, unknown or other
  misc_feature (327)..(327): n is a, c, g, or t
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (686)..(686): a, c, t, g, unknown or other
  misc_feature (686)..(686): n is a, c, g, or t
  modified_base (690)..(695): a, c, t, g, unknown or other
  misc_feature (690)..(695): n is a, c, g, or t
tcagtcgtcgctcgcacgaccggtgctcgatttagacgacagctcagggtcctgggcccagtctgtgctgactcagccaccctcagcgtctcgggacccccgggcaggagggtcaccatctcttgtctggaggcaactccaacatcggaagtaattatgtattctggtatcagcaactcccgaggaatcggacccccaaatcctnatccagagaataancagcgcctgacggggtccctgaccgattcncgtggctaccagtctggaccacctcacgtcctccctgacccatccgtaggtcggggcccttccggggaccgaagggtntacggacggcttaggtacctttaacgtttacgtggttagacctaacgtccggaaccggggaacctaccgaaaacggtaggttacggggaattacggaaacctaagttcggtagggtaaccgggttgggggttttacgggtcgttaccgggggacgggtaacgggaaccgtaaacgtcggtaccgtacgttacggactaacggaccgtaacggccgtccgtccccgttcggtccgtaccttccgtacccgttcccctaccccgttccttaccccgttccgttaccgttaccgttaccgtacgggtccggtaccggggtccgtcgggaaccgacggccgtacgtaacggtcgngcncncgncgcnnnnnn

SEQ ID NO: 24521 - DNA, 762 bp, Homo sapiens
  misc_feature: GYAE6OF01DJAIP.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcacgcgtccgtcggggacccccgggcaggacgggtccaccatcttctttgttcgtggacgacaactccaacagtacggaagttaattatgttacttcgtaggttatcacgaccaacctccccgaaggtaacctacccggaacccccctaaaccgttacctactaacctaccgaaggaacggaaacttaacgtacgacggcccggtaccctacggaaccggggtccctacggaccgttacttccgttcgtacggtccctaccgtaacgttccgtacgaccctacccgtcgacccgtccctacccgtacgaccctagtccggaggtccgggtacccgtcccgggtacgaggtacgtacggacggtctagttacttcgttacgtgtcgactacggtacccggaagggtacccaacgaacgtagggtcggaacgtaacgtaacgtaacgttccggtagggttacgggttacgggggttttcggggttacggggttacccggggacggggtaaaccgggtaaaccccgttaaacggtccggggttaaacccccgttgggttaacccggtaaccccggg

SEQ ID NO: 24522 - DNA, 902 bp, Homo sapiens
  misc_feature: GYAE6OF01CW5CD.21.22.B11.1.454.CMB.1.raw
  modified_base (191)..(191): a, c, t, g, unknown or other
  misc_feature (191)..(191): n is a, c, g, or t
  modified_base (261)..(261): a, c, t, g, unknown or other
  misc_feature (261)..(261): n is a, c, g, or t
tcagtcgtcgctcgcacgaccggtgctcgatttagacgacagctcaggggggggaagctcagcttcagctgtggtagagaagacaggactcaggacaatctccagcatcggccgcttccctctcctcctcaccctcctcactcactgcgcagggtcctgggcccagtctgtgctgactcacgcccaccctnacgccgtcgtccggggaccccggcaggacgggtccacctatcttcttgtccgtggacgaccaactccaanagtacggaattaaactttatgttaattccgttaggtatacgaacgtaccaacctacccgaagggtaaaccgttccggaaccccctaaacctcccttacaactcccgaaaggtaacgtaaacttaagtaccaacggtccccggtaccccgttacgggtacccgggggttcccctacggtaacccgttaacgttccgttacgtccgggtacctaacccggtaacggtccttacgggtaaccctacccgtaccgaccgttcccccttacccgtaccgtaaccctaagttaccggaccggggttcgggtaccccgtacccgggggttaaccggtagggcgttacgggaccgggttactaccggttaacgttttacgtttacccgttgtacggtaaccctacggttaacccgggaacgggaccgttaaacgaaaccggttagggtaacgggttacgtaaaaaccggtacgttaaaccgtttcgggtaacgggtaccggggtttaccgggggttttaccggggggttaaggggttaaccccgggggtaaccgggggtaaaacccggggtaaaaacccccggttttaaacggcccccggggtttttaaaaccccggccccggggtttaaagggggttaaccccccggg

SEQ ID NO: 24523 - DNA, 900 bp, Homo sapiens
  misc_feature: GYAE6OF01EL1NJ.21.22.B11.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagacgacagctcgaggggggggaagctcagcttcagctgtggtagagaagacaggactcaggacaatctccagcagtcggccggtcttccctctcctcctccaccctcctcactcactgcgcgaggtccgtcggcccagtcttgtcgctcgactcacgcccacctcagcgtcgtccgggaccccggnaggacggtaccacctacgtcttcgttacgttccgtaggacggacctaactaccgaaactacgtaacggtaaattaattagttacgttacttagttaggttactacgaaccgtaccgtaaccgtacccggtaaggtaaccgtaccccggtaacccccttaaaacttccctactaacccgacggtaacggtaaacggtaaatttacgaccgtaccggacccgtaccggtaccggtaccggggttaccctaacggaccgtacgtttccgtaccgttcggtaacccgttcgaaccggtttcggacccgacgtacccctacgtacccgttaccccttccgtaacccgtaccgtacgttaccggtaacgggttccccgggtaccgtaccccgggtaacgggtaacggttaacggtcgggtacgttacgttaaccggttaaccgtttaacgtttacggttccgaacggttacggtacccgggtaaccggaaccgggtaactaacccggtaagggttcgtaacggtacgtaacggttaaacctcggtttaaaccgggagggttttaccgggggtacgggggttttacgggttcggggtaaaccccggggggtacgggtaaaaccccgggttaaccttaaaccggggtaccccggtttaacggtaacccgggttacgaaacccccgggg

SEQ ID NO: 24524 - DNA, 610 bp, Homo sapiens
  misc_feature: GYAE6OF01BZPGQ.21.22.B11.1.454.CMB.1.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccagggcaggaggtcaccatctcttgttcnggagcactccaanatcgaataattatgtattctggtatcagacaactcccgaggactcggaccccaactcctcactccaagagaataatcacgccggcctacgacgggtcctgaccgtattccgtcgtgcctacgaacgtcgtcggacctacctcgaccgtccctccgacacctactcgtaggtcgggtcctccggttaccgtaggactacggacggtctacgtacgttacttacgtcgtcgtactacggttaccggaaccgggacaacgtaacgacgttagggactacggtaactaacgttcgtaggtacgggttcggggttagggtcgggtacgggacgggacggaacctaaagtccggacccgttcgtaaccggg

SEQ ID NO: 24525 - DNA, 808 bp, Homo sapiens
  misc_feature: GYAE6OF01E1ABM.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccgcttccctctcctcctcaccctcctcactcactgcgcagggtcctgggcccagtctgtgctgactcagcccaccgtcagcgtctcggggacccccgggnagtacgggtcaccatatcttgtcgtggagccaactcaacagtcggaagttattatgtattctggtatacagacaaccgtcccaggtaactcggaccccctaaacgtcctactacgtaccgagaacgggtaactaaactcgagcccgggtaccctcgtaacggggttccctacggaccgtactttacgccgtacgggtccctaaccgtaagtcccgtacggacctaacccgttaccaccgtaccctttacccgaaccgtacccgttaagtacccggtaacgggttccccggggtaccttaccccgggggttaaccggaaggtaaccggtcgggtaacggtccccgttaagttaaccccgtttaagttttaacccgttaggaccgtaacgtaacccggtaaccggtacccgggggaaacttaccgtaaaaacgtcgggtaaaggggacccgtttagaaacccggttaacttaacggttacgggaacgggtttccgggggtttaacggggttcccgggttaaccgggggtaaccggggaacccggtaaaaccccgtaaacgttacccggttaccccggtaaccggttaacgaaccccggg

SEQ ID NO: 24526 - DNA, 779 bp, Homo sapiens
  misc_feature: GYAE6OF01B8YX2.21.22.B11.1.454.CMB.1.raw
  modified_base (59)..(59): a, c, t, g, unknown or other
  misc_feature (59)..(59): n is a, c, g, or t
  modified_base (159)..(159): a, c, t, g, unknown or other
  misc_feature (159)..(159): n is a, c, g, or t
  modified_base (175)..(175): a, c, t, g, unknown or other
  misc_feature (175)..(175): n is a, c, g, or t
tcagtcgtcgctcgcacgaccggtgctcgatttagacgacagctcgagggggggggaanctcagcttcagctgtggtagagaagacaggactcaggacaatctccagcatggccgtccttccctctaccctcctccaccctcctcactcactcgcgacncgggtcctgggacccnggtctgtgactacgacctacaccgccctacctcaacggtccgtaccggacccggggaccccggatagggtaccgtaccactacgtttccgtacgttgtacggcggaacgacctactaaccgaacgtagtacggtaagttaacttatagttacttaggtacgaactacacgtaaccctacgtaccgaacggtaaccacccggtaacccctaacacctacgtaactaccgaagaagtaacgtacgacgtaccgggtccggacccggtccgggtaccccgtacggtaccgtacgtttcgcgttaccgcgttaacccgtaagtcccgtacgtaccctaaccgtaccgtaccctcccgacccgtacgacctacgtacggtacgggtccggtaccggtccggaaccgggtaagtcggtacgggtacgtaccgttagtaaccgttacgttccgtaggtaacccgacggttacgacccgggaacggtaaccggaacttaggacgttaaggaacgtaagtaccggtatccggttaggacgggttacgggttacggtccggacgggtacgaaacgggtactaacgcggtaaccggtacgcggtaacgacccggg

SEQ ID NO: 24527 - DNA, 746 bp, Homo sapiens
  misc_feature: GYAE6OF01DVBI0.21.22.B11.1.454.CMB.1.raw
  modified_base (212)..(212): a, c, t, g, unknown or other
  misc_feature (212)..(212): n is a, c, g, or t
  modified_base (334)..(334): a, c, t, g, unknown or other
  misc_feature (334)..(334): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctgggcccagtctgtgctgactcacgccaccctcagcgtcgtcggggaccccggnagacgggtcacctatctcttgtcgtggacgcaactccaacagtacggtaagtaattatgtacttctggtatacgacgcaaccgtcccgaaggaacgtccggaacccccaaactcctacaacnccgaaggaacggtaataactcgacgccggcccgtacggacggggtccctacggtaccgtacgttcctcgtcggtacctaccgtaacgttcgtacggccctacccgtactacccgtccccttacccgtacgaacccgtagttaccgtaacggggttcgggtcccgttacccggggtaccggaaggtacgttacgggacggtaccttacgttaaccgtttattaccgtggttacgaccgttacgtaccgggaacgggtaccacgtaaaccgtagggtacgggtaataccggtaactacggttcgtacggggttacggggttaggggtttcgggttacggggttaccggggaaccgggaacccgggtaaccgttaaaccgcccgggttaacccgttccggtagggtaaccccggg

SEQ ID NO: 24528 - DNA, 789 bp, Homo sapiens
  misc_feature: GYAE6OF01DPG2N.21.22.B11.1.454.CMB.1.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
  modified_base (419)..(419): a, c, t, g, unknown or other
  misc_feature (419)..(419): n is a, c, g, or t
  modified_base (624)..(624): a, c, t, g, unknown or other
  misc_feature (624)..(624): n is a, c, g, or t
tcagtcgtcgctcgcacgaccggtgctcgatttagacgacagctcgagggggggggaagctcagcttcagctgtggtagagaagacaggactcaggacaatctccagcatggccgcttccctctcctcctcacctcctcactcactgcgcgacgggtccgtcgggcccagtctgtgctgactcacgccacccgtcacggtcgtcggccggggaccccggnaggacggtcaaccntnttcttgttcgtggacgcactccaanagtacggaaagttatagtagttagttctaggactacganacctaaccgtaccgaaggtaactcccggaaacccctaaacttccgactactaccgaaggaaaggtaactaaacgtcgaacgccgtaccgtcggaccgggtcctagtaccgtattaccgngtaccggcttacgagtcgtacgacccctcgtacaccgtacccgttaccgacgtaacccgtacgtaccggtacggggttcccgggtccccgttaaccgggggacccggtaagggtaccgtaagggtacgggtacctttaaccggtaacgtttaactttacggttacgaacggaacgttaaccgggtacccggaacccggggttaanaaaccccggtaaggtaaaccggggttacggaagtaaccggtaaaccgtacggttaaccgggttaagggaccggggttttcggggggttagttccgggggtaaccgggaaacgggtaaccgtacccggtaacgtaacccgggttaccgttaccgggcggtaacccg

SEQ ID NO: 24529 - DNA, 724 bp, Homo sapiens
  misc_feature: GYAE6OF01DQ8II.21.22.B11.1.454.CMB.1.raw
  modified_base (119)..(119): a, c, t, g, unknown or other
  misc_feature (119)..(119): n is a, c, g, or t
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (324)..(324): a, c, t, g, unknown or other
  misc_feature (324)..(324): n is a, c, g, or t
  modified_base (493)..(493): a, c, t, g, unknown or other
  misc_feature (493)..(493): n is a, c, g, or t
  modified_base (591)..(591): a, c, t, g, unknown or other
  misc_feature (591)..(591): n is a, c, g, or t
  modified_base (632)..(632): a, c, t, g, unknown or other
  misc_feature (632)..(632): n is a, c, g, or t
tcagtcgtcgctcgcacgaccggtgctcgatttagacgacagctcaggggggggaagctcagcttcagctgtggtagagaagacaggactcaggacaatctccagcatggccgcttccnctcctctcacctcctcactcactgcgcgtacgggtccgtcgggacccagtctgtgctgacgtcacgccacctnacgccgtcgtaccggggacccccggngacggtacgggtccaaccgtacttcttcgtttcgttacgcgggtaacgccaaaccgtcaaactagtaccgtaaagttatttatgttacgttcgtaggtactcgacnccgtaaacctaccgtaacggaacgtccccgaaccccgttaacctcctacgaactaccggaaggtaacgtaaatacgtacgacggtccgtaccgtacggtacccgggttccacgtaccgttcttctacggtcggacctaacggtgttccgtacggaccctaccgtaaccnccgttaccccgtcccgtaagccctagacggttccgggtcggtacccgtccggtacggagtacgtagccgtctaacgttacgtttaagtacgtcggtanaccgaccggtccggagtacccgacaaggttcgaagtactanaccgttaaggcgtaaggtcgggttcgggttaggtccggtaccgggaaagaccggtaaaccgtacggacgttacccgttaggtccgtaacccg

SEQ ID NO: 24530 - DNA, 747 bp, Homo sapiens
  misc_feature: GYAE6OF01A9FWE.21.22.B11.1.454.CMB.1.raw
  modified_base (58)..(58): a, c, t, g, unknown or other
  misc_feature (58)..(58): n is a, c, g, or t
  modified_base (237)..(237): a, c, t, g, unknown or other
  misc_feature (237)..(237): n is a, c, g, or t
  modified_base (660)..(660): a, c, t, g, unknown or other
  misc_feature (660)..(660): n is a, c, g, or t
tcagtcgtcgctcgcacgaccggtgctcgatttagacgacagctcagggggggggaanctcagcttcagctggtggtagagaagacaggactcaggacaatctccagcatggccgcttccctctcctcctccaccctcctcactcactgcgcgagggtcctgggcccagtctgtcgcttacgaccttccgacgccccacccttcacggtccggtccggtacccgggggacccccggngacggacgggttaccacctacttccttcgtttaggtccgtgggaaccggacaacctacccaaagtacgtaccgggttaaagttaatttacttaggttactttcggtcggttaatccgtaacgacctaaacctacccggaagggtaaccgtacccggaacccccctaaacctccctcctaacgttacccgaggtaaccggtaaattaactacggacggtccggcccgtaccggaccgggttccctacggtaaccttcgtctcgtccgactacgtactcgcgtcacctcaccgtcctccgtacacctacgtcgtacggtacggtccgacggtcgaacggtgtcggtacgtcgtagtaacctgttacgtgtaacgacgtaccgtacggaaccgggtactaaacggtaaacgtagggataccgtaanacgttacggagttacggggtcggttaaggttcggtaccgggaggaaccggtaacgtacgaccgttcggtacccgtgtccggaaccgg

SEQ ID NO: 24531 - DNA, 769 bp, Homo sapiens
  misc_feature: GYAE6OF01AUH7C.21.22.B11.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgcgcagggtcctgggcccagtctgtgctgactcacgcccaccctcagccgtcgtaccggggacccccggnacggacgggtccacctatcttcgttgttcgtgggacgacctaaccgtaccaactacgtacggtaagttaatttagtgtacttcgtaggtactacgagtacctaacctacccgaaggtaacctccggaaccccctaaacgtccctactacaacccgaaggtaacgtaaactaacgtaccgaccggtacccggtccctaccgggtaccggggttccctacggtaccgtacgttccgtacgtcggtacctacgtacgttcgtacgacctaccgtacgaccgtccctacctacgaacctacgtccggtacgggtcccggtaccgttccggggtacgaggtacgtgggtctacgttacgtaacttacggttctacgcgttaacccgtacggtaccgggaaccgttaccgaacgtaagggtcggtacggtaacgtcgaacggttactcgggtagggtaaccggggttttggggtcggggtttaccggaccggggggtaacgtaaccccgggtaaacgtaaccgggttccgggtaacccggtggtaccccgggtaacg

SEQ ID NO: 24532 - DNA, 324 bp, Homo sapiens
  misc_feature: GYAE6OF01BNQM6.21.22.B11.1.454.CMB.1.raw
  modified_base (307)..(324): a, c, t, g, unknown or other
  misc_feature (307)..(324): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcgacgggacgcaacagtgggatgacaatctgagtcgggttggtgtcggacggacggacaaacgtcgaccgtcgtaggtcagccgaagctcgcccctgtcactctcgtcccacctctcctcgtctctactggacgcggctggcaacggcgactagtgcagcnnnnnnnnnnnnnnnnnn

SEQ ID NO: 24533 - DNA, 702 bp, Homo sapiens
  misc_feature: GYAE6OF01CPOQY.21.22.B11.1.454.CMB.1.raw
  modified_base (194)..(194): a, c, t, g, unknown or other
  misc_feature (194)..(194): n is a, c, g, or t
  modified_base (216)..(216): a, c, t, g, unknown or other
  misc_feature (216)..(216): n is a, c, g, or t
  modified_base (272)..(272): a, c, t, g, unknown or other
  misc_feature (272)..(272): n is a, c, g, or t
  modified_base (385)..(385): a, c, t, g, unknown or other
  misc_feature (385)..(385): n is a, c, g, or t
  modified_base (485)..(485): a, c, t, g, unknown or other
  misc_feature (485)..(485): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctcgggcccagtctggtgctgactcacgcccaccctnagcgttcgcggggacccccggnaggacgggtccacatcttcttgtctggagtcaactcaacagtacggaagttaattntgttattctggtatcagtacacgtccgaagtactccggacccctaactcctacactaccgagagtaactaactcgacggccgtaccgtcggtaccgggtcctacgaaccgttnttacctcggtacggtacctacccgtagttcgtacgtccacctccgaccgtcccttaccgacctacgtacgtacgacgggtcggtccgtccgggtaccggngggtatcggtacggtcctacggtactttacgttacgtggtacgtacaacgttaccgggaccgggtaacgtacgaaaccggttggtacggataaccggtatacggttggtagggtccgggttggggtttacggggttccggttcgggggaaccgggtaacccgggtaacctaaacccggttcggggttaaccccgtacgggttaacccggtacccggg

SEQ ID NO: 24534 - DNA, 882 bp, Homo sapiens
  misc_feature: GYAE6OF01CZTJ7.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggtcttccctctcctcctccaccctcctcactcacgtgcgcgagggtccgtcgggcctagtctgtgctgactcacgcccaccctcgacgtccggtccggtcccggggacccccgggcgaggtacgggtaccaccgtacttccttcgtttgttcgtagggacggtacctaacctaccaacgtacgtacggtaaagttaaacttagttagttagtttcgttagtactacgacgtacctaacccgtaccgtaacgggtaacgtcccggaaccccctaaaccttcctaccgaactaccggaaggtaacggtaaacttaaacgcgaaccggtccggtcccgtcggtaaccgggggtcctacggtaaccgttcttccgtaccgtacggtccgtacgtaaccgttcgtaccgtaccacccttacgcccgtaccccttccgtacctaccctacgtaccggttacgggttcccgggtccggttaccgggtacggaacgggttacggtacgggtaaccgttacttacgtttaaccgtttaactttacggtgggttacgtaaccggtacggtaacccggtccggggtaacccgtaaaccggagtaacgggtaacggtagtaacgggtaaacccgtacggttacgggtacgggtttaccgggggtttaggggttaccgggggtttcggggtaacccgggggtaaaccggggttaacccgggtaaacggttaccccggtaaccgggttacccggtttaccggttacccgggtaaaccccggg

SEQ ID NO: 24535 - DNA, 802 bp, Homo sapiens
  misc_feature: GYAE6OF01DII9P.21.22.B11.1.454.CMB.1.raw
  modified_base (58)..(58): a, c, t, g, unknown or other
  misc_feature (58)..(58): n is a, c, g, or t
  modified_base (240)..(240): a, c, t, g, unknown or other
  misc_feature (240)..(240): n is a, c, g, or t
  modified_base (374)..(374): a, c, t, g, unknown or other
  misc_feature (374)..(374): n is a, c, g, or t
tcagtcgtcgctcgcacgaccggtgctcgatttagacgacagctcgaggggggggaanctcagcttcagctgtggtagagaagacaggactcaggacaatctccagcagtcggccgtcttccctctcctctccaccctcctcactcacgtcggcgtacgcgggttccgtcgggcctagttcgtgtcgctacgactcgacctcccaccgttcgacggtccggtccggccggggaccccggnaacgggtacggtactacctgttcgttcgtttacgtcggaggacgtaccaactacgaacgtaggtaacgtaaagtttactttagtgttaacgttcgtacgtataccacgtacctaccgtaaccgtaacggtaccnccccgtaacccacgtacctctaaccgtacgaagtaataactacgacggccgaccgtcccgtacggtcggttaccgacgtacctttcgtcttacgccgactaacggtacgttcccgacgttaccgacctccgtacccgttccttaaccgcgtaaccgtaccggttcggtaaccggggtccccgtaccggttaacccgggaagtaacggtcgtaacgggtaacgttacctagtttaacccggtaatttcgggaccttacgtcggaaaccgttaccgggaacggtactaacggagttaacggagaccgtaaacttcgtaaggtggttaaccgggggttcgggtaggggttttcggaaccgggaacggggtaaacccgtaaaccgggtaactttaacgggcccgtttaaaccggtgggaaacccgttacccg

SEQ ID NO: 24536 - DNA, 770 bp, Homo sapiens
  misc_feature: GYAE6OF01CJ5YS.21.22.B11.1.454.CMB.1.raw
  modified_base (737)..(737): a, c, t, g, unknown or other
  misc_feature (737)..(737): n is a, c, g, or t
  modified_base (743)..(743): a, c, t, g, unknown or other
  misc_feature (743)..(743): n is a, c, g, or t
  modified_base (748)..(749): a, c, t, g, unknown or other
  misc_feature (748)..(749): n is a, c, g, or t
  modified_base (753)..(753): a, c, t, g, unknown or other
  misc_feature (753)..(753): n is a, c, g, or t
  modified_base (765)..(765): a, c, t, g, unknown or other
  misc_feature (765)..(765): n is a, c, g, or t
  modified_base (767)..(768): a, c, t, g, unknown or other
  misc_feature (767)..(768): n is a, c, g, or t
  modified_base (770)..(770): a, c, t, g, unknown or other
  misc_feature (770)..(770): n is a, c, g, or t
tcagtcgtcgctcgcacgaccggtgctcgatttagacgacagctcagggtcctgggcccagtctgtgctgactcagccaccctcagcgtcgtcgggaccccgggcaggagggtcaccatcttcttgttctggaggcaactccaacatcggaataattatgtattctggtatcagctaactccaggaactcggacccctaaatcctacactaccgagaaggtaataactcgagccggtacctcgacggggtccctagaccgtattctcgtcggacctaccgtaaggtcctacggccacccgtactaccttccctacccgtacgacctaacgttcgtacggtccggtaccggttacccgggtacggaacggtacgtacggtaacggtaccgttaacggtaacttttaacgtttaacgtcgggtaccgtacgtaaccggtacccggaaccgggtaaccgaacgtaaacgtaacggttaggggtaaactacggtaaactaacgggtcggttagggtacggggttcgggtttaacgggggttcggtacgggggttaaccgggaacgggtaaaccctaacgggtaccgtacccggttaaccgtaacgggtaccgtaacgaccccggtaagcccggtacccgtccccgtacggttaccctaccgttcccgtacccttaccccgtacccgttcccttcggttacctaccgtacgtacggtcggacgggcgtacggacacgggtcncgtaanacgtnnatcngatcgactgacngnngn

SEQ ID NO: 24537 - DNA, 800 bp, Homo sapiens
  misc_feature: GYAE6OF01BWY65.21.22.B11.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (619)..(619): a, c, t, g, unknown or other
  misc_feature (619)..(619): n is a, c, g, or t
tcagtcgtcgctcgcacgaccggtgctcgatttagacgacagctcaggggggggaagctcagcttcagctgtggtagagaagacaggactcaggacaatctccagcatggccgcttccctctcctcctcaccctcctcactcactgcgcgacgggtccgtcggcccagtctgtgtctcgactcacgcccaccctacncgccgtccgtccggggacccccgggnaggacggtacacctatcttcttgttcgtaggacggaccaacctaccaactagtaaccggtaaagttaatttattagttacttacgttaggttatcaacgtacctaaccgtacccgaaggtaacgtacccggaaccccctaaactccgtaccactaccgaaggaacgtaaataacgacgtaacggtcccggtacccgttaccgggaccggggttccctacggtaaccgttacgttcccgtcggtaccggtacctaaccgttaacgtcccggtacgtccctaacccgtcgacccggtacccttcccgtaccgtaaccctacgtaccggtcgggttccgggtacccgtaccgggtacgaaggttcgtcgggacgttcgtacgtacgttactttacggtntacggacctaggtacccggacgggtaacctaacaaccgggtggtaagggtaactaacggtaaaccgtagtttacgggacgggttaagggttccggggttagggttacccgggccggggtaaacgggaaccgtaaacccggttaacgtacccggtaccggttaaccggttcggtaaacccgg

SEQ ID NO: 24538 - DNA, 790 bp, Homo sapiens
  misc_feature: GYAE6OF01CGRFI.21.22.B11.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcacccctcctcactcactgcgcaggggtcctcggggcccagtctgtgctgactcacgcccaccctcagccgtcgtcggggacccccggganaggacgggtcaccgatcttcttgttctggaggcacctccaacatacggaagtattatgttattactggttactacgacgcctaactccccgaaggtaacctccgggaccccctaaaccttcccacctactacccgaaggaggtaaacttaacgtacgaacgtcccggtaccccgtacggtaaccgggggtcccccttacggaaccgttacgtttccgtaccgtcggaccgtacctaacgtcggtcggctacccctcacgtcccctaccgtccgaacctacgtccgtaggtccgggtacccgttacccggggtaccgacggtacggtggtaacggtcctacggtaaccgttactttacggtccggttacgcgtaaccggttaccgaccgggggacctaccgaaacggtaggtacgggtaactaccggaaacttaccgttacgggtacggttacgggggtttacgggggttgggggtttcccgggtttaaccgggggacccggggtaaacgggaacccccggttaaaacggtcccgggttaaccccgggttcggttaaacgggtaccccggg

SEQ ID NO: 24539 - DNA, 737 bp, Homo sapiens
  misc_feature: GYAE6OF01EBTSY.21.22.B11.1.454.CMB.1.raw
  modified_base (219)..(219): a, c, t, g, unknown or other
  misc_feature (219)..(219): n is a, c, g, or t
  modified_base (266)..(266): a, c, t, g, unknown or other
  misc_feature (266)..(266): n is a, c, g, or t
tcagtcgtcgctcgcacgaccggtgctcgatttagacgacagctcaggggggggaagctcagcttcagctgtggtagagaagacaggactcaggacaatctccagcatggccgcttccctctcctcctcaccctcctcactcactgcgctagggtcctcgggccctagtctgtgctgactcacgcccaccctcacgtcgtccgtcggggaccccccggnaggacggtccaaccgtatccttcttgttcgtgggagccaactccaanacgtacggaagtaacttagtgtattcgtaggtatacgacgacctacctaccgaaggtaacgtccggaaccccctaaacgtcctactaacgtccgaaggtaaggtaaaacttaactccgacggcccggtacccttccgggacggggttaccctaggtacccgtacgtttccgtacggtacgtcctaaccgtacgtcgcggacctacccgtacgaccgtccctccgtacgtaccacgtcggtacgggtcggtccgtaccgggtacggagtacgtggacgtctacgtacttattacgtggtacactacgtaccggaacgggtccctaagaacggttgtaacggggtacaacggtaactacggtccgtagggttacgggttccggggtttacgggggttcggaaccgggggtacgggaacccgggtaaaccgttaaccggtaccggttacccggtaccgggtacgtaaccccggg

SEQ ID NO: 24540 - DNA, 669 bp, Homo sapiens
  misc_feature: GYAE6OF01EOAHJ.21.22.B11.1.454.CMB.1.raw
  modified_base (355)..(355): a, c, t, g, unknown or other
  misc_feature (355)..(355): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
  modified_base (553)..(553): a, c, t, g, unknown or other
  misc_feature (553)..(553): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcgacgcggttccgtacggggaccccccgggcaggacgggtccaccacgttccttctttgttccgtgggacggcctaaacctccaacagttacggaaagttaattattggtatttcgtaggtatcgaagccaactccccgaaggaactccggacccccaaactccncactaccaggaagaataactcagccggcctcgacgggtccngaccgnttcngtcgctacctaagtcncggcacctcacgtccctccgtacgacctagtcgaggttcgggaccgtcccgggtacgtaaggtacgtggacgtctacgtactttaattacctggttcgacacggtccgaacgggcaaccaagtagtaggtntacgaaatacgtaccgtgggtacgttagggggtttgggtcgggttacgggggtaccgggaaaccggggtaacctaaaccgggtaccgggtacccgttaccggtaacgggtaccccg

SEQ ID NO: 24541 - DNA, 749 bp, Homo sapiens
  misc_feature: GYAE6OF01DBJNV.21.22.B11.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctcgggcccagtctgtcgctgactcacgcccaccctcagcgtcgtccgggggacccccggnaggacgggtccacctattctcttgttcgtggagacaactccaacagtacggaagttaattatagttattcgttaggtaactcacgtaccaactacccgaaggaacctccgaacccctaaactcctcgaactaccgtaagaacggaaattactaccgacggtccggaccctcggtaaccggggttccctacggaacctagttctcgtcggacctaccgtaacgtccgtacgacctaccgtaccgaccgtccccgtacccgtaccgacctacgtacgtacgggtccggtccggttacccgggtaccgggtacggtacgtacggtcggtacgtacgtacgtttacgtacgtcggtacgtacgtacgtaccggaacggggtaccgtaacgaacgtacggtaggtaacgttacgtaaccgtacgttcggacggtcgggttcggggtttaggggttccggggttaacgggaccggggtaaacgggtaacccgtaaagggttcccggttaacccggtaacggttacggtaacccggg

SEQ ID NO: 24542 - DNA, 307 bp, Homo sapiens
  misc_feature: GYAE6OF01E0DYV.21.22.B11.1.454.CMB.1.raw
  modified_base (299)..(307): a, c, t, g, unknown or other
  misc_feature (299)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacagtgggatgacaatctgagcggttgggtgttcggcggagggaccaactgaccgtctaggtcagcccaaggctcgccccctcggcactctcgttcccaccctctccctcgtctcactgagcggctggcaaggctcatacgnnnnnnnnn

SEQ ID NO: 24543 - DNA, 863 bp, Homo sapiens
  misc_feature: GYAE6OF01C02UN.21.22.B11.1.454.CMB.1.raw
  modified_base (58)..(58): a, c, t, g, unknown or other
  misc_feature (58)..(58): n is a, c, g, or t
  modified_base (125)..(125): a, c, t, g, unknown or other
  misc_feature (125)..(125): n is a, c, g, or t
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgacagctcgaggggggggaanctcagcttcagctggtggtagagaagacaggactcaggacaatcctccagcatcggccggcttcccnctccctctccaccctcctcactcactgcgcgacgggtcctcgggccctagttctggtcgctagacctcgacgcccaccctcgagccgtccggtccgggaccccggngaggtacggtccaaccgtntttccttacgtttcggttcgtaggggaccgacctaacctacctaacgtacggttaacggaaagttttaacttagtacgtttacttcgttaggactaccgacgtaaccctacgtacccggtaaggtaaccgccccgaaccccttaactcctactaacgacgaaggtaaagtaactcgtacgacccgggtacccgacccggtaggtacccggggttccctaacggtaacccgtttcgtttcccgtacgggtacccggtacccgtttaaccggtaaccgggtttccgtacccgggtacccgtaaccccctttaaccgcccccgttacccgttaacccgtacccgtaacccggttaaccgtccgggttaacggggtccccggtttacccggtacccggggttaccgtaagggttaccgtacgggtaccggtacgttaaccgttacgtttacgttaccggttcgacgtaaccgttacgaccgggaccgacgtacgaacgttgggactaaccggataccgacgttcggtacgggtcgggttgggttcggggttacgtacccgggggacaaccgggttaaccgtaacccggtccggttaaccgtcgggtaaccgtaccgg

SEQ ID NO: 24544 - DNA, 656 bp, Homo sapiens
  misc_feature: GYAE6OF01EOJGD.21.22.B11.1.454.CMB.1.raw
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
  modified_base (645)..(645): a, c, t, g, unknown or other
  misc_feature (645)..(645): n is a, c, g, or t
  modified_base (648)..(650): a, c, t, g, unknown or other
  misc_feature (648)..(650): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
  modified_base (656)..(656): a, c, t, g, unknown or other
  misc_feature (656)..(656): n is a, c, g, or t
tcagtcgtcgctcgcacgaccggtgctcgatttagacgacagctcagggtcctgggcccagtctgtgctgactcagccaccctcagcgtctcgggaccccgggcagagggtcaccatctcttgttctggaggcaactccaacatcggaagtaattatgtattctggtatcagcaactccaggatcggccccaactcctcatccagaggaatatcagccggccctcgacgggtccctgaccgtattctcgtggcctacaagtctcggccacctcacgccctccagaccatcaggtcggcctccggcgaggactggagtctagacttagttactgtcacacgtcgaacgggacacgaacgtggtcgggatacggaactaacgttcgtaggacgggttcgggtttcggggtcggttaccgggagggtaaccggggaacctaaaccggttccggtaacccggttccgtaacgggttacccgaaccggtaaccccgacgggtccccgtacccgtccccccggttaggtacccttaccgttcccggttaccccgttcccccgtacccgttcccctccgttaccgttcctaccgttccggtaaggcggtccggtacggtcgacggacggtacacgttagacgntancgagcngcnnncngngn

SEQ ID NO: 24545 - DNA, 829 bp, Homo sapiens
  misc_feature: GYAE6OF01C0Z9N.21.22.B11.1.454.CMB.1.raw
  modified_base (127)..(127): a, c, t, g, unknown or other
  misc_feature (127)..(127): n is a, c, g, or t
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (313)..(313): a, c, t, g, unknown or other
  misc_feature (313)..(313): n is a, c, g, or t
tcagtcgtcgctcgcacgaccggtgctcgatttagacgacagctcgaggggggggaagctcagcttcagctgtggtagagaacgacaggactcaggacaatctcagcatgccgctcctctcctctcncctctcactcactgcgcacgggtcctcgggccctagtctgtgctgactcacgcccacctnagcgtcgaccgggaccccggngaggcgggtaccaccacttcttcttcggttcgtaggaaccgtccaaactccaaagtagtaaccgggtaattaaattagtatttacgttcgttacggtaactcganacgtaaacccgtccgaacggtaacggttaccccggaccctaaaaccttccgtacaaaccgttcccgaaggtacgtaaaacttacttaccgacgggtcccgtacccggtacgtacggtacccgtacggtcccgttaagtttccgtcgttaacgtcccgttaaccgtaacggttccgtacgggtaacccttaccgacccgtacccgtccccgtaccgttaccgtacctacgttaccgtacggttacgggtccgttccgggtaacgtacggtacgttccggaacgggttcgtaacgttaaccgtttacgtaaccggtttgtacgtaaccgtaaccggtttaccggaaccgggggttaacccacggttaaacggtagggttacggtaacgtaaccgtaaacggtaccggtaccggttaagggttcgggtacggggtttacgggggttacggtcccggggtaaaacggcgggtaaaccggttaccctaacggttcccggttaacgggtaccggtaacccgg

SEQ ID NO: 24546 - DNA, 703 bp, Homo sapiens
  misc_feature: GYAE6OF01ERYIQ.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnagaggtcaccatctcttgtcgtggagacaactccaatagacggtaagtaattatgtattctgtactcagcaactacccgagaacgtccggaccccctaaactcctacactaccgagaaggtaaataactcgacggaccgcccgtacggtaccggggtacccctacggaaccgtacttcctcgtacggaccttacgaacgtcgtcggacctaccctgaccgtccctacccgtacacctataccggtaggtcgggccctccgggacgacggagttacggacggttcctaggtaacctttacgttacgtcgtacgcgtaacgtaccgggacgggtacccgacgtaacgtaggtacgggtagaacgtactaacgttcggtcgggtacggggttacgggggttttcgggtcggggttaccgggaacgggggtaacccggtaaaccccgttaaaccgggtaccggtaaacccgggttccgtaaacgggttaccccgg

SEQ ID NO: 24547 - DNA, 860 bp, Homo sapiens
  misc_feature: GYAE6OF01DLX82.21.22.B11.1.454.CMB.1.raw
  modified_base (847)..(848): a, c, t, g, unknown or other
  misc_feature (847)..(848): n is a, c, g, or t
  modified_base (850)..(850): a, c, t, g, unknown or other
  misc_feature (850)..(850): n is a, c, g, or t
  modified_base (852)..(853): a, c, t, g, unknown or other
  misc_feature (852)..(853): n is a, c, g, or t
  modified_base (855)..(855): a, c, t, g, unknown or other
  misc_feature (855)..(855): n is a, c, g, or t
  modified_base (857)..(857): a, c, t, g, unknown or other
  misc_feature (857)..(857): n is a, c, g, or t
  modified_base (859)..(859): a, c, t, g, unknown or other
  misc_feature (859)..(859): n is a, c, g, or t
tcagtcgtcgctcgcacgaccggtgctcgatttagacgacagctcagggtcctgggcccagtctgtgctgactcagcccaccctcgagcgtcgtccgggacccccgggcaggacgggtccacctattccttcgtttgttcgtgggaggacaacctaccaaacagtacgggtaaattaattagttagttacgttcgtaggtactaccacgacctaacccgtacccggaaaggtaaccgtaccccggaacccccctaaactccctacaccgtaaccggaaggaacggtaaataacgtccgacgggtacccgtccggtaacggtaccggggtccctacggtaccgttacttccgtcggtacggtcctaaccgtacggtccggtaccggaccctacccgtaccgtaccgtccctacccgtacggaacctacggtaccggtacgggtccgggtacccggtaccgggtacggaacggtcgtacggacggtacctacgttacctaagttcgtgtaccgtacgtacgtaccggaacgggactaacggtaagtacggaggtacgtacgtaacgtcggttacggtaggtacggggttacggggttcgggttacgggaaccggggtacgggtaaaccggtaaccggtaaccggttaccggtacccggttaccggtaccgaccggaccgtacccgaccggttcccgtaccccgtcccgttaccgtccttacccgtcccgtttacccccgtacccttacccccgttccgttcccgtttaccctccggttaccgtaccggtcggtaccggggtccggtacggaccggtaccgcggtaccgtagcggtatcaggtccagtcnncncnncngngng

SEQ ID NO: 24548 - DNA, 850 bp, Homo sapiens
  misc_feature: GYAE6OF01DL42G.21.22.B11.1.454.CMB.1.raw
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
tcagtcgtcgctcgcacgaccggtgctcgatttagacgacagctcgaggggggggaagctcagcttcagctgtggtagagaagacaggactcaggacaatctccagcatggccggcttccctctccctcctcacccctcctcactcactgcgcgtagggtcctgggcccaggtctgtgctgactcacgcccaccctcacgtccggtacgccggggaccccccgggnagggacggtccaacctnttcttcgtttgtcgtgggacgacctaacctccaaacgtagtacggaaagttaatttntagttacttcgtgtatcacgacctaacctccgtaaagaccgtaccggaccccctaaacttcccacgtacctaccgaagtaacggtaaactaaccgtcgaaccggtcccgtacccgtacgggtaccgggttacccctacggtaacccgttcgttccttcggttccgtaccgtaaccgtaacggtccgtaacccgggccttaacccgtccgtaacccggtccccttacccggtcgtaaacccgtaccgttacggtaccggggtcccgggttacccggtccgggtaacggacgggtacggtacggtaacgggttcttaacttacgttaacgttcggtagtttacggaaccgtaaccggttaccgggaaaccggtccgtaaaccggttaagtaacgggtacggttaacgtaacgtaaccggttaacgtaggttacccggggttaggggtttacccggggttggggttaacccggggtaccggggaaacgggttaacccggtaaacgttacccgggtttaccggaccccggtttaggggtaaccgtaacccgggg

SEQ ID NO: 24549 - DNA, 789 bp, Homo sapiens
  misc_feature: GYAE6OF01E4FIF.21.22.B11.1.454.CMB.1.raw
  modified_base (235)..(235): a, c, t, g, unknown or other
  misc_feature (235)..(235): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggaccccgggcagagggtcaccatctcttgttcnggagcaactccaacagtacggaagttaattatgttattcgtggtatcagccaacctcccaaggtacgtccggaccccctaaactccctcactccaagaacggaataactcgacgccggtccctacggaccgggggttcccctaggaacccgtactttccgtccgttcggccctaccgtaacggttccggtaccgggtacctaaccccgtcgtaacccggtccccctttaccccgtacgtaaccccacgttaccgtacggggttcccgggtcccggttaccccgggtaccgggaaagggtacgtacgggtaacggtccgttaggttaaccttacgtttaccggtcggtcgaccgttaacgaccggaaccgggggtaaaccgtaccgaaacgttagggtaccgggtaagttaccggaaacgtaaccgttacggttacggggtcgggtttaccggggggtttacggggttcggggttacccgggggaaccggggtaaccgggtaaacccgtaaaccggttacccggtaaccccggttacggtaaccggggtaacccg

SEQ ID NO: 24550 - DNA, 1006 bp, Homo sapiens
  misc_feature: GYAE6OF01DVZFT.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcaggggggggaagctcagcttcagctgtggtagagaagacaggactcaagacaatctccagcatggccggcttcctctcctctccacctcctcactcactcgcgcgacgggtcctcgggccagtctgtgctgactcacgccacctcgacgccgtcgtccggggaccccggngacggtacgggtaccaaccgtacgttccttcgttttacggttccgtacgggtaacggtaccaaacctaccgaaaacgtacggttaaacgggtaaaacgtttaaacgtttaagttacggtttaacgttttacgtttacggttaacgtaccgaacggtaacctaaaccgttaccccggaaaggttaaccgtacccgggaaaccccccttaaaccttccccgttaacgaaccgttaaccggaaacggtaacggtaaaaactttaaccggttaccgaccgggtacccgggttaccccggttacgggtaacccggggtttcccgtacggtaaacccgttcgttaccgtttccggacggttaccccttacggtaaaccggttccggtcggtaacccctaccggttccgtaacccgtcccgttacccggtaacacccgttaacggttccgtaccggggttccgggtccctccgggggtaaacgaggttacggtacgggacccgggttctttaacgttaaccgtttacgtttaaccgggtgtaccggttaaccgaaccgggttacggggtaaaacccccgggttaccgaaacgttaaccgggtaagggttaaccggggttacgaaaccgtaccgggttaaaaggtttcccgggttaacgggggttacccggggttttcgggggggtttaaccgggttcgggggttaaaccccgggggtaaggggtaaacccgggtaaaaccctttaacggggttaaccgggttaccccccgtttaaaggggaccccgggttaacccggg

SEQ ID NO: 24551 - DNA, 555 bp, Homo sapiens
  misc_feature: GYAE6OF01A5JCP.21.22.B11.1.454.CMB.1.raw
  modified_base (209)..(209): a, c, t, g, unknown or other
  misc_feature (209)..(209): n is a, c, g, or t
  modified_base (446)..(446): a, c, t, g, unknown or other
  misc_feature (446)..(446): n is a, c, g, or t
  modified_base (468)..(468): a, c, t, g, unknown or other
  misc_feature (468)..(468): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgtctggaggcaactccaacatcggaagtaattatgtattctggtatcagcaactcccaggaatcggcccccaaactcctcactccagaggaataatcagcggccctcgaggggtcccctgacccgattctctggcctccaagtctggcacctcacgtccctccctcgacccatcaggtcgggcctccgggtccgaggactgaggctgactattactgtncatccgacggggtacacaacgngtgggatggacatcgtggaggtcgggttgggtcggttcggggacgggtacgggaaccaaacgtggacccgttcccgtagggtacccg

SEQ ID NO: 24552 - DNA, 855 bp, Homo sapiens
  misc_feature: GYAE6OF01B19IT.21.22.B11.1.454.CMB.1.raw
  modified_base (222)..(222): a, c, t, g, unknown or other
  misc_feature (222)..(222): n is a, c, g, or t
  modified_base (754)..(754): a, c, t, g, unknown or other
  misc_feature (754)..(754): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctccctcctcaccctcctcactcactgcgcagggtcctgggcccagtctgtgctgactcacgcccaccctcgacgccggtccgtcggggaccccccgggnacggaacgggtccaccatcttctttcgttcgtgggacgaccaacctccaaccgagtacggaaagtttaaactttagttacgttaatttcgttacggttactaccgaacgaccctaaccgttaccccgaaacgggtaaacgtaccccgggtaccccccctaaaaacttccccgttaaccgaacctacccggtaaaggaaacggttaaaacgtaaacgtcccgaaaccggtcccgggtcccccgttaacgggacccggggggtttcccctaacggggtaaccccttaacgttccccgttacgttccggtacccgttaccgaacggtttaccggtcccgggtaaccctaacccggttccaacccgttccccgttaccccggttaccgaaccccgttaactacccgggttacgggttccggggtccccggttaccggggtccgggtaaacggtggtaccgggtaaccggtccttaacggtaccgtttaacttaccggtgttaccgagtaccgttacggaccgggacaccgtaacgnggtacggataacgtaactagtcggtggacgggtttcggtcgggttcgggacgggacggtaacgggaaccctacggtacgtacccggttggcggttacccgg

SEQ ID NO: 24553 - DNA, 733 bp, Homo sapiens
  misc_feature: GYAE6OF01D1FV2.21.22.B11.1.454.CMB.1.raw
  modified_base (714)..(714): a, c, t, g, unknown or other
  misc_feature (714)..(714): n is a, c, g, or t
  modified_base (716)..(716): a, c, t, g, unknown or other
  misc_feature (716)..(716): n is a, c, g, or t
  modified_base (718)..(718): a, c, t, g, unknown or other
  misc_feature (718)..(718): n is a, c, g, or t
  modified_base (720)..(720): a, c, t, g, unknown or other
  misc_feature (720)..(720): n is a, c, g, or t
  modified_base (724)..(724): a, c, t, g, unknown or other
  misc_feature (724)..(724): n is a, c, g, or t
  modified_base (728)..(728): a, c, t, g, unknown or other
  misc_feature (728)..(728): n is a, c, g, or t
  modified_base (730)..(731): a, c, t, g, unknown or other
  misc_feature (730)..(731): n is a, c, g, or t
tcagtcgtcgctcgcacgaccggtgctcgatttagacgacagctcagggtcctgggcccagtctgtgctgactcagccaccctcagcgtcgtcgggaccccgggcagagggtcaccatctcttgttctggaggcaactccaacatcggaagtaattatgtattcgtggtatcagcaactcccaggactcgaccccaactcctcatccgagaaggaataatcgacgccggccctcgaccgggtccctcgaaccgtacttcctcgtacggtcctaccgtaagttccgtacggcctaccgttccacggtcccccttaccccgtacgaacccacgttaccgaacggttccggggtacccggttccccgggttacggaacgggtattagggaaccggtaccgttacgtaacgttttacgtttaaccgtgtacgtacctacggtaccgtacgggaaccgtaccaaacggttagggtacgtaacgtacgaaacgtaaacgttcggtacggtaacgggtttacgggtttcggggttcgggttaccgggaccggggtaacgggaaccgtaacgtccggtaccgttacgtacggtccgaacggtacccgacgtacccgtccgtcccctgtaccgtccgttccgtccctacccttcccgttaccctcccgttacctccgttacgttccgacggtcgaccggcgtacggcgtacgcgtatacgagngncncngacncacncnngc

SEQ ID NO: 24554 - DNA, 785 bp, Homo sapiens
  misc_feature: GYAE6OF01DJUSV.21.22.B11.1.454.CMB.1.raw
  modified_base (760)..(760): a, c, t, g, unknown or other
  misc_feature (760)..(760): n is a, c, g, or t
  modified_base (765)..(765): a, c, t, g, unknown or other
  misc_feature (765)..(765): n is a, c, g, or t
  modified_base (770)..(770): a, c, t, g, unknown or other
  misc_feature (770)..(770): n is a, c, g, or t
  modified_base (777)..(779): a, c, t, g, unknown or other
  misc_feature (777)..(779): n is a, c, g, or t
  modified_base (781)..(781): a, c, t, g, unknown or other
  misc_feature (781)..(781): n is a, c, g, or t
  modified_base (783)..(783): a, c, t, g, unknown or other
  misc_feature (783)..(783): n is a, c, g, or t
  modified_base (785)..(785): a, c, t, g, unknown or other
  misc_feature (785)..(785): n is a, c, g, or t
tcagtcgtcgctcgcacgaccggtgctcgatttagacgacagctcagggtcctgggcccagtctgtgctgactcagccaccctcagcgtcgtcgggaccccgggcaggaggtcaccatctcttgtctggagcaactccaacatcggaagtaattatgtattctggtatcagcaactcccgaggaacgtccggaccccaaactcctcactccgaaggagtaaataacgtcacggaccggtccccgtcggacggggttccctacggacctacttctccgtcggtcctaccgaacggttccgacggcctacctacgaccgtcccttccctacgaccacgtcgacggtcgggccgtccgggtaccgagtgtacggacgtcgtagtactttacgttacgtcgtcgacgtacgtaccggaacgggaccaacgaaacgtaggtgggaacttacgaacgttacgtacggttggggaacggtttcgggggtttgggttaccgggtaccggggaacggggtaacccggaaccgtaaccggttaccggtacccggtaccggttaacgggtcccgaaaccgtacccggaccggtccgtaccccggtccccggttaccggtaccgtaccccgttccgtttaccccggttccccgttcccccgttccccgtttacccgtttacccgttcccgttaccccgttaccggttaaccgggtccggggtaccggtcccgggaacggtaccggtacggaccccgtagtaaaccgtcgganacgtnacgtntacgacnnncngngn

SEQ ID NO: 24555 - DNA, 900 bp, Homo sapiens
  misc_feature: GYAE6OF01A40R9.21.22.B11.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagacgacagctcaggggggggaatctcagcttcagctgtggtagagaagacaggactcgaggacaatctccagcatggccggcttcctctcctctcaccctcctcactcactggcgctacgggtcctgggccctagttctggtcgtcctgacctcacgtcccctacccgtcgacggtccggttccggtacccgggggaccccccggganagggtaccgggtcccaaccgttagttccgttacgtttacggttccggtacgggaaccgtacctaaacccttaccgaaaacgtacgttaccggggtaaactttaagtttaacgttcgttacgtttaccgttacggttaacttaccggaaccgtacctaaaccccgttaccccggaagggtaaccttccccgggaaacccccttaaactccgtaccaacggtccaaagggtactaaactaacgtcaacccgggtccgtacccgtacgggaccggttccacgacgttctacgtcgttacggacctacgacgttcgtcggacctaccgttaccgaccgtaccccgtactaacccgaccgttcgtaaccggtcggttacccgggacccggtccgggtaacccggtaaggcccgtttaacggacggtttacgtaacggtttaccgttaaccggtttacgttccggaacggtaacccgttacccggtaacggaaccccgggtacgaaccgtacgtaagggttacgtaacggttaaacccgagttaacccggtgggtaacggggttccggttacgggggttacgggttaccgggtacccggtaacgggtaacccggtaaaccggttaccgttacccggtaacccggttcgtaaccggtaacccggg

SEQ ID NO: 24556 - DNA, 787 bp, Homo sapiens
  misc_feature: GYAE6OF01AP2DN.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgagggtcctgggcccagtctgtgctagactcagccacctcagcgtcgccggggaccccggnacgacggtcaccagtctcttgttcctagggacgcctaacctccaacgtacgtacggaaagttaatagttgttaacttcgtggtaactcgacgtcgaaccctccgaacggtaacgttaccggaaccccctaaaccgtcctaccgacgttacccgaaacgggtaaggaaaactttaaccgtcccgaacgggtaccccggtccccgtacgggtaaccgggggttccccgtacggtaccccgttactttccgttccgtacgggtacccttaccgtaacggttcccgttggaacccgttaccctacgtaacccgtcccttcccgacgtaccctaagtccggtacgggtcgggcccgttacccgggtaacccgtaggggtacctaggggtaccgtccgtttaacggtcttaacgttaaccgtgtaacgtcgtacgtccgggaaccgggtaccgacgtaaaccggtaggttacgggacggtacacgttaacgtccgtggggtaagtcgggggtttacggggtcgtacggggacgggtaaaccggtaaccgttaggtcccgtaaaccggtcgtacggtacccgg

SEQ ID NO: 24557 - DNA, 635 bp, Homo sapiens
  misc_feature: GYAE6OF01DI6IK.21.22.B11.1.454.CMB.1.raw
  modified_base (255)..(255): a, c, t, g, unknown or other
  misc_feature (255)..(255): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctccaccctcctcactcactgcgcagggtcctggcccagtctgtgctgactcagccaccctcagcgtcgtcggaccccggcagagggtcacatctcttgttctggagcaactcaacatcggaataattntgtattctggatcagcactccaggatccggaccccaatcctcatccagagaatancngcgccctacgagggtccctgacctnttcctcgtcgcctaccgacgtcgtcggcacccgttnaccggtccccttccctagaaccctactaccgtaggttcccgggtcccttacccgggtacgagggtacgttcgggaacgtccgtagtaaccctttggttaaccctgggtcacctaacggtccgaacgggtcccgaacgtaactagttcgggactacgacctaaagttccggaccggtagggttacccggggttggggttaccttccgggggaacgggtaaccggaacccttaaacggtggtaccccgtacgttacggacccgg

SEQ ID NO: 24558 - DNA, 844 bp, Homo sapiens
  misc_feature: GYAE6OF01ACUQ0.21.22.B11.1.454.CMB.1.raw
  modified_base (56)..(56): a, c, t, g, unknown or other
  misc_feature (56)..(56): n is a, c, g, or t
  modified_base (122)..(122): a, c, t, g, unknown or other
  misc_feature (122)..(122): n is a, c, g, or t
  modified_base (242)..(242): a, c, t, g, unknown or other
  misc_feature (242)..(242): n is a, c, g, or t
  modified_base (261)..(261): a, c, t, g, unknown or other
  misc_feature (261)..(261): n is a, c, g, or t
  modified_base (542)..(542): a, c, t, g, unknown or other
  misc_feature (542)..(542): n is a, c, g, or t
  modified_base (614)..(614): a, c, t, g, unknown or other
  misc_feature (614)..(614): n is a, c, g, or t
  modified_base (728)..(728): a, c, t, g, unknown or other
  misc_feature (728)..(728): n is a, c, g, or t
  modified_base (740)..(740): a, c, t, g, unknown or other
  misc_feature (740)..(740): n is a, c, g, or t
tcagtcgtcgctcgcacgaccggtgctcgatttagacgacagctcagggggggaanctcagcttcagctgtggtagagaagacaggactcgaggacaatctccagcagtggccgtcttcccnctcctcctcaccctcctcgactcactgccgcgacgggtcctgggcccagtctgtcgctgactcgacgcccacctcaggccgttcggaccgggacccccgtagacggtacggtcctacctnttccttcgttggttaccgngggaacgcctaaccctacaaacgtacggtaccgaaagttaacttagtacgttacgtttagtacgttactcgtaacaccgaacctaccgaacgggaacctaccccggaacccctaaacctccgtacctaccgttaaccggaaggtaaacgtaaacgtaaccgttaaccgccggtaaccggtccccggtaccggtaaccggtcccgtaacggtaacccgttacgtttccgaccggttacctaccgttaccgtaacggtcgtaccgtacccgaccgttaacccncccggtcccctaaccgttcgaaccgttaccgtaaccgggttccgtaacccgggttcccgggttaaccccggngggtttaaccgtacgaccgggtagtaacccgttagtacgtttaaccgtcgttacacgttccaccgttaaccggaccggtaaccgtaccaaaggtccgtaggtaaccggtaaacncgggtttaaacnggttaacggttccgggttgggtcggtttaaccgggcggggtaaaacgtcccggtaaaaccggtaccctaaccggggtccgtaaaccggttgggtaaacccccgg

SEQ ID NO: 24559 - DNA, 692 bp, Homo sapiens
  misc_feature: GYAE6OF01D2WG4.21.22.B11.1.454.CMB.1.raw
  modified_base (587)..(587): a, c, t, g, unknown or other
  misc_feature (587)..(587): n is a, c, g, or t
  modified_base (602)..(602): a, c, t, g, unknown or other
  misc_feature (602)..(602): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
  modified_base (666)..(667): a, c, t, g, unknown or other
  misc_feature (666)..(667): n is a, c, g, or t
  modified_base (673)..(674): a, c, t, g, unknown or other
  misc_feature (673)..(674): n is a, c, g, or t
  modified_base (677)..(677): a, c, t, g, unknown or other
  misc_feature (677)..(677): n is a, c, g, or t
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
  modified_base (690)..(690): a, c, t, g, unknown or other
  misc_feature (690)..(690): n is a, c, g, or t
  modified_base (692)..(692): a, c, t, g, unknown or other
  misc_feature (692)..(692): n is a, c, g, or t
tcagtcgtcgctcgcacgaccggtgctcgatttagacgacagctcagggtcctgggcccagtctgtgctgactcagccaccctcagcgtcgtcgggaccccggcaggagggtcaccatctcttgttcgtggaggcaactccaacagtacggaaagttaattatgttatttcgtggtatcgacgacctaacctcccgaaggtaacgtccggaccccctaaacttccctacacgtaccgaaggaacggtaaattaacgtaccgacggtcccggtaccccgtacgggtacccggggttccctacggtacccgtctttccgtccggttcggccttaaccgtacggttccgtacggaccctaccgtccgaccgtcccctacccgcgaccgtacgtcgtacgggtccggtcccggttccgggaccggagggtcgtacggacggtctaacgttactttaacgttcggttggtccacgtaccggacggaaccgggtaccgaactaaggtacgggtaggacgtaacgtaacgtaacgtcggtacggggtaccgggcggggtaacgtacgggtacggaacgggactaacgaagggtnacgtcgagttcccgngagcgcgtcgacgtgcgcgtacgtcgtcgcgtcgcgtcngngtatcgcgtcgcngngtcgtcgnngtcganngtngcgtcgngncngngn

SEQ ID NO: 24560 - DNA, 827 bp, Homo sapiens
  misc_feature: GYAE6OF01AHGRR.21.22.B11.1.454.CMB.1.raw
  modified_base (209)..(209): a, c, t, g, unknown or other
  misc_feature (209)..(209): n is a, c, g, or t
  modified_base (251)..(251): a, c, t, g, unknown or other
  misc_feature (251)..(251): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccggnaggacggtccaccatctcttgttcgtggacgacaactccaanagtacggaaagttaatttagtgttaactttcgttaggttactcgaacgtacctaaaccgttccccgaaagggaaccttaccgggaaccccccctaaaaccgtccccttacacgtacccgaaggtaacggtaaacttaaacgtaccgaacggtccccgggtaccccgtacggtaccgggggttacccctaggtaacccgttagtttcccgtacggttcggtacccttaccggtaaaccggtttccgtacccgggtaccctaaccccgtcgtaaccccgggttcccttacccccggttacggtaaccctaccgttccggtaacggggttccggggttaccccgttacccggggtaccggtaagggtacgtccggggaacggttcccgtaacggtttaacctttaacgttcggttcggtacgtaccgtaacgtacccgggaacgggaccgtacaaacggtcggttacggaatacgaccttaagtccggtaggtcggggttacgggtttgggtaccggttaccgggcgggtaaaccggtaccgtaacgttacccgggtacccgttacggtcggtaaccgg

SEQ ID NO: 24561 - DNA, 327 bp, Homo sapiens
  misc_feature: GYAE6OF01D1COY.21.22.B11.1.454.CMB.1.raw
  modified_base (262)..(262): a, c, t, g, unknown or other
  misc_feature (262)..(262): n is a, c, g, or t
  modified_base (310)..(327): a, c, t, g, unknown or other
  misc_feature (310)..(327): n is a, c, g, or t
tcagtcgtcgctcgcacgaccggtgctcgatttagacgacagctcagggggtccctgaccgattctctggctccaagtctggcacctcagcctccctgaccatcagtgggctccggtccgaggatgaggctgactattactgtgcatcgacgggacgacaacatgggatgacaatctgagtcggttggtgtcggcggaggaccaaacgtcgaccgtcgtaggtcacgcccaggcctcgccccctcgtcactctccgtccccnccctcctcctcgtctctactgacggcggctcggacgaggcacatagcnnnnnnnnnnnnnnnnnn

SEQ ID NO: 24562 - DNA, 685 bp, Homo sapiens
  misc_feature: GYAE6OF01AOIHM.21.22.B11.1.454.CMB.1.raw
  modified_base (172)..(172): a, c, t, g, unknown or other
  misc_feature (172)..(172): n is a, c, g, or t
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (459)..(459): a, c, t, g, unknown or other
  misc_feature (459)..(459): n is a, c, g, or t
  modified_base (586)..(586): a, c, t, g, unknown or other
  misc_feature (586)..(586): n is a, c, g, or t
tcagtcgtcgctcgcacgaccggtgctcgatttagacgacagctcagggggggaaggcgtcagcttcagctgtggtagagaagacaggactcaggacaatctccagcatcggccggtcttcctctcctcctccaccctcctcactcacgtgcgcgacggtccgtcgggaccngttcgtgttgctcgaactcacgcctaccnctcggaccgtcgccggggaaccccggtnaggtaccgggcacctatccgttctttaggtcgtacgggacgtacctaactaccgaagtcgtacggtaagtaattagtcgttagttcttggtactactaggactaccgaccgtaggaacctccggaaacccctacctccgtacacctcgaaggtacaagtactacgacgccgtaccgcgtaccggtcgtaccgacttctctcgtcgtacctgtacgtcgaccgtctacccncgtaccgtcctacgtaccgactaccgtacgcggtacggtcgcgggtaccgtaagtcgacgtcgactacgtgtactacgtctacgtccgtaagccggtacggacgtaacgacggtacgacggttaacnccgggaacttcgaacggttcggtaacggttgggttacgggtcggttacgggtacggaaccgtacggtaccgtaaccggaccggttggcggttaacccgg

SEQ ID NO: 24563 - DNA, 627 bp, Homo sapiens
  misc_feature: GYAE6OF01BVEPB.21.22.B11.1.454.CMB.1.raw
  modified_base (211)..(211): a, c, t, g, unknown or other
  misc_feature (211)..(211): n is a, c, g, or t
  modified_base (397)..(397): a, c, t, g, unknown or other
  misc_feature (397)..(397): n is a, c, g, or t
  modified_base (528)..(528): a, c, t, g, unknown or other
  misc_feature (528)..(528): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctgggcccagtctgtgctgactcagccaccctcagcgtcgtcgggacccccggnagagggtcaccatctcgttgttctgggagcaactccaactagtacggaagtaattagtagttattcgtggttatctagcctaacctcccaaggaatccggacccccaactcctcatccgagagaatactcacgccggccctcgacgggtcctagaccgtacttctcgtggcctaccgaagttccgnggtacctacctacgaccggtcccttcctacgacctactcgacgggttcgggccgtccgggtcgaggtactgggacgtctcggacttagtacctgtcgacagtccgacgggtaccacgaactggtagggacnggtaactacgttcgtaggtacgggttcgggttaggggtccggttacgggacgggggtaaccgaaccctaacggtccgacccggttacgtcggtaacccg

SEQ ID NO: 24564 - DNA, 737 bp, Homo sapiens
  misc_feature: GYAE6OF01CB2V3.21.22.B11.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagacgacagctcagggggggggaagctcagcttcagctgtggtagagaagacaggactcaggacaatctccagcatggccgcttccctctcctcctccaccctcctcactcactcgcgcgacgggtccgtcgggcccagtctgtgctgactcacgccaccctcgagccgtcgtcggggacccccggnacggagggtcaccattcttcgttgttcgtggacgcaactaccaacagtacggtaaagttaattatgttaacttcgtggtatcagactaacctaccgaggaactccggaaccccctaacttccctacactaccgaagaacgtaataactacgacggtccggtaccctacggtaccggggttccctacgggaacccgtacgtttccgtacggtccggtaccgttaccgtaaacggtccgtacggaccctacccgtcgaccgttcccctacccgtcgaaacctcgttaaccggacggggttccggtcccggtacccgggtacgagggtactacgggtacggtactacgttaacgtttacttacggttcgtacgacgtacggtaccgggaacggtccaacgaacgtggtacgggactaacggaactagtacgaggtcgggttcggggttggggtcgggttcccgggaacgggtaaccggtaaacgttaaccgtaccggacccggttacgtcgggtaacccg

SEQ ID NO: 24565 - DNA, 778 bp, Homo sapiens
  misc_feature: GYAE6OF01BYDGB.21.22.B11.1.454.CMB.1.raw
  modified_base (694)..(694): a, c, t, g, unknown or other
  misc_feature (694)..(694): n is a, c, g, or t
tcagtcgtcgctcgcacgaccggtgctcgatttagacgacagctcaggggggggaagctcagcttcagctggtggtagagaagacaggactcaggacaatctccagcatggccggcttccctctccctcctcaccctcctcactcactgccgcgacgggtcctcgggcccagtccgtgtcgctggacctcaacgccctaacccctcacgtccgtccggtccggggacccccccggtagaacggtacgggtaccaaccgtacttccgttccgtttgtttaccggtacgggaacggtacctaaacccgtccgaaaaccgtacgtaaccgggtaaagtttaattacgttacgttaagttactggtaactacacgtacctaacctaccgtaaggtaacgtcccggaaccccctaaccttccctacgcgtaaccgaaggtaaagttaaactacgtacgaccgccgggtccctacgggtaccggttcccgtagaccgttattccctcgtccggtactacgtaacgtccgtacgccctactaccgacgtcccctacccgataacccgtacgttaccgcgggttaccggtccggtacccgtacggacggtaacgtcggacgttctacggttacttacttaccgttgtaccgacgtaacgtacggaacgtccgtagaacgtgggaagtcgtaacgattaccgnggtacggtccgggttgggttacggtaccgggttcggaaccgggaacggtaaccctagggtacccaacgggtcgtcggtaaccgg

SEQ ID NO: 24566 - DNA, 868 bp, Homo sapiens
  misc_feature: GYAE6OF01DVKGA.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctgggcccagtctgtgctgactcagccaccctcagccgtcgtccggggacccccggctaggacggggtccaccgtacttccttctttcggttaccgtgggaacggaccaaccttaccaacaacgttacgggtaaagttaagtttacttaggttacttaccgttggtactacgacggacctaacccgtccccgaagggtaaacgtccccgggaaccccctaaaacctttcccgtaacctacgttacccgaaaggaacggtaaactaacctacgaacggtaccccggtcccgtcggtaaccgggggttccctacggaccgttacttccgttcgtcggtacctaccgtaacggttcctcgggtaccctacccgtaccgaccccggtcccttaccccgtaccgtaaccccgtacgttaccggtaacggggttcccgggtcccggtttacccggggtaccggtacgggtacgttacggggtaaccggtaccgtttacgggttaacctttaacggttttaacccgtcgggttaacgtaccgttaacggttaacccggaaccgggggttaaccgaaccgtaacggttaccggaggggtaacgtacgtaaaccgtacggttacgggtacgggtacggggtttacggggtttcggggttacgggtaccgggtacgggaacggtaaccgtaacgtcggtaccggtaccggtgtaacccggg

SEQ ID NO: 24567 - DNA, 910 bp, Homo sapiens
  misc_feature: GYAE6OF01BRUC4.21.22.B11.1.454.CMB.1.raw
  modified_base (59)..(59): a, c, t, g, unknown or other
  misc_feature (59)..(59): n is a, c, g, or t
  modified_base (889)..(889): a, c, t, g, unknown or other
  misc_feature (889)..(889): n is a, c, g, or t
tcagtcgtcgctcgcacgaccggtgctcgatttagacgacagctcgagggggggggaanctcagcttcagctgtggtagagaagacagggactcaggacaatctccagcagtcggccggtccttccctctcctcctccaccctcctcactcactcgcgcgtacgggtccgtcggggaccctgtcgttggtgctcgtacctccaccgacccacccgttacacggccggttcccggcccggggggaccccccggagacgggtacgggttccaaccgtacgttcctttcgtttcggttcggaacgggaccggtaacctaaccacctaaagtaccggttaacggttaaaagttactttattaggttaacgtttacggtacggttactacgtaccgtacctaaacccgtcggaaacggtaaccccgtaccgaacccccttaacgtacccgtacctacggtaaccggaagtaacggtaaactacgtccggaaaccgggcccgttacccggtaccggggtaccggttaccgaaccggtttaccgtcgtttcccgtaaccgtcggtaccgttaaccgaggttcccgtaccggtacccgtaacccgtcccgtacggttacccccctccgggttaccgaaacccggtttcggaaccccgggtttcgggggtaacccccggggtttccggtaccggggttaacccggggtaaggtaccgggtgggttaaccggttaccgtacgttttaacgtaacggtttctacgggttaccgtaccgtacggggtaaccgggcggtaaaccgttccggaagttccgggaaggttcccaaagtagtcggtaggttcggtagggtcgggggtggtcgggaccgggtaagtacccgggtaagccgggtttanacccgggttgaccgttccggg

SEQ ID NO: 24568 - DNA, 769 bp, Homo sapiens
  misc_feature: GYAE6OF01CICO5.21.22.B11.1.454.CMB.1.raw
  modified_base (56)..(56): a, c, t, g, unknown or other
  misc_feature (56)..(56): n is a, c, g, or t
  modified_base (118)..(118): a, c, t, g, unknown or other
  misc_feature (118)..(118): n is a, c, g, or t
  modified_base (122)..(122): a, c, t, g, unknown or other
  misc_feature (122)..(122): n is a, c, g, or t
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (666)..(666): a, c, t, g, unknown or other
  misc_feature (666)..(666): n is a, c, g, or t
tcagtcgtcgctcgcacgaccggtgctcgatttagacgacagctcagggggggaanctcagcttcagtctgtggtagagaagacaggactcgaggacaatctcagcatgcgcttcctntccnctcacctctacactcactgcgcgtacgggtcctgggcccaggtctagtcgctacgactcaccgcctacctcgacgtccgtcggtaccggggacccccggnaagggttacggctaacctnttccgttgttcgtcgtaggacgactaactccaaaagtgtacgggtaaattaattagttacgttacgtttcgttaggtactaccgtacgacccgtaaccgttacccgaaacgggttaaccgtacccggaccccctaaaaccttccggttaacctacctacggtaacggaaaggtaaacttaacgacggaaccgtccgggtaccccgtacggtaaccggggtttccctaccgtaaccggtactttccggtccgcgtaccgtaacgtaacgtccgtacggaccctaccgtacgtcccgtacccttaccggtctaaccgtaccgtacggacggttcgggtacccgtccggtaacgggagtacggtacggacggccttacggtaacttaccgttatacgcgtacgacgttacggaccgtacaccgtaagngtacggtaagcctaaggtacctgtacggtcgggtacgggttgggtaccggtcgggaacgggtaaccgtaccgaaactcgggtacctaccggttgtaaccccgg

SEQ ID NO: 24569 - DNA, 783 bp, Homo sapiens
  misc_feature: GYAE6OF01DF3SH.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctctcaccctcctcactcactgcgcgagggtcctgggcccagtctgtgctgactcagcccaccctcagccgtcgtcggggacccccgggnaggacgggtccacctatccttcgttcgttcgtgggacggtaccaaacctccaactagtaccggtaaagttaattagtgttattcgtaggtatcacgtactaactacccgaaggtaacctcccggaaccccctaaactttcctacctacgtacccgaaggtaacggtaaaattaacgtaccgacggcccggtaccctacggtaccggggttccctacggaacccgttagttcctcgtcgggtcctaccgtaagtcgttacggacctacccgtcgaccgtcccgtaccctacgaccacgttacgacgggtccgggtaccgtcccgggtacggaggtacgtacggacggtctacgtaacgtttatttaccggtggttacgccgtagttacccggaacccggggtacgtaccgaaacggtacggtaggggtacttaacgacgtaccgttacggttagggtacggggttacggggttttcggggtcgggtttacccgggggaaccggggtaaccgggttaaaccccaaacgggttcccgggttaaaccccggttccgggttacggaaccccggg

SEQ ID NO: 24570 - DNA, 804 bp, Homo sapiens
  misc_feature: GYAE6OF01DOAPT.21.22.B11.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagacgacagctcaggggggggaagctcagcttcagctgtggtagagaagacaggactcaggacaatctccagcatggcccggcttccctctcctcctccaccctcctcactcactgcgcagggtcctgggcccagtctgtgctgactcagccaccctcagtcgtccgtacggggaccccccgggnaacgggtacgggtccaacctacttcttccgtttcggttccgtagggacggacctaaccacccaaacctaggtaaccggtaagttaaatttaataggttactttccgttagggttacttacaacggtacaaaccttccccgaaggtaacgtcccggaacccctaaccgtccttacactaccgagaaggtaaactactacacggacccggcctacggtaccgggtcccgtacgaccggttactccgttcgtcggtaccgtaccgtaacgttcggtacgggtacccaccgttaccgaccgttccctaccccgtaccgtaacctacctcggtacggttccgggtcccgtcccgggttaccgggaggtactacgggtacgccgtacggttacttaacgttacgttcgtcgtcctaacggtccggacgggtaccgtaacctaacgtagtacgggtaacgttacgaacgtaacgtacggtacgggtagggttacggggttcgggttccgggttaccggggtacggggtaacccgggttaacccgtaaacccgggtaccgttaaaaccgggttccgttaacggtaaccccgggg

SEQ ID NO: 24571 - DNA, 929 bp, Homo sapiens
  misc_feature: GYAE6OF01CQXDQ.21.22.B11.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagacgacagctcgaagggggggggaagctcagcttcagctgtggtagagaagacaggactcaggacaatcctccagcatggccggtcttccctctcctcctccaccctcctcactcactgcgcgtacggggtccgtcgggccctagtctggtgctcgacctcacgccccaccctcgacgtccggtccgtccggggaccccccgggngacggacggtcaccacttcttcgtttgtcgtacgggagtcaacctaccaacaagtacggtaaagttaaatttagtagtttacgtttcgtaggttaactacgacgtaacctaaccctacccggaaggttaaccgaccccggtaacccccctaaccgttaccctaccgtaaccgtaccggtaagtaacgggtaaaacttaacgtaccggaccgccccgggttaccccgtacgggttacccgggttccctccggttaaaccgttctttccgtccgtacggtcctacccggttaacgtccgtaccggacccacccgttacccgaccgttaccccgtaccccggtacgtaaacccggtccgtttaacggaaccggggtttccccggggttacccccgggtttacccgggaacggggtaacgggttacccggtaacgggtacccggggttaacccttagggttaacccttttacggtttacccggtaagggttaccgggacctaaccggtaacccggggtacggtaaccgaaacgttaaccgggaaggtacggtaaagttacccgtaaaggtaccgttacgggttagggttacggggtggggtttttaggggttccccggggttacggggaaccggggtaaaccggttaaccccgaaaggtcccgggtttacccgggcgttaacccggggtacccg

SEQ ID NO: 24572 - DNA, 746 bp, Homo sapiens
  misc_feature: GYAE6OF01DOG40.21.22.B11.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagacgacagctcgaggggggggaagctcagcttcagctgtggtagagaagacaggactcaggacaatctccagcatggccggcttccctctcctcctccaccctcctcactcactgccgcgacgggtcctgggcccagtctgtgctgactcacgcccaccctcacgtccgtccggtccggggaccccccgggngacggtacgggtccaaccctattccttcgtttcgttcgtggacggaccaacctaccaaacgagttaccgggtaagttaaactttagttgttaacgtttcgttaggttactcgaacgaccaaccgttaccccgaaggtaacttcccggaacccctaaactccctacactaccgaaggaacgtaaactaactcgacggcccgtacccgtacggtaccgggtcccgtaagaccgtacttcgtcgtacggtcctacctacgtcgtcgcctacctccacgtccctccgtcaccgagtacgtacggtccggtccgtccggtaccgaggtacgtcggacggtactacgttacttacgttacgtgtacgacgtacgtaccggacgggaacgaccgtaacgtacgggtaggtacgtacgtaagtcttacggtaggttcggggtcggggtttggggttcgggtaccgggtacgggttaaccggtaaaccgttaaaccggtccggtaaacccggtccggtcggtaacccgg

SEQ ID NO: 24573 - DNA, 926 bp, Homo sapiens
  misc_feature: GYAE6OF01AYSYA.21.22.B11.1.454.CMB.1.raw
  modified_base (228)..(228): a, c, t, g, unknown or other
  misc_feature (228)..(228): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactcgcgcgacgggtcctcgggccctagtctgtgtctagtacctcacgcccaccctcacggccgtcggtcccggggacccccggngaaggacgggtaccacctattccttcgtttcgttcggtacggacggacctaaaccgttaccgaacacgttaccggtaaagttaactttaggttatttacgttcgttaggttactacgacgtacctaacccgtacccggaaggtacctaccccggaaccccctaaacctcccgttaccgtaacttacccgaaggaaacggtaaacttaacttaccggaaccggtccccgggacccgttaccgggtacccgggggttaacccctacggtaaacccgtttaccgtttcccgttaccggtcggttaaccccttaaccgggttaaccgttcggtaacccggtcccctaaccccgttacgtaccccttccccggtttaccaaccggtaaccccttagtccgggtaccgggttcccggtcccgggttaccgggtaccgtacggggtacctacggggtaccgtaccgttaagtaccgtttaacgtttcggtacgtacgtaacgttacccgggaacgggtacccggtaaccggtaaaccgtaggtaccgggttaaggtaacgttaacccgtaacgggtttaccgtacggttaacggggggttccggtttaccgggggtttaacgggtcccgggttacgggggaaccggtttaaacggggaaccccgttaaggttccccggtacccgttaggttaaccgggaccccgg

SEQ ID NO: 24574 - DNA, 1056 bp, Homo sapiens
  misc_feature: GYAE6OF01CPCOI.21.22.B11.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcgagggtccgtcgggcccagtctgtcgctcgactcacgcccaccctnacgcgtccgtccggggacccccgggngaggacgggtccaccgtacttccttcgtttgttcggtggacggacctaacctccaaacgtagttacggtaaagtttaattagttcgttacttcgttacggtatccgacgacctaacccgtaccgaaggtaaccgtccccggaaccccctaaaccttcctaaccgtacctaccggaaaacgggtaagttaaaacctaacgttaccggaacggtccccgggtaacccccgtacgggtaacccgggggttaccccgttaccgggtaacccgtttaccgtttcccggttaccggttaccgggtaccccgttaaccgttaacccggggttcccgttaccgggtaccccctaccccggttaccgttaaccccgggtccccccttacccggtaacccgtaacccgttaaccgggttaccgggtaacccggggtttaccccggggttaccccgggtacccggggtaaacccggggttaacgggttaaacggggtccgggggtttaacccggttaaccgggttaaaccggttttaaccgttttaaaccgggttttccccggtaagggttttaccccgggaacggtttaaaccccgggtacccgggggtaaacccggttacccgggtaaaccgtaaacgggttaacgggttacgggttaaccgttaaacgggtaacttaaaccgggttccggggtaaacgggttccggggggttacgggtttttaacgggggggtaacccgggtttacgggggaaacccggggttaaaccccgggtaaacccttaaacccggggttacccggtttaaacccccgggttcgggtaaacccgggtaacccccggg

SEQ ID NO: 24575 - DNA, 795 bp, Homo sapiens
  misc_feature: GYAE6OF01DELYV.21.22.B11.1.454.CMB.1.raw
  modified_base (122)..(122): a, c, t, g, unknown or other
  misc_feature (122)..(122): n is a, c, g, or t
  modified_base (159)..(159): a, c, t, g, unknown or other
  misc_feature (159)..(159): n is a, c, g, or t
  modified_base (191)..(191): a, c, t, g, unknown or other
  misc_feature (191)..(191): n is a, c, g, or t
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
tcagtcgtcgctcgcacgaccggtgctcgatttagacgacagctcaggggggggaagctcagcttcagctgtggtagagaagacaggactcaggacaatctccagcatggccggcttccctntcctactcaccctcctcactcactgcgacagggtccngggcccagtctgtgctgactcacgccaccctnagcgtcgcggggacccccgnagcggtcaccngtctcttagtcnggacgacaactccaacagtacggaagttaattatgttaacttcgtaggtactcgacgtaccaacctcccgaaggaaccgtaccggtaacccccaaaccttcctacgaaccgtacaacggtaaggtaaacgtaactacgaaccggcccggtaccctaccgggtaccggggtacccttacggtaacccggttactttcccgtaccggtacgtaccgttaacccgtaaaggtcccggtttaacggaccctacccggtacctaacccggttcccctaaccgttaccgaacccgttaactaccgggtaaccgggttcgggtacccgttacccgggtaaccgggaaggtacgttaccgggagtacgtacgttaacgttaacgtactgttacgacctagtaacccggacggggaacctacgaaaccgtggtacggagtaacgtaaccgtacgtacggtacggtcggggttaccggggttttaggggtaccggtttaaaccggggcggggtaaaccgtaaacccggtaaaccggttacggtaacccgtaccgggttacggaaacccggg

SEQ ID NO: 24576 - DNA, 728 bp, Homo sapiens
  misc_feature: GYAE6OF01EH4JF.21.22.B11.1.454.CMB.1.raw
  modified_base (242)..(242): a, c, t, g, unknown or other
  misc_feature (242)..(242): n is a, c, g, or t
  modified_base (710)..(710): a, c, t, g, unknown or other
  misc_feature (710)..(710): n is a, c, g, or t
  modified_base (712)..(716): a, c, t, g, unknown or other
  misc_feature (712)..(716): n is a, c, g, or t
  modified_base (719)..(720): a, c, t, g, unknown or other
  misc_feature (719)..(720): n is a, c, g, or t
  modified_base (722)..(723): a, c, t, g, unknown or other
  misc_feature (722)..(723): n is a, c, g, or t
  modified_base (725)..(725): a, c, t, g, unknown or other
  misc_feature (725)..(725): n is a, c, g, or t
  modified_base (727)..(727): a, c, t, g, unknown or other
  misc_feature (727)..(727): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctgggaggcaactccaacatcggaagtaattatgtattctggtatcagcaactcccaggaatcggcccaaactcctcatccagagaataatcagcgcctcgacgggtccctgaccgtnttctcgtcgcctaccgaacgtctcggaccacctccgacgccctcccgtcgtaacccacgtaccgaggtcgggtaccgtccccgggtccggacggtaggtacggaggtccgttaggtaaccgttaactttacgttggtacgacgtacgtaccggaacggggaaccgtaaacgaaaaagggtcgggtaacgtacgaaactaacggttacgttacgggacggggttacgggggttacgggttacggggtaccgggaacggggaaccgggtaaaccctaaacggtaccggtacccggtaccgacgggttaccgaccgtaaccggaccggtccgtccccggtaccccgtccggttcccgtaaccgttcccgttcccgttaacccccgtccccgtttcccgtacccgttcccgttaccgtacccgtaccggcgggtaccgtcgtacggtaccgaacgggtcacgtagtacgtcncnnnnngcnnanngngng

SEQ ID NO: 24577 - DNA, 682 bp, Homo sapiens
  misc_feature: GYAE6OF01D0BF0.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcgagggtcctcgggcccagtctgtgctgactcacgcccaccctcacgcgttccgtccggggacccccggcgaggacgggtccacctatccttcttcgttcgtggacgacaaccgtaccaaaagtacggtaaagttaattagttgttaactttcgttagtatacgtacgacctaacctacccgacggtaacgtcccggaaccccctaactccctacactaccgaagaacgtaataactcgacggcccgtaccgtacggtaccgggtcctacgtaccgtacttcgtacgtcgtactaccgtacgtccgtcgacctacctaccgccgtccctccgtacgacctacgtcgtacgggtccggtccggtccggtacggtacggtacgtacggcgtacgtacgtacttatcgtgtcacgacgtacggacggacgacgagtacggtagtacgagtactagtcgtaggtcgggtcgggttcgggtcggttacgggacggtacggtaaccgtacgtaccggaccgtacggtcgtcgacccgg

SEQ ID NO: 24578 - DNA, 964 bp, Homo sapiens
  misc_feature: GYAE6OF01E2RE7.21.22.B11.1.454.CMB.1.raw
  modified_base (213)..(213): a, c, t, g, unknown or other
  misc_feature (213)..(213): n is a, c, g, or t
  modified_base (468)..(468): a, c, t, g, unknown or other
  misc_feature (468)..(468): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctctcactcactgcgcagggtcctgggcccagtctgtgctgactcacgccaccctcagcgtcgtcggggacccccgggnacggacgggtcaccattcctctttgttcgtgggacggcaacctccaaactagtacggtaaagtaatttagtagttaattcgttagggttaacttcacggtacctaacctaccccgtaagggaaactccgggaacccccctaaaacttcccgttacaaccgttaccaagggaacggtaaacttaactaccgtacggaccccggtaccccgtcgggtaaccgggggttcccctacggtaacccggtaacttttcccnccggttacgggtaccctaccgtaaacgggttctacggggtaccctaacccttccgacccggacccctttaccccggaccgtaacccgtacttaccggaacggggttcgggttaccccgggtccgggtaaccccgggtagggaaccgttaggaccgggttacgtaaccgtaacggttttaaactttaacccggttcgggtttaacggcccctttaaagggtaccccgggggtaaacccgggttaaccgtaaaccccgggttaaacgtacggggttaaacggggttaaacaaccccgggttaaacgtaaaacggttacccgggttaacggggggtaaaccgggggtttcggggggtttttaccggggggttaccggggtttaacccggggggggaacccgggggttaaaacccgggggtaaaaccccggaaacccgggttttaccccggggtaaaccccggggtttacccgggtaacccggggttaaaacccccgggg

SEQ ID NO: 24579 - DNA, 742 bp, Homo sapiens
  misc_feature: GYAE6OF01DQJNG.21.22.B11.1.454.CMB.1.raw
  modified_base (84)..(84): a, c, t, g, unknown or other
  misc_feature (84)..(84): n is a, c, g, or t
  modified_base (216)..(216): a, c, t, g, unknown or other
  misc_feature (216)..(216): n is a, c, g, or t
  modified_base (688)..(688): a, c, t, g, unknown or other
  misc_feature (688)..(688): n is a, c, g, or t
  modified_base (724)..(724): a, c, t, g, unknown or other
  misc_feature (724)..(724): n is a, c, g, or t
  modified_base (732)..(732): a, c, t, g, unknown or other
  misc_feature (732)..(732): n is a, c, g, or t
  modified_base (740)..(742): a, c, t, g, unknown or other
  misc_feature (740)..(742): n is a, c, g, or t
tcagtcgtcgctcgcacgaccggtgctcgatttagacgacagctcagggtcctgggcccagtctgtgctgactcagccaccctnagcgtcgtcgggacccccggcagagggtcaccatcttcttgttctggaggccaactccaacatacggaagttaattatgtattctggtatcagacactccaggatcgacccaatcctcatccagagaatacncgagccgacctgacgggttcctagaccgtattccgtcgtggcctaccgtaagttcctacggtacctacctcgacgtccccttcccgtagacctactcggtacggttcgggacccgttaccccggcggaagtagtacggaacgtccttagtaaccgtttacttaccgtgtcgtactacgtaaccggtacgggacctaacgaacgtagggttaggtaactaccgtaaagttaaacctcggttaaaggtaccgggttttccggggttagggttaacgggttcccggggaacgggtaaacccggggtaaacaaccccggttttaccgggaaccccggtttacgggtaaaccgggttaccgaacccggtaaccggtacccggtaccgtttccccgtacccccgggttacggtacctacccgtttccgttaccccgttaccccttacccgtcccctttacggtaccgttctacgtacngggtacgcgtcgacggctacggctacgatcgagtcnctagcagntacagccnnn

SEQ ID NO: 24580 - DNA, 889 bp, Homo sapiens
  misc_feature: GYAE6OF01BX1H5.21.22.B11.1.454.CMB.1.raw
  modified_base (57)..(57): a, c, t, g, unknown or other
  misc_feature (57)..(57): n is a, c, g, or t
  modified_base (91)..(91): a, c, t, g, unknown or other
  misc_feature (91)..(91): n is a, c, g, or t
  modified_base (121)..(121): a, c, t, g, unknown or other
  misc_feature (121)..(121): n is a, c, g, or t
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgacagctcaggggggggaanctcagcttcagctgtggtagagaagacaggactnaggacaatctccagcatggccgcttccctntcctcctcacccctccctcacgtcacgtcgccgcggtacgggtccgtcggccctagttcgtggtcgcgtcgtaccncgaccgccccctacccgtgacggtccggttccgggaccccgggggaccccggngtaaggggtaccggtacccaaccttcgtttcctttacggttttacggttacggagggtaaccgaacccttaaacccgtaaccgaaacgttacggtaacgggtaaattttaaacgtttggttacgtttaacttcgggttaacgttactaccgaactacctacccgtacggaagtaaccgtaccccgaaaccccttacttccactacgtaccgaaggtaataaacttaccgacggaccggtaccccggtaccgttacggggtacccggttacccgacgtaaccgttcttaccgtcggtaccggaccttaacggtacgtttccggaccgtacccttaccgacgtaccccgtcccttacgaacgccgttaatccgggttcggggacccggtttcccgtaccggtaagacgggtttagacgggtcgtaacgttaacgttaactttaccgttaggtgaccggtacttaccgggacccgggaaccgtaacgtaaccgtacgggtacgggtacgtacgtaaacggtaccttacgggtcggttaccgggggttagggtttcggggggtccgtttaccgggggaccggaaacccgggtaaacccgtaacgttacccggtacccgggtcctttaacggggaccctacggg

SEQ ID NO: 24581 - DNA, 764 bp, Homo sapiens
  misc_feature: GYAE6OF01E35Y4.21.22.B11.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgcccacccgtcagccgtcgtccggggacccccgggnaggacgggtccaccatccttcgttgttccgtgggacggaccaacctaccaaacacgtacggtaagttaattattgttattcgtaggtactacagaccaacctacccgaaggtactccggaacccccaacttacctacactaccgaaggaagtaactagtaccacggacccggtcccgtacgggtaccgggttcccgtacggtaccgttactttccgttacgtcgggtcccttaccgtaaacggttccgtccgggtaacctcccgtaccgtaccccgtcccctttaccccgtaccgtaaccgtacctaccgggtaccgggttccggggtccccggttacccggggtaccgggtaaagggtacgttacgggaacgggttcgtaaccgtttacgtttacgtttaacgttgtaccggacgttaacggtacccggaccgggggtaacacgtaacgtagacggggtataggactacgtcggtaggtacgggttcggggtagggtcgtcggggacggacggaaccgtacgtaccggtaccgtcggtagtaccg

SEQ ID NO: 24582 - DNA, 956 bp, Homo sapiens
  misc_feature: GYAE6OF01BG52K.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcaggggggggaagctcagcttcagctggtggtagagaagacaggactcaggacaatctccagcatggccggcttccctctcctcctcacctcctcactcactgcgcagggtcctgggcccagtctgtgctgactcacgccacctcacgtcgtcgtccggggaccccggnaggtacgggtccacctagttccttctttcgttcgtggagcaacctccaacacgtacgggaaatttaattagttgttatttcgtacggttactacgacgaccaaaccgttaccgaaggtaacgttacccggaaccccctaaacttccctacgtaacgtaccgaaaggtaacgggtaaacttaaacgtaccgaacgggtaccccggtacccgttaccggaccgggggttaccctacggtaacccgttaacgtttcccgtcggttacccggtaccgttaccgtaaaccgttcgggttaaccgccgttaacccgtccgtaaccgtcccccgttaaccgtacggtaacccttagtaccggttacgggttacccgggtcccgttaccgggttaacccgggtaagggtacgttaacgggtacgggtaacctttaccgggtaaacctttttaccgggttacgttacgggtaaccggtaaccttaccgggttaacccggggacccgggtaaacccgtaaccgtaaaccgggttaggttaccgggtaacgtaaacccgttaaaccgttaaacggtacccgggttaaaggggtaccggggtttcccgggggtttaaggggggtttcccggggttaacccgggggaaaaaccggggtttaaaccccggggggtaaaaccccttaaaacccgggggtttacccggtaaacccccgggtttttaaaccccgggaaaggggggtttaaacccccccgg

SEQ ID NO: 24583 - DNA, 949 bp, Homo sapiens
  misc_feature: GYAE6OF01A7U5L.21.22.B11.1.454.CMB.1.raw
tcagtcgtcgctcgcacgaccggtgctcgatttagacgacagctcagggggggaagctcagcttcagctgtggtagagaagacagggactcaggacaatctccagcatggccggcttccctctcctcctcaccctcctcactcactgcgcgagggtccgtcgggcccagtctgtgctgactcacgcccaccctcgacggtccgtccggtaccgggggaccccccgggagaacggacggggtaccaaccgtaacttccgttctttcggttcgtagggacggtacctaacctaccaaactaacgtaccggtaaagttaactttagttacgttaacttcgtaggttacctccgaacgtaccgtaaaccctcccgtaaagggtaaccgtacccgggtaaccccccctaaaaccttacccttaaccgaacccgttaccgaaacgggtaaacgggtaaaacttaaacggtaaccgtaacgggtaccccgggtaccccgttaaccgggtaaccggggggttaaccccctacggtaacccggtttaacgtttacccgttaccggttaccggtaaacccgttacccgtaacggttacccggtacgtaccccgtaaacccgtcccggtaaccgtcccccgttaacccgttaccgtaacccgtacgttaacccggtacgggtttacccggggtaccggttaccccggggtacgggtaacgggttacgttacgggtaaccggtcgttaccgggtaaccttaacggttttacgacgttacggtaccgtacggtaacccggaacggggttaccaaccggtaaacgtaggtaacgggtacttaacggactaacgtcgggttaagggtcgggttacggggtttcgggtcgggtaaccggggtacggggtaaacgtaaccccggtaaggttaacccgtcccggtaaccggtttaaggaaccccggg

SEQ ID NO: 24584 - DNA, 679 bp, Homo sapiens
  misc_feature: GYAE6OF01C3UCG.21.22.B11.1.454.CMB.1.raw
  modified_base (218)..(218): a, c, t, g, unknown or other
  misc_feature (218)..(218): n is a, c, g, or t
  modified_base (343)..(343): a, c, t, g, unknown or other
  misc_feature (343)..(343): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctcgggcccagtctgtgctgactcacgcccaccctcagcgtcgtccggggacccccgggnaggacgggtcaccatcttcttgtcgtggagcaactccaacatacggaataattatgttattcgtggtactcagacaacctcccgaggtaactccggaccccaactcctacactacagagaatacncacggccgcccgtcgacgggtcctagaccgtattcctcgtcgtcctacgtacgtcgtcgcctacctcacgtccctaccgtacgaccctagtccgagggtccgggtcccgttaccgggtaccggaaggtcgtacgggtacggtacctacgttaaccctttaagttcccgtggttaccacgtaaccggtaccggaaccgggtacgactaacggtaggtgggaactacgaacgtacgttcggacgggtacgggttcggggtttacggggttccggtaccgggggtaaccgggaacggtaaacccgtaacggttccggtacccgtcggttacggaccccg

SEQ ID NO: 24585 - DNA, 941 bp, Homo sapiens
  misc_feature: GYAE6OF01CV7TS.21.22.B11.1.454.CMB.1.raw
  modified_base (617)..(617): a, c, t, g, unknown or other
  misc_feature (617)..(617): n is a, c, g, or t
  modified_base (738)..(738): a, c, t, g, unknown or other
  misc_feature (738)..(738): n is a, c, g, or t
tcagtcgtcgctcgcacgaccggtgctcgatttagacgacagctcgaggggggggaagctcagcttcagctgtggtagagaagacaggactcaggacaatctccagcatcggccggtcttccctcctcctcctccaccctcctcactcactgccgcgtacgggtcccgtcgggccctacgtccgttggtcgtcctacgtacctccaaccgacccctaaccccctcgacggtccggttcccgggtacccgggggaccccccccggggtagaacgggtaccggggttacccaacccgttagttcccgtttccgtttcggttacggtagggtaccgacctaaacctacccgtaaaccgtagttaacgggtaaacgttaagtttaacgttgtttaacgttcgttacggttaacgttaccgaacggtaacctacccgtacccggaaacggttaaccgtacccccggtaaaccccctaacccttcctaccgtacctaacggaaaggtaacgtaaacttaccgtacgaaccggcccgggtacccgtacgggtacccgggtccttaaccggtacgtaccttacgttccggtcgtacctaccgtacggtccgtacggtcctacccnccgttaacctcccgtacctaccgacctacggtcggaccgggttccgggtaaccggttaccccgggacggtaggtgtaaccggggattaccgtcgtaacggttttacgtaccgtcgttaacnccgaacggtaacccgggccgtaacaacggtaacgtacgggttaggactaacggaaccgttaggtcgggtttacggggtttaccggggtagggggttttaccggtaacccgggggtacccggggaaacccggggtttaacggaaaacccccgggttacggacccgggtttaaaccccggttccgggacccggttaaaccccggg

SEQ ID NO: 24586 - DNA, 861 bp, Homo sapiens
  misc_feature: GYAE6OF01EGW3M.21.22.B11.1.454.CMB.1.raw
  modified_base (227)..(227): a, c, t, g, unknown or other
  misc_feature (227)..(227): n is a, c, g, or t
tcagtcgtcgctcgcacgaccggtgctcgatttagacgacagctcgaggggggggaagctcagcttcagctgtggtagagaagacaggactcgaggacatctccagcagtcggccggtcttccctctcctcctccacccctcctcactcactgcgcgtacgggtccgtgggcccagttctgtgctgactcacgcccaccctcacgcgtccggtaccggggccccggnaagggtacggtccaaccattccttacgttttcggttacgtagggacgacctaaaccgtccgaaacgtacggtacggtaaagttaactttattagttatttaccgttgtactacgacgtaccaacccgtaccccgtaaggtaaccgtacccggaacccccttaaaccttcccgttacaccgtaccgtaacggtaaggtaaactaacgtacgaaccgggtcccggtaccccgttacggtacccgggggtacctaccgggtaaccctttacgtttccgtcgtacggttacccgtaccgtaagtcccgtcgtacctaccctcgtacccgtccctaccgtaccgtaccacgtacgtacgggtcggttacccgtccgggtaaccggaggtacgtcgggtaacgtccgttaccggttaactttaccgttacgtttcgacgtacctaccggttaacccggaccgggtaacccgttaacgaacggttaggtacgggtaactacggtaaactacgttacggttaacgggtacgggtttcggggggttaacggtttcgggggaacccggggtaacggggaaaccccggttaacggtaaaacccgttacccgggaaccggtttaaccggtccggttaaacccccgg

SEQ ID NO: 24587 - DNA, 946 bp, Homo sapiens
  misc_feature: GYAE6OF01DW9I7.21.22.B11.1.454.CMB.1.raw
  modified_base (58)..(58): a, c, t, g, unknown or other
  misc_feature (58)..(58): n is a, c, g, or t
  modified_base (103)..(103): a, c, t, g, unknown or other
  misc_feature (103)..(103): n is a, c, g, or t
  modified_base (257)..(257): a, c, t, g, unknown or other
  misc_feature (257)..(257): n is a, c, g, or t
tcagtcgtcgctcgcacgaccggtgctcgatttagacgacagctcgaggggggggaanctcagcttcagctggtgtagagaagacaggactcaggacaatccnccagcatcggcccgtccttccctctcctcctccaccctcctctactctactggccgacgtacgggtcctaccgggccctaggtcgttgtcgctgtactcgacgccctacccttacgacgtccggttaccgggaccccgggggaccccccggggngtaacgggtaaccggtcccaaaccgttctttccttcgtttacgtttcggacgggaacaacccgttaacctaaaccgaacgtaaccggtttaaacgggtaactttaaaaggtttattttaacgtacgtttttacgggtttacgtaacggttaccaaaacgggtacccctaacccgtaaccccggtaaaggggtttaaccccgcccccggtaaacccccttaaaaccgtccctcgtaaactacccggaaaggaaccggttaaaataaccgttacggaaccccgggtcccggttacccggtaacccgggttccggggtaaccctacgggttaccttaacgtttcccggttcgtacggtccgtaccccggtaggttccgtaacccggacctaaccctttacggcccgttacccgttaccgtacgtaaccccgtaggtaccggtccgggttacggtacccgggtacggtaaccgtcgggtaacgtcgggtacggtatacgtaccgttttaagttcccgtggtacgcgaacggttacccggacgggtacgtaaccagggtacgtaggaccgtaagtaccgtagacgggttaccggtgggtttcggggggtccggttggggaaacccggtggggtaaacccgtaccgggtaacggttaacccgggttaccgttaaccgggtcgtaaaccccggggg

SEQ ID NO: 24588 - DNA, 868 bp, Homo sapiens
  misc_feature: GYAE6OF01BWLQM.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgagggtcctcgggcccagtctgtcgctgacctcacgcccaccctcgacgtccgtccgtaccggggaccccccgggcgaggacggggtccaccgtacttccttcgtttgttaccgtgggaacggtaccaaacctaccaaacgtacgtaaccggtaaagttaaagttttaagtacgttattttacgttagggttaacttacgaacggacctaaaacccgtccccggaagggtaaccgtacccggaacccccctaaacgtccctacaactccgaaggaagtaactaacgtcgacggtccccggtaccgtaccggtaccggggtaccctacggacgttacgttcctcgtcggtacctaccgaacgtccgtacggtaccctaacctccgaccgttccccgttaccccgtaccgtaacctacggtaccgtacggggtcccgggtacccgtacccggggtaacggtacggtaacggttcggaaccggttcggtaaccttaacgtttacttaccggttacgtacggtaccgtaaccgttacgggaacccggggtaccaaccggtaaacggttaccggtagggtaaacgttaaccggaacgttaaacggtaccgggtagggttacgggttagggggtttaccggggttacgggttacccgggggaaccgggtaaacggtaaccccgaaacggttaccggtaacccggtacgggtaccgtaacccggg

SEQ ID NO: 24589 - DNA, 833 bp, Homo sapiens
  misc_feature: GYAE6OF01DG0VV.21.22.B11.1.454.CMB.1.raw
  modified_base (58)..(58): a, c, t, g, unknown or other
  misc_feature (58)..(58): n is a, c, g, or t
  modified_base (246)..(246): a, c, t, g, unknown or other
  misc_feature (246)..(246): n is a, c, g, or t
  modified_base (735)..(735): a, c, t, g, unknown or other
  misc_feature (735)..(735): n is a, c, g, or t
tcagtcgtcgctcgcacgaccggtgctcgatttagacgacagctcagggggggggaanctcagcttcagctgtggtagagaagacaggactcaggacaatctccagcatcggccggcttccctctcctcctccaccctcctcactcactgcgcgacgggtcctcgggccctagtctggtcgaccttgacctccacgcccgtacccctcgacggtccggttcccggtacccgggggaccccccgggngtaacggtaccgggtaccaacccgtatttcctttccgtttaggttccggtgggaaccggtaccctaaaccgtacccgtaaaccgtaaggttaaccgggtaaagtttaagtttacgttagggttaccttttcggtaggttaactccgaacgtaccgtaaacccttccccgaaggtaaccgtaccccgtaaacccctaaacgttcccgacgtaaccgtaccgaaaggtaacgtaaacttacgccgtacggtccccgttaacccgccgggtaaccgggtcccttggaaccgttacttccgtacggtcgtacctacgtacgtccggtacgacctaccgtccgaccgtcccgtaccgtaaccgtaccctacgtacggtaccgggtccggtaccggtaccgggtaccggagggacctcggggtaacttccgtaggttaccttacgggtttctcgggtacacgtacgggacccggtaacggcgaacgttaaccggnggttacgactaacgtacgtacctggtaacggtcgggtgggtttacggcgggtaccggacgggaaccgtacgacccgtacggtcgacggtctacccggg

SEQ ID NO: 24590 - DNA, 815 bp, Homo sapiens
  misc_feature: GYAE6OF01ARUVV.21.22.B11.1.454.CMB.1.raw
  modified_base (236)..(236): a, c, t, g, unknown or other
  misc_feature (236)..(236): n is a, c, g, or t
  modified_base (665)..(665): a, c, t, g, unknown or other
  misc_feature (665)..(665): n is a, c, g, or t
  modified_base (685)..(685): a, c, t, g, unknown or other
  misc_feature (685)..(685): n is a, c, g, or t
tcagtcgtcgctcgcacgaccggtgctcgatttagacgacagctcaggggggggaagctcagcttcagctgtggtagagaagacaggactcaggacaatctccagcatcggccggtcttcctctcctcctccacctcctaccactcactcgcgcgtacgggtcctcgggaccagttctggttcgactcgtaacctcacgcccacctcgacggtccgtcggtaccggggaccccggngaggacggggtccaacctcgttccttcgtttggttccgtacgggacgacaaaccctcaaaacggtacgttacggtaaacgttaactttagttacgttaacgttcgttacggttactacgaacggtacctaaccgtaccgtaacggtaaccgtaccggtaacccctaacctacctacctaacgttaccggaaacggtaaacgtaaacgtaacgtacggaccgtaccgggtaaccgttacgggtaaccgggttacccgtacggtaaccgttacgttccgttaccgttccgggtactaaccgttaacgggttcctaccgggtaccttacgtaaccgtccttacccgttccggtacctaccgtacgtcggtacgggtccggtaccggtccggtacgacggtcgtacggaggtactacggtactcgttaggtcngacgtacacggtaccggaanacgtcgacggtaacgcgttaaacgcgtacgttggtacgggtcgggttacgggtgggttaccgggtacgggtaaccgggaacgggtaaaccctacggggtaacccgttacggtacgggttacggtacccgg

SEQ ID NO: 24591 - DNA, 780 bp, Homo sapiens
  misc_feature: GYAE6OF01CE5G2.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctcggcccagtctgtgctgactcacgccaccctcagcgtcgtcggggaccccggnagaggtccactatcttcttgtctggagcaactccaacatacggaagttaattatgttattcgttggtaactcacgacctaaccgtacccgaggaactccggaaccccccaaactccctaccactacccgaaggtaacggaaattaacgtaccgaacgggtccccggtaccccgtccggtaacccgggggttccctacggtaacccgttacttcccttcggtaccggtacccctaccgtaacggttccgtacggtaccctaacccgtccgaccgtccccttcccgttaacggacctaaccgtccgtaacgggtccgggtacccgtcccgggtaacggacgggtacgtccgggtacgggtctaccgttaacgttacttacggtcggtacaccgtaccgtaccgaaccgggtcaacctaaacggtagttacgggtactaaccggtaaaccgtacgtcgggtaacggtcggggtttaccggggttaggggttccggttaccgggggaacccggtaaaccggggtaaccctaaccgggttaccggtaccccggtcgttaaacggggtaaccccg

SEQ ID NO: 24592 - DNA, 903 bp, Homo sapiens
  misc_feature: GYAE6OF01EYJMV.21.22.B11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcacgggtcctcgggcccagtctgtgactgactcacgcccaccctcacgtcgtccgtccggggacccccgggnaggacgggtccacctattccttctttgttacgtggacggccaacttccaaacacgtaacggtaaagtttaacttagttcgttaatttccgtagggttaactacgaacggaccctaacctaccccggtaaaggtaaccgtacccgggaacccccccttaaaactttccctaccggtaaccttacccggaaggtaacggtaaacttaacgttaccggaaccggccccgggtaccccgttaccggggaccgggggtttacccccgtacgggttaacccgtacgttttcccgttcgggttaccggtacccgttacccgtaaacgtttccggtaccgggtaccctacccgttaccgaacccggttcccccttaccccgtaacggtaaccctaacggtccggttaaacggggttcccgggtacccggttcccggggtacggtaacgggtacttacggggtacggtacccgttaacggttacctttaacgtttccggtagggtaacgtccgtaaccggttaacccgggaccgggttaaaccgacgtaaaccggtagggttaaccgggatacggtaaacccttaggttccggtaggtacgggggttcggggtttgggggtttacgtacccgggggacgggtaaacccggtaaacctacggttaaccggtacccgtcggttacggacccgg

SEQ ID NO: 24593 - DNA, 909 bp, Homo sapiens
  misc_feature: GYAE6OF01AKHY1.21.22.B11.1.454.CMB.1.raw
tcagtcgtcgctcgcacgaccggtgctcgatttagacgacagctcgagggggggggaagctcagcttcagctgtggtagagaagacaggactcaggacaatctccagcatcggccgccttccctctcctcctccaccctcctctacctcactgccgcgtacgggtccgtcgggccctagtcgtgtgactcgtacctccgacgtcccaccctcgacggtccggtccggtcccggggacccccgggacgaacggtacgggtaccacctacgttccttcgtttcggttacgtacgggacgtacctaaacctaccgtaaacgtacgtaaccggtaagttaacgtttacgttagtttaacttcgttacggtatacaacgtacctaaccgtaccgacggtaaccgtacccggtaccccctaacctccctacgtaccgtaccgaacggtaacgtaactaaccgtacgaaccggtccccggtacccgtaccgggtaccggtacccgttacggtaccgttacgttccgtacgttcggtacctaccgtaacggtaccgtcggtaaccctaccgtaccgtacccgttacccgtcctaacccgtaccgtacgttaccggtacggggtaccccgggtacccgtacccgggttaacgggacggttccgaacgggtagtaacccgttacgttaacctttaggttaccgttacggtaacccgtacgttaacccgggtaacccggacggggtaaccccaacgggttaaacggtacggttaacggggacttaccggtaacgttaccggtacgggtaagggttccggggttacggggtttacggttcggggtaaccccggggacgggttaaacccggtacccgggtacgtttaacccggggtacctttacgggtcccgggtaacccgg

SEQ ID NO: 24594 - DNA, 834 bp, Homo sapiens
  misc_feature: GYAE6OF01AIFZ5.21.22.B11.1.454.CMB.1.raw
  modified_base (175)..(175): a, c, t, g, unknown or other
  misc_feature (175)..(175): n is a, c, g, or t
  modified_base (810)..(810): a, c, t, g, unknown or other
  misc_feature (810)..(810): n is a, c, g, or t
  modified_base (815)..(815): a, c, t, g, unknown or other
  misc_feature (815)..(815): n is a, c, g, or t
  modified_base (821)..(821): a, c, t, g, unknown or other
  misc_feature (821)..(821): n is a, c, g, or t
  modified_base (827)..(829): a, c, t, g, unknown or other
  misc_feature (827)..(829): n is a, c, g, or t
  modified_base (831)..(831): a, c, t, g, unknown or other
  misc_feature (831)..(831): n is a, c, g, or t
  modified_base (833)..(834): a, c, t, g, unknown or other
  misc_feature (833)..(834): n is a, c, g, or t
tcagtcgtcgctcgcacgaccggtgctcgatttagacgacagctcagggtcctgggcccagtctgtgctgactcagccaccctcagcgtcgtcgggacccccgggcaggacggtcaccctatcttcttgtctggagcaactccaagagtacggaataattatgtattgtaggtancacgcaacctcccgaggaactcccggaaccccaaacttcctacacgtaccgaaggaaggtaaatacgtccgacgggtcccggcccctcgggtaccgggttcctacggtacctacgttcctcggtcggtccttaccgtacgtcgtccggtcccaaccgttccgacccgtccttacccgcgaaaccctggtacgtcggggtccggtcccggttaccggccggaagtcgacggtcggtacgtacgtacctttaacgttcggacgtctaacgtaaccgggtaccggaacccgggtaacaaaccgtaaggggttaaaccggtccggtaagttaaaccgaacgtttaaccggttaggggaaccggggtttaccgggttttgggggttacgggtttcccgggggaacgggtaacccgggaaacgtaacccggtaacggtaacccggtaccgggttacccggtaccggtaacccgggaaacccgcccgggtaacccggttcccggtaccccccgtttacccggtacccgttcccgttaccgtttccccttacccccgtttccccttaccccggttcccttaccgttccggttccgtaacgtccggttaccggacggtacggacgaccggtagccgtacgagtnacgtnactgangactcnnncngnn

SEQ ID NO: 24595 - DNA, 907 bp, Homo sapiens
  misc_feature: GYAE6OF01AT2M7.21.22.B11.1.454.CMB.1.raw
tcagtcgtcgctcgcacgaccggtgctcgatttagacgacagctcgaggggggggaagctcagcttcagctgtggtagagaagacaggactcgaggacaatctccagcagtcggccggtcttccctctccctcctacctacccctcctcacctcacgtcgcgcgtacgggtccgtcgggccctagtcgtgtcgtctcgctccgaccgcccaccgtcgacggtccgtcccgggtcccggggaccccggtagaacgggaccggtccaccttacgtttcccttcgtttacgttaccggtacgggaccgtaaccgtaaccctaccgtaaacgtacggttaaacggtaaagtttaaacgtttaagtttacggtttaaccgtttgttaacggtacttaccgaaccgtacccgtaaccggtaacccggaacggtaacccgtaaccccggaaccccctaacgttcctaccgtacgtaaccggtaaggtaaacgtaactaacgccggtaccggtccccgtaccggttaccggggaccgttaccgacgggtacctttacgttccgtacgtacccggtaaccgtcgttaccggtcgttaaccgacccgttacccgtacctacccgttcccttaccgtacgtaccgtcgtaaccgggtccgggttaccccggttccgggtacccggtacggtaacgttaccgggttacgggaaccgttcgttacggttaaccgtttagttccgtaagtccgtaaccggtacggtaaccggacgtaacgtaacgttaggacggtacgtacgtacttaacggtacgttacgggtggtaccgggggtttggttacgggggtacccggtacggggtaacggtaacccgggtaacgtacggtaacccgggtcgttacggtaccgggtaacccgg

SEQ ID NO: 24596 - DNA, 754 bp, Homo sapiens
  misc_feature: GYAE6OF01EL8XO.21.22.B11.1.454.CMB.1.raw
  modified_base (597)..(597): a, c, t, g, unknown or other
  misc_feature (597)..(597): n is a, c, g, or t
tcagtcgtcgctcgcacgaccggtgctcgatttagacgacagctcaggggggggaagctcagcttcagctgtggtagagaagacaggactcaggacaatctccagcatcggccggcttccctctcctcctccaccctcctcactcactgcgcgacgggtcctcgggcccacgtctgtgctcgactcacgcccaccctcacgtccgtcgtccgggaccccggaggacggtccacctatctcgttcgttctcggacgaccaacctaccaacgtagtacggaaagttaactttattacgttacttcgtaggtaacttacacgaccaaccgtaccccgaaggtaacctaccggtaaccccctaaaacgtcccctaacaacctaaccgaaggtaacgtaaactactccgacggtcccgtacccgtaccggaccggggtcccctcggtaacccggttactttccgtccgtacgacccgttaccgacggttccgacggtccctaccgtaccgtccgtcccgttaccacgtaacctagttccgaaggggtcccggtccgtaccgggtacggagtaacgtggtacgtcttacgtattactttcggngtacgtcacgtaccggaacggaccgtacgtaacggtacggtacggacttacgaacgtaccgttgttacgggtacggttggggttacggtcggggtccggaacggggaacccttaaaccggacgttacccggtaacccggttcgtacggtaaccccgg

SEQ ID NO: 24597 - DNA, 803 bp, Homo sapiens
  misc_feature: GYAE6OF01ANS72.21.22.B11.1.454.CMB.1.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (270)..(270): a, c, t, g, unknown or other
  misc_feature (270)..(270): n is a, c, g, or t
tcagtcgtcgctcgcacgaccggtgctcgatttagacgacagctcagggggggaagcgtcagcttcagctgtggtagagaagacaggactcaggacaatctccagcatggccggcttcctctcctctcaccctcctcactcactgcgcacgggtcctcgggcctagtctgtgctgactcacgccacctnacgcgtcgtcggggacccccggnacggagggtccaccgacgttcttacgttcggtctagggaccgacaaccttaccaacgngtaacggtaacttattacgtagttagttacgttggtactacgtacgacctaaccgtccgtaaggacgtaccgggacccctaaacgtccctacgtactacccgtaagacgtaactacgcgacgtccgaccgtcgaaccggtcctcgactcgtactacgtcgccgtactaacgtcgcggtccaaccgtcgtaccgtacccgttccgacaccctaacgtcggtaccgggttacggacccggttaccgggttaaccggtagggtacccttagggtacccggtaccggttacgtttacctttaacggtcgtttaggggactaaccgacggggtttaccgaacccgggggtacctaacctaacgggttacggtccggtaaaaggttacccgtattaaccccggggtaaggtttcccgggtccggttaacggggggttttcggggtcccgggttaaccgggggtaccgggggaaacccgttaaaacccggttacccgtacccggggggtaaccccttttagggggtaacgtacccccggg

SEQ ID NO: 24598 - DNA, 649 bp, Homo sapiens
  misc_feature: GYAE6OF01A77T2.21.22.B11.1.454.CMB.1.raw
  modified_base (629)..(629): a, c, t, g, unknown or other
  misc_feature (629)..(629): n is a, c, g, or t
  modified_base (642)..(642): a, c, t, g, unknown or other
  misc_feature (642)..(642): n is a, c, g, or t
tcagtcgtcgctcgcacgaccggtgctcgatttagacgacagctcagggtccgtgggcccagtctgtgctgactcagccaccctcagcgtctgggacccccgggcagagggtcaccatctcttgttctggaggcaactccaacatcggaagtaattatgtattctggtatcagcaactcccaggaactggcccccaaatcctcatccagaggaataatcagccggcctcgacggggtccctgaccgtattctcgtggctccaagtctggccacctcacgcctcctagaccatcgaggtcgggctccggtcgaggatggaggctaggactagttacgtgtcgcacgtcgacgggtcacaacagtgggatgactaatcgtagaggtcggttggtcgttcgggacgggtaacgggaaccgtaacgtacggtaccgtaccgtacggtacgacggaccgaacggtccgtccgtccccgtccggtcctaccgttccgttaccgttccccgtaccccgttcccgtacccgtaccggtaccggtaccgtaccggtcggtacgggtaccgggtaccggtaccgggaccggtaaccgggtccggtaccgtaacggtacggtacgcggtcgacgacgacncggggacacgtcncgtcgcg

SEQ ID NO: 24599 - DNA, 710 bp, Homo sapiens
  misc_feature: GYAE6OF01E4BOX.21.22.B11.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagacgacagctcagggggggggaagctcagcttcagctgtggtagagaagacaggactcaggacaatctccagcatggccggtcttccctctcctcctccaccctcctcactcactgcgcagggtcctcgggcccagtctgtgctgactcacgccaccctcacgtcgtcgtcggggaccccggnaggagggtcacctatccttcttgttcgtggtacgaccaacctccaacacgtacggaaagttaatttagtagttattcgtaggtactcgacgtaccaaccgtccgaacggtaacgtaccggaccccctaaaactcctacactacccgaaggaacggtaaattaactcgaacggtcccggaccctcgggtaccggggttcccacggtacctacttcctcgtcggtcctaccgtagtccgtcggacctaccgtaccgacgtccctaccgtcgtaacctacgtacggtacggttcgggtaccggttcccgggtacggacggtaggtacggacggtacctacgtaacgtttacttacgtcggtactacgtacgtaccggacgggtacacgaacgtggtaggtactacgaactacgtcgtagggtcgttcgggggtaggttcgggtcgggtacgggaaccgtacgtaacggtaccggttaccgtcggtacggtacccgg

SEQ ID NO: 24600 - DNA, 666 bp, Homo sapiens
  misc_feature: GYAE6OF01DIM7G.21.22.B11.1.454.CMB.1.raw
  modified_base (64)..(64): a, c, t, g, unknown or other
  misc_feature (64)..(64): n is a, c, g, or t
  modified_base (164)..(164): a, c, t, g, unknown or other
  misc_feature (164)..(164): n is a, c, g, or t
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (275)..(275): a, c, t, g, unknown or other
  misc_feature (275)..(275): n is a, c, g, or t
  modified_base (643)..(643): a, c, t, g, unknown or other
  misc_feature (643)..(643): n is a, c, g, or t
  modified_base (647)..(647): a, c, t, g, unknown or other
  misc_feature (647)..(647): n is a, c, g, or t
  modified_base (656)..(656): a, c, t, g, unknown or other
  misc_feature (656)..(656): n is a, c, g, or t
  modified_base (663)..(663): a, c, t, g, unknown or other
  misc_feature (663)..(663): n is a, c, g, or t
tcagtcgtcgctcgcacgaccggtgctcgatttagacgacagctcagggtcctgggcccagtcngtgctgactcagccaccctcagcgtctcgggaccccggcaggacggtcaccatctcttgtctgaggcactccaacagtcgaagtaatatgtatctggtancagccactccgagactcgaccctaacncctacagtccagaagaactacncacggccgtccgtacgacgggtcctagaccgattctcgtacgctaccgatcgtagcctaccncgaccgcctccgtacgactacgtcgacggtaccggccgtccgggtaccgaggtacggtacggacggacttacggtaacttcgttaacgtcggtaccgtaactcggtaaccggaaccgggaacgtaccgaaaggtaacggtacgggtactacgtaaacgtacgtacggtcgggtacggtacggggttcggtggttaccgggacgaaccggtaacgtacgtacgaccgtcgacggtacgacggaccgtacgtaccgtccgaccgttccggtcctaccgtcctacccgttccctcccgtccgtccgtaccgtcgttccgtacgtcgtacggtacggtcggtaccgtaccgtacgacgtacgacgtcgagtnacgntcgatacgntggctgnacg

SEQ ID NO: 24601 - DNA, 787 bp, Homo sapiens
  misc_feature: GYAE6OF01CYHCJ.21.22.B11.1.454.CMB.1.raw
  modified_base (221)..(221): a, c, t, g, unknown or other
  misc_feature (221)..(221): n is a, c, g, or t
  modified_base (713)..(713): a, c, t, g, unknown or other
  misc_feature (713)..(713): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgcgcgacgggtccgtcgggcccagtctgtgctgactcacgcccaccctcaggcgtcgtccggggacccccggngaacggacggggtccaccgtacttccttctttcggttacgtacgggacggtaccaacctaccgaacgagttaaccgggtaaagtttaaattagttacgtttaagtttaccggttaggtaacttaccgaacgtaacctaaccccgtaccccggaagggtaaaccgtcccccggtaaaccccaaacccttcccgtaactacgtacccgaaggtaaacgtaaactaactccgacggtcccggaccctacggtaaccggggtcctacggaaccgttcgttaccgtcgttacgtacccgtacgtaaccgtcgtaccgacctaccgtcgacccgtcctaccctacgccaacggttcgacgggtccgtacccgtcgggtaccaggttacgcgtacggtacacgttacgttacttacgtacgtcgaaccgtagtacccggaacggtaacgcctaaggtacggtggaacttaacggacgttaccggtggacgggttcgggngggttttaggggccggtaacggggaccgggaacgtaaccggaacgttcccgaaccggttggtacccgtaaacgg

SEQ ID NO: 24602 - DNA, 831 bp, Homo sapiens
  misc_feature: GYAE6OF01A4BAK.21.22.B11.1.454.CMB.1.raw
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
  modified_base (816)..(816): a, c, t, g, unknown or other
  misc_feature (816)..(816): n is a, c, g, or t
  modified_base (827)..(827): a, c, t, g, unknown or other
  misc_feature (827)..(827): n is a, c, g, or t
tcagtcgtcgctcgcacgaccggtgctcgatttagacgacagctcagggtcctgggcccagtctgtgctgactcagccaccctcagcgtcgtcgggaccccgggcaggagggtcaccatctcttgtctggaggcaactccaacatcggaagtaattatgtattcgtggtatcagctaactcccgaaggaactcggaccccaaactcctacactaccgagaaggtaaactaactcacgcggacccctggtacggggtccctaggaccgttacttcctccggtacggccttaccaagttcctcggacctaacgtcaccggcctccctcaaccgtntaccgaggttcggacccgttaccggcggtaacgngttacgcgggtctagtaccttagttacnggttacgctacgnggaccggaaccacaacgnggtacgggatacggaactactgtcgggaagtttcggggttcggggttacggtccgggtacgggaaacgggtaacccggtaacgtacccgggtacccgttacggtaccggtaacggtaccggacccggtaacggtaccccgggttaccccggtaccccggtttaccccggtacccgtttacccggtttcccgttaccccccggttttccccggtaccccccgtttacccccggtttcccgggttaacccgtttccccggtttaaacccgggttcccgggtttaacgggacccgggggttcccgggtaaccggggtccggaaaccggggtttaccgggacccgttaacggtacccgttacgggatcggcccgtaaggtagttcgcccggtancgtacgtccgngtcg

SEQ ID NO: 24603 - DNA, 726 bp, Homo sapiens
  misc_feature: GYAE6OF01C12K6.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcgacgggtccgtgggcccagtctgtgtctgactcacgccctaccctcgagtccgtccgtccggggacccccgggcgaggcgggtaccaccgtatccttcgtttgtcgtggacggacaacctaccaacgataacggtaagtaatttactagttattcgtaggttactacgacgacctaaccgtacccgaacgggtaacgtcccggaaacccccaacttccacgacctaccgaagaagtaaactaacgtacgaacggcccggtcccgtacgggtaccgggtcccgtacgaccgtattccttcgtacggtacctccgtaagtccgacggtcccaaccgtcaccgttccctaccgacgtacccgtaactcgacggggtcgtacccggtccggtaccggagtcgaggtcgtcgtactaacgttcgtacgtcgtcgaactacggtaacggacggaagccgtaaacgtcgggtacgaacgtaaccgagtaccttaggggacgtacggggttggttacggggtccgggtacgggacggaaccggtaaaccgaaccggtcgtaccggtacccggtggtaaacccg

SEQ ID NO: 24604 - DNA, 706 bp, Homo sapiens
  misc_feature: GYAE6OF01BD1N3.21.22.B11.1.454.CMB.1.raw
  modified_base (212)..(212): a, c, t, g, unknown or other
  misc_feature (212)..(212): n is a, c, g, or t
  modified_base (542)..(542): a, c, t, g, unknown or other
  misc_feature (542)..(542): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccacctcagcgtcgtccggggaccccggnaggacggtccaccatctcttgtctggagcaactccaacagtcggaagtaattagtgtattcgtggtactcagctaacctcccgaaggtaactccggaccccctaaactcctacactccgaaggaacgaaataactcgacgccggcccgtacggccgggggttaccctaggtacccgtattccgtcgtcgggtacctaccgtaacgtccgtacggacctaccctcaccgtaccctcccgtacgaaccctcgtacgtacgggttccgggacccgttacccggggtacggaacggactacgggaccgggtcttacggaactttacggtttacnggtcgaccgtagtaccgacggggactacgtaacgtacgggtacggtaactacggaacgttactcggtacgggcggggtttacggggttaggggtcgggttaaccggggcgggtaaacccggggtaaactacgggtacccgaccggttaccggtacggtaccggg

SEQ ID NO: 24605 - DNA, 773 bp, Homo sapiens
  misc_feature: GYAE6OF01DOS3F.21.22.B11.1.454.CMB.1.raw
  modified_base (455)..(455): a, c, t, g, unknown or other
  misc_feature (455)..(455): n is a, c, g, or t
tcagtcgtcgctcgcacgaccggtgctcgatttagacgacagctcgaggggggggaagctcagcttcagctgtggtagagaagacaggactcaggacaatctcagcatggccggtcttccctctcctcctccaccctcctcactcactgccgcgacgggtccgtcgggccctagtcgtgtgcttgacctcacgcccacccttcacggccgttccggacccggggacccccggcgacgggacggtccacctacgttcctttcgttcggttcgtaggacggacctaacctacccgaacgaacgttacggtaaagtttaactttacgttagttacgtttcggtaggtactacacgacctaaccgtccggaaggtaacgtcccgaacccctaacttcctacgactccgaagtaacgaacttaacgtcggaccgacccggtccgtaccggccgggttccncgtaccgttcttccgtcggtcgacccgttactacggtcgttcggaccctacgtccctaccgtcccctccgtacaccgtacgtcggtacgggtcggtcccgttcgggaacgtggtaaccgtgtacgtactacggtactttcgtacgcggttcgacgttacggacccgggtaacgccgtaacggtaacttaggggtacgttaagacctaacgggttcttacggggtagggttcgggttaggggttcggggtttacgggacgggaccgggtaaaacccgtaccgggaacgttcccgggaacgttccggaaccgtacccggg

SEQ ID NO: 24606 - DNA, 737 bp, Homo sapiens
  misc_feature: GYAE6OF01CW9AO.21.22.B11.1.454.CMB.1.raw
  modified_base (58)..(58): a, c, t, g, unknown or other
  misc_feature (58)..(58): n is a, c, g, or t
tcagtcgtcgctcgcacgaccggtgctcgatttagacgacagctcgaggggggggaanctcagcttcagctggtggtagagaagacaggactcagacaatctcagcatcggccgtcttccctctcctcctccaccctcctcactcactcgcgacgacgggtccgttcggggaccctagtcgtggtactctggacctcgacgccctaccgtcgacggtccggtcgtcccgggggacccccggagtaggtcggggttaccaacctcggtttcctcgtttacggtcgtacgggtaacgaccttaaaccgtcaacgttaggtacggtaaagttaattagtgtttaacttacgtacggtattccacggaacctacgtaccggaaagtacggtaaccccgaaccctaaccgtcctaacctaccgtacgaacggtaagaaactacgtacgacggtccgaccggtaacgccgggtcctaggacccttagttccgcgtcggaacctacgacgttcgacgtaccctcgactaacggtccctacgtacgtacctacggtaccggtagtccggtccggacgtaccggtagtccaggtcggctacgtaagtctacgtctacgcgacgtcggacgtacacgtagacgaggtactacgtacgacgttacggacgggttccggggtggttacggtcggggttaacgggacggttacggtaaaccgacgtttggaccccgttagggcgtaccgg

SEQ ID NO: 24607 - DNA, 881 bp, Homo sapiens
  misc_feature: GYAE6OF01DE33B.21.22.B11.1.454.CMB.1.raw
  modified_base (58)..(58): a, c, t, g, unknown or other
  misc_feature (58)..(58): n is a, c, g, or t
  modified_base (143)..(143): a, c, t, g, unknown or other
  misc_feature (143)..(143): n is a, c, g, or t
  modified_base (185)..(185): a, c, t, g, unknown or other
  misc_feature (185)..(185): n is a, c, g, or t
  modified_base (204)..(204): a, c, t, g, unknown or other
  misc_feature (204)..(204): n is a, c, g, or t
  modified_base (276)..(276): a, c, t, g, unknown or other
  misc_feature (276)..(276): n is a, c, g, or t
  modified_base (774)..(774): a, c, t, g, unknown or other
  misc_feature (774)..(774): n is a, c, g, or t
tcagtcgtcgctcgcacgaccggtgctcgatttagacgacagctcgaggggggggaanctcagcttcagctgtggtagagaagacaggactcgaggacaatctccagcagtcggccgtcttccctctcctcctccaccctccncactcacgtcgcgcgacgggtccgtcgggacccagtctggtnactgacctcacgcctcccngtacgtccggtcgacccggggacccggcagggtacggtaccactcgtttcttcgtttcggtacgacgggacncccaaaccttaaccgaaccgttagtaacgggtaaattaacgtttagtagtttacgttacggtagtaaccacacgtaacccgtaaccgtaccggaaacgtaccgtaccccggaacccctaacctacctacctaccaacggtaacggaaagtaacttaacgccggaccggtaccgtcccggttaacggccggggttacccacgtaaccgttctaccgtgtccgtccgttaacggtacgttccgtacggtcccgtaaccgtcccggttaccacccgttacccctaacgggtacctaccgggtacgttcccggggtaaaccgggtacccgttacccggggtaaggaccggtacggggtttacggaacccgtttaccggtaaaggtttaaccccggtttaagtttccgacgggtttaccgtaccgaaccggttagggaaacccccgggagtacggtaaacgacggggtttaacaacggggacttaacgtagggttaacccggngggggttacggggttcggggtttacggggttacccggggaaccgggtaacccggttaaaccgggtaaccgttacggaaccccgttccgggcgggttaaccaccgggg

SEQ ID NO: 24608 - DNA, 897 bp, Homo sapiens
  misc_feature: GYAE6OF01BTCOQ.21.22.B11.1.454.CMB.1.raw
  modified_base (732)..(732): a, c, t, g, unknown or other
  misc_feature (732)..(732): n is a, c, g, or t
tcagtcgtcgctcgcacgaccggtgctcgatttagacgacagctcagggggggggaagctcagcttcagctgtggtagagaagacaggactcaggacaatctccagcatggccggtcttccctctccctcctcaccctcctcactcactgcgcgaggtccgtcgggcccagtctgtgacgtcgactcgacgccaccctacaggccgtccggtacccgggggaccccccgggtacgaacgggacgggttaccaaccgtacttccgtttcgttttggttccgtaggggacgggtacctaaacccgtaccgaaaaccgaacggttaaccgggtaaaagtttaacgtttaagttacgtttaacgttttaccgtaggttacttaaccaacggtaacctaaaccgtacccgaagggtaaccgtaccccggaaccccctaaaacctccctaccgaacgtacccgtaaagggtaacggtaaactaacctacggtaaccggtcccggaacccccggttacgggtaccggggttaccccgtacggtaacccggttacgtttaccgtaccgtcggtaccccttacgtaaacccggttccgtaccgggttacccacccggttaacccgcgtacccccgttccgtaccggtaaccttaaccggtcggttaccgggttacccggggtcccgttacccgggacgggacggttacgtagggacgttccgtaaacgtacttaacgttcncggtaggtacacgtacgggaaccgtacgacgtacggtagtcgggaagtacgtacgtagtacggtacggtagggtcggggtttacgggtacgggtaccggggtaacgggaacgggttaaaccccgagggttacccggtaccgggttaaggtcccggtaaacccggg

SEQ ID NO: 24609 - DNA, 761 bp, Homo sapiens
  misc_feature: GYAE6OF01D7VMX.21.22.B11.1.454.CMB.1.raw
  modified_base (539)..(539): a, c, t, g, unknown or other
  misc_feature (539)..(539): n is a, c, g, or t
  modified_base (562)..(562): a, c, t, g, unknown or other
  misc_feature (562)..(562): n is a, c, g, or t
  modified_base (633)..(633): a, c, t, g, unknown or other
  misc_feature (633)..(633): n is a, c, g, or t
tcagtcgtcgctcgcacgaccggtgctcgatttagacgacagctcgaggggggggaagctcagcttcagctgtggtagagaagacaggactcaggacaatctccagcatggccggtcttccctctcctcctccaccctcctcactcactgcgcgacgggtccgtgggccctagtcgtgtgctcgactcacgccctacccctcaggtccgtccggtccggggaccccccgggagacggtacgggtccaaccctattccttccttggttccgtagggacggtaccaacctacccaaacgtagtaacgggtaaattaatttacgttagttattccgttaggtactacgacgtacctaaccctaccccgaagggtaacctaccccggaacccccctaaaaccttcccttactaaccgtaccgtaaggaaacgtaaaattacctacggaccgggtccccggtccccgttacgggaccgggggttcccctaacggtaccttacttccgtcgtacggtctaaccgtacgtccgtacggcctacccnctaccgtcccctacctacgaccnctacgaggggtcccggtccgttaccggccggaagtcgtagtacggtccttagtactttacgttctcgggtnacgtacgtaccggacggtaccagtacgaggtcgaatactacgtgttcaggggtacggttgggtttcgggtcgggtacggacgggaaacccggtactaacggtcccgtaaccggtggtaacgtacccgg

SEQ ID NO: 24610 - DNA, 760 bp, Homo sapiens
  misc_feature: GYAE6OF01CF8AH.21.22.B11.1.454.CMB.1.raw
  modified_base (484)..(484): a, c, t, g, unknown or other
  misc_feature (484)..(484): n is a, c, g, or t
  modified_base (591)..(591): a, c, t, g, unknown or other
  misc_feature (591)..(591): n is a, c, g, or t
  modified_base (623)..(623): a, c, t, g, unknown or other
  misc_feature (623)..(623): n is a, c, g, or t
  modified_base (729)..(729): a, c, t, g, unknown or other
  misc_feature (729)..(729): n is a, c, g, or t
tcagtcgtcgctcgcacgaccggtgctcgatttagacgacagctcaggggggggaagctcagcttcagctcgtggtagagaagacaggacctcaggacaatctccagcatggccggcttcctctcctcctcacctcctcactcactgccgcgacggtcctcgggcccagtcctcgtcgctgaccttcacggtccacccgtcacggcgtcgtaccggggacccccgggcgtaacggacggggttaccaaccgtacgttaccttccgtttcgttacgtacgggtacgggtaccaaacctaccgaaacgtagtaccggtaaaggttaacttacgtgtaacttcgtagtactacacgacctaaccgtaccgtaacggaacgtccggtaacccctaaaactcccgtaactaacctccgaaggtaacggtaaactaacgtacgacggacccggtacccgtacggtaccggggtcccttaacggaaccgtntttaccgtacggtcgggtacccttaccgaacgttcgaccggtctacctccgtaccgtaccctcccgtacgacctcggtacacgggtcggtcgtaccggtcggtacgngtacggactcgtacgtacttaacgtcttacgnaccgtaacgtccggaacgtacggactaacggtacgtacgacgtacacgtactcggttcggaacgggttggtacggggttcggaccgggtacggaaccggtaaaacnccgggtaagttaccgggttacgacggtaccg

SEQ ID NO: 24611 - DNA, 1028 bp, Homo sapiens
  misc_feature: GYAE6OF01B1EL8.21.22.B11.1.454.CMB.1.raw
  modified_base (121)..(121): a, c, t, g, unknown or other
  misc_feature (121)..(121): n is a, c, g, or t
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
tcagtcgtcgctcgcacgaccggtgctcgatttagacgacagctcaggggggggaagctcagcttcagctgtggtagagaagacaggactcaggacaatctccagcatggccggtcttccnctcctcctcaccctctcactcactgcgcgaggtcctgggccagtctgtgctgactcacgccaccctgacgcgtcgtcgggacccccgganaggagggtccaacctnttccttccgttggttccgtagggacggacctaaaccctccgaaaactacttaccgggtaaaacgttaatttaagtaggtttaccgttgttagggttacttacccgacggtacctaacctacccggtaacggtaaaccgttcccggaaccccctaaaaaccgttccctacccgtaacgttaacccggtaaacggtaaagggttaacttaaacggttaccgaaccgggtaccccggttcccggtaccggtaaccgggggtttaccccacggggttaaacccgtactttcggtacccggttcggtaccttaacccggttaaggggttaccctacgggtaccccggtaacccttccggaacccggtcccttacccgttaacccggtaacccgtaccgttaacgggtaacccggggtttcggggtaccccggtttaccccgggggtacgggttaaccggttacggggtacgggttaacccgggtccggtaaacgttttaacccgtttaaaccggtttacggttaacgggtttccgtaaccgggttaaccttaaccccgggggttaaaccgggtaacccgggaaacctttaaacccggggtaaagggtcccgggtaaagtaacccgggtaacgttaaccgtttacgggttaaacggggtttccgggggttcgggggtttaaacccggggtttaccggggtagggggggttaaaccccgtaaaccggggggggttaaacccccttaaaacgggggttaccccggtttaaacccccgtttccgggggttaaaacccgtaacccccgggg

SEQ ID NO: 24612 - DNA, 696 bp, Homo sapiens
  misc_feature: GYAE6OF01DOSQH.21.22.B11.1.454.CMB.1.raw
  modified_base (282)..(282): a, c, t, g, unknown or other
  misc_feature (282)..(282): n is a, c, g, or t
tcagtcgtcgctcgcacgaccggtgctcgatttagacgacagctcagggggggaagctcagcttcagctgtggtagagaagacaggactcaggacaatctccagcatcggccggcttccctctcctcctccaccctcctcactcactgcgcagggtcctgggcccagtctgtgctgactcagccaccctcagccgtcgtcggggacccccggcaggacggtccaccatcttcttgttctagggacgcaactcaacatcggaagtaattactgtattctggtntcagcactccaggtaactcggacccctaactcctacactccgaagtacggaattaactcgaacgccggcctaccgaggggtccctagaccgtaatttccgcgtacggccttacccaagttccgtcggcctacccggttcaaccggttccctcccgttacggactcgtacgcggtcgggtcctcccggggttccgaaggtgacgggtacggcctttcgaaccttttatacgtttcgagtcccgaagttccggaacccggggtccgtaacaacccgtaaggttacggggtacctaaggacctaaacggttcgtacgggtaccggttcggggggtttattcccggggggtacggtacggggaaccgggttaaaccccgaagggttaccccggcccggttaacggttaacgtacccgg

SEQ ID NO: 24613 - DNA, 939 bp, Homo sapiens
  misc_feature: GYAE6OF01AJAYH.21.22.B11.1.454.CMB.1.raw
tcagtcgtcgctcgcacgaccggtgctcgatttagacgacagctcagggggggggaagctcagcttcagctgtggtagagaagacaggactcaggacaatcctccagcatggccggcttccctctccctcctcacccgtcctcactcactgcgcagggtcctcgggccctagtctgtcgctgactcacgccaccctcgagccgtcgtcggggacccccggacggacgggtccaccgtagttccttcgtttcggttcctgggacggcctaaacctccgaaacgtacgtaccggtaaagttaactttaacgttacggttaactttcgttaggtacttacgaacgccgtaaacccttccccgaagggtaaccgttcccggaacccccctaaaccgttccgtaccgtacgttaacccggaaggtaacgggtaaaacttaacgtacccggtaacggtaccccggtaccccgttacggtaccggggttacccctacgggtaaccccgtttacgtttacccgttaccggtacgggttacccttaacccggtaaaccgggttcccgttaccgggtaaccccttaccccgtaccgtaccccgtaccccgtttcccgtaccgaaacccgttacgtaccgtacgggttcccgggtacccgttacccgggtaccgtaagggtacttaccggggtaacgttcccgtaacgttaacccgttaacgtttacgtaccgggttacctaaccggtaacggttacccggaacccggggtaacaaccgttaacgggttaccggtagggttaccgtaacgtaaccggtaaccgtttagggtacccgggttagggggtttcccggggtttaaggggtttccggggtaaccggggaaaccggttaccgggtaaacccggttaaccgtaccgggttaccgttacccggttacggaacccccgg

SEQ ID NO: 24614 - DNA, 838 bp, Homo sapiens
  misc_feature: GYAE6OF01APIEQ.21.22.B11.1.454.CMB.1.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
tcagtcgtcgctcgcacgaccggtgctcgatttagacgacagctcagggggggggaagctcagcttcagctgtggtagagaagacaggactcaggacaatctccagcatggccgcttccctctcctcctcacctcctcactcactgcgcgagggtcctcgggcccagtctggtcgtctgactcacgcccaccctcacgccgtccgtaccgggggacccccggnaggacgggtcacctnttcttcttggttcgtagggacgaccaacctaccaaacgtagtacgggtaaatttaacttagttacgtactttcgtaggtacaccgtagaccctaaccgtaccgaaggtaacgtcccgaaccccctaactcctacactaccgaaggtaagaactactcgaccggtcccggtcccgtacgggtacccgggggtccctacgggtaaccgttcgttccgtcggtacccgtacccttaaccggtaacggtttccggacccgtacccgtaacccgtccgaccccgttccccgttacccgtacgaacccgttagtccggttacggtcccgggtcccgttcccggggtacggtaggtaccggtacggaccggtacgtaccgttaacgttcgttaccgtgtacccgcgtaccgaccgggaccgggaactaacgtaacggtcggtacggtaattaaccggaaccttacgttacgggtaacgggggtaccggggttttggggggtttacgggttaccccggggtacgggggtaacccggggtaaaacccggttaaccggtaaaccccggttaccggggtaaccccggttcgggttaaccggaacccccggg

SEQ ID NO: 24615 - DNA, 648 bp, Homo sapiens
  misc_feature: GYAE6OF01CDLAR.21.22.B11.1.454.CMB.1.raw
  modified_base (107)..(107): a, c, t, g, unknown or other
  misc_feature (107)..(107): n is a, c, g, or t
  modified_base (147)..(147): a, c, t, g, unknown or other
  misc_feature (147)..(147): n is a, c, g, or t
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (306)..(306): a, c, t, g, unknown or other
  misc_feature (306)..(306): n is a, c, g, or t
  modified_base (413)..(413): a, c, t, g, unknown or other
  misc_feature (413)..(413): n is a, c, g, or t
  modified_base (633)..(633): a, c, t, g, unknown or other
  misc_feature (633)..(633): n is a, c, g, or t
  modified_base (641)..(641): a, c, t, g, unknown or other
  misc_feature (641)..(641): n is a, c, g, or t
  modified_base (644)..(644): a, c, t, g, unknown or other
  misc_feature (644)..(644): n is a, c, g, or t
  modified_base (647)..(647): a, c, t, g, unknown or other
  misc_feature (647)..(647): n is a, c, g, or t
tcagtcgtcgctcgcacgaccggtgctcgatttagacgacagctcagggtcctgggcccaggtctgtgctgactcagccacccgtcagcgtctcgggacccccgggnagagggtcaccatctcttgttcctggaggcaactccaacntcggaagtaattatgtacttctggtatcagccaactccaggatcgaccccaatccnatcagagaatancgagccgccctcgcgggtccctgaccgtattccggtctggacctaccgaaggttcctaggccttaacccgttcgaccgcccttacccgtanaacccgagttacacgggttcggggacctccccgggtccgaggtacgtacggaggtccttagtaacctagttaccgtgtacgactacgtaccgacgggccactaacgngtggactcgacgtaactcggtagcgggttacggttggggtcgtcgggacgtaccggaaccgtacgtaccgtaccgtacgcggtacgaccgtaccggacgcctacccgtcccgacggttccacgttccgtccttcccctacctcctctaccttcgtccgtacgcgaccgggtccgtcgtacggtaccgaggtcccgtaagacgtcgggcatcggctaggancgttacgnccngcng

SEQ ID NO: 24616 - DNA, 810 bp, Homo sapiens
  misc_feature: GYAE6OF01EPCF7.21.22.B11.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagacgacagctcgagggggggggaagctcagcttcagctgtggtagagaagacaggactcaggacaatctccagcatggccggcttccctctcctcctccaccctcctcactcactgcgcgagggtcctgggcccagtctgtgctgactcacgcccaccctcacgccggtccggtccggggaccccccgggnagggacggggtccacctattccttcgttgttcgtagggacggacctaacctaccaaacagtacggaaagttaacttagtagttattcgttggtaatcgacgtaccaacctccgaaggtactcccggaccccctaaactccactactaccgaaggaagtaactaacgtaccgaacggcccggtacccgtaccgggtaccggggttcccctaggaacccgtacttccgttcggtcggtacccgtaccgtaacggttcccgtacgggtaccctaccccgttccgacccgttcccccgttaccctaccggtaaccccctagttccggtaaccggggttccgggttaccccgggtcccggggttaacccgggaagggtaccgtacggggtaaccgtccgtagttaccgtttaactttccggtagtcgtacaccgggttacccggaaccggggtaccaaccggttacgtaaggtcggataacggtatacgtacggtagggtacgggtttaggggtcgggttcgggtaaccgggaggggtaaacccgggtactaacccggttaccgtacccgggttaccgtaggtaccccgg

SEQ ID NO: 24617 - DNA, 780 bp, Homo sapiens
  misc_feature: GYAE6OF01DCUQP.21.22.B11.1.454.CMB.1.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
tcagtcgtcgctcgcacgaccggtgctcgatttagacgacagctcaggggggggaagctcagcttcagctgtggtagagaagacaggactcagacaatctccagcatggccgcttccctctcctcctccaccctcctcactcactgcgcgacgggtcctcggccctagtctgtcgctgactcacgcccaccctnacgcgtcgccggggacccccggngagacgggtaccaccgtactccgttctttcggtcgtcgggacggtaccaaacctccgaacacgtacggtaattaattagtgttacttcgtagtatacgacgtacctaaccgtacccgaaggaaacgtcccgaaccccctaaacctccgtaccaacgtaccgaaaggaacgtaaactaacgtacgaaccggtcccggtaccccgtcggtaaccggggtccctaccggtaacccgtacgttccttacgtcccggtaccttaaccgtccgggtaccgtcggaccctacccttaccggacccgttcccctaccccgtagacccgttaacgtccggtagggtcccgggtccctaccccgggttacgggacgtacgggttacggtaccggtacgtttacggtaaccttttaacggtttcgtcgggtttacccggacgttaacccgtaccggggaacccgggaaccgtaacgtaacggtaagggacggtacggtacaaacgttaccctggggttaacggccgggtcgggtaccgtgggacgtaaacgggctaaccggaatcgactgtgcg

SEQ ID NO: 24618 - DNA, 813 bp, Homo sapiens
  misc_feature: GYAE6OF01C1962.21.22.B11.1.454.CMB.1.raw
  modified_base (59)..(59): a, c, t, g, unknown or other
  misc_feature (59)..(59): n is a, c, g, or t
  modified_base (237)..(237): a, c, t, g, unknown or other
  misc_feature (237)..(237): n is a, c, g, or t
  modified_base (803)..(803): a, c, t, g, unknown or other
  misc_feature (803)..(803): n is a, c, g, or t
tcagtcgtcgctcgcacgaccggtgctcgatttagacgacagctcgagggggggggaanctcagcttcagctgtggtagagaagacaggactcaggacaatcctccagcagtcggcccgtccttccctctccctcctaccaccctcctcactcacgtgcgcgagggtcctcgggacctgtctgtgctagacctccacgcccacccgtcgacggccgttccggcccggggaccccggngagggacggtaccacctacgttcgttcgttacggttcggacgggacgtaccctaaaccgtccgaaaacgtggttaacggttaaagtttaactttaagttcgttaacgtttagttcggttactacgaactaccgtaaacccgtaccggtaacggtacccgaccccggtaacccctaacctacctaccaccgtaaccgaaagggaacgtaaactaaccgccgtaccggacccggtacccgttaccggacgggttcccgtacgtaacctctttccggtccgtacgtcccgtacgtacgttccgacgtacctaccgtccgacccgttaccccacgtacctaaccttcgtacggtaccgggtaccggtcccggtacccgggttacgggaaggtacggtaggtacggtacgttacgtaacctttaggttgtaccgacgtacctacggaacccggtaccggtaaccgtaacgaacgttcgaggtactaacgtacgttacgcgggttacggtcgggtcgggttacggtcggggtaacgggtaccggaaccggtaacgtacgtaccgtacccggngtaccggacg

SEQ ID NO: 24619 - DNA, 698 bp, Homo sapiens
  misc_feature: GYAE6OF01ERZB0.21.22.B11.1.454.CMB.1.raw
  modified_base (676)..(676): a, c, t, g, unknown or other
  misc_feature (676)..(676): n is a, c, g, or t
  modified_base (682)..(683): a, c, t, g, unknown or other
  misc_feature (682)..(683): n is a, c, g, or t
  modified_base (687)..(687): a, c, t, g, unknown or other
  misc_feature (687)..(687): n is a, c, g, or t
  modified_base (693)..(696): a, c, t, g, unknown or other
  misc_feature (693)..(696): n is a, c, g, or t
  modified_base (698)..(698): a, c, t, g, unknown or other
  misc_feature (698)..(698): n is a, c, g, or t
tcagtcgtcgctcgcacgaccggtgctcgatttagacgacagctcagggtcctggggcccagtctgtgctgactcagccaccctcagcgtctgggaccccgggcagagggtcaccatctcttgttctggaggcaactccaacatcggaagtaattatgtattctggtatcagccaactcccaggaatcggacccccaaactcctcatccaagaggaataatcagccggcctcgacgggtccctgaccgattctcgtggcctacaagtctggccacctcacgccctcctgaccatcgaggtcggtccgtccggtacgaggtcgtaggacgtctagtacttaagttactggtacgactacgtaccggaaccgggacgaccaagaggtaggactacgaactaacgttcgtagggacgggttggggtttgggttacgggttacgggacgggtaaccgggtaaccgtaaaccgtccgtaacccggtcgttacgggtaccgaccggtacccgaacgggtcccgtccccgggtaccccgttcgggttacctacccgtttcccgttcccggtttcccccgtaccccgtttcccttccccggtttaccgtttcccgtaacgttaccgtaccggtaacgggtccgggtaccggttcggaccggtaaccggccgtaacgtacgtagngtaccnncgtngtcagnnnngn

SEQ ID NO: 24620 - DNA, 831 bp, Homo sapiens
  misc_feature: GYAE6OF01CMYFW.21.22.B11.1.454.CMB.1.raw
tcagtcgtcgctcgcacgaccggtgctcgatttagacgacagctcgagggggggggaagctcagcttcagctggtggtagagaagacaggactcaggacaatctccagcatggccgtcttccctctcctcctccaccctcctcactcactcgccgacgacgggtcccgtcgggcccctagttctggtcgctcgactcaccgacccctaccctcacggccggttccggaccggggacccccccgggagacggtaggggtaccctaccgtacttctttccgtttggtttaccggtagggaaccggtaaccctaaacccgtaccgtaaacctagtaacgggtaaatttaatttagttacgtttaacttcgttaggtactacgaacgaacctaaccgtaccgaaggtaccgtaccccggtaaccccaaccttccactaccgtaccgtaaggaacgtaactaacgtcgaccggtcccggacccgtacggccggggttacctacggaccgttaccttcgtcgtacgtaccctacggtacgtccgttaccggacctcccgtacgtccccgtacctacccgtccgtaccgtaccgttaccgggtacgggtcccgggttaccgtacccggggtacggaacggtacggtacggtacgttcgtaacgtttacgttaacgttcgttacgacggtaaccgtacgtaacccgggtaaccgaccgtacgtaacgaggtacggacgtacgtacgtaacgtcggtaggtacgggttggggttcgggtacggtaccggggtaaggaccggtaaccggtaccaccgggtacccgcggttaccggtaccgg

SEQ ID NO: 24621 - DNA, 729 bp, Homo sapiens
  misc_feature: GYAE6OF01B3BJY.21.22.B11.1.454.CMB.1.raw
  modified_base (217)..(217): a, c, t, g, unknown or other
  misc_feature (217)..(217): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (371)..(371): a, c, t, g, unknown or other
  misc_feature (371)..(371): n is a, c, g, or t
tcagtcgtcgctcgcacgaccggtgctcgatttagacgacagctcaggggggggaagctcagcttcagctgtggtagagaagacaggactcaggacaatctccagcatggccggcttcctctcctcctcaccctcctcactcactgcgcgagggtcctcgggcccagtctgtcgctgactcacgcccaccctcacgcgtccgtcggggacccccggnaggacgggtccacctactcttcttcgttcgtgggaggaccaactccaaacagtacggaaagttattattntacttcgtggtanctacgactaacctccgaaggtaactccggacccctaaactccctctaactaccgaggtaaacgtaataacncgacggcccggtaccctaccggtaccggggtcctcggaaccttcgttccgtacgtacggtcctaccggtagtccgtcggaccctaccgtaccgaccgttaccctccctaacgacctataccgggtacggtccgggtccgttcccgggtacggacggtacgttcgggaacggtcgtaacggtactttacgttacgtgacggtaactaccgtaacggaacgggtaccgtaataaacggtggacgggactaggacctaaagtcggttaggcgggttcggggtttaggggttcgggcggggtaaccggaaaccgggtaacctaacggtacccgggtaaccggttacggttaccggaacccgg

SEQ ID NO: 24622 - DNA, 702 bp, Homo sapiens
  misc_feature: GYAE6OF01DWFX2.21.22.B11.1.454.CMB.1.raw
  modified_base (105)..(105): a, c, t, g, unknown or other
  misc_feature (105)..(105): n is a, c, g, or t
  modified_base (244)..(244): a, c, t, g, unknown or other
  misc_feature (244)..(244): n is a, c, g, or t
  modified_base (691)..(691): a, c, t, g, unknown or other
  misc_feature (691)..(691): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
  modified_base (702)..(702): a, c, t, g, unknown or other
  misc_feature (702)..(702): n is a, c, g, or t
tcagtcgtcgctcgcacgaccggtgctcgatttagacgacagctcagggtcctgggcccagtctgtgctgactcagccaccctcagcgtcgtcgggaccccgggnagagggtcaccatctcttgttctggaggcaactccaacatcggaagtaattatgtattctggtatcagcaactcccaggatcggccccaactcctacagtccagacggaataatcgacgccggccctcgacgggtcccngaccgtattctcgtgcctcaagtctacggccacctcaccgtccctccctagaccctatacgacggttcgggcccgttcccgggtccggaagggtacgtaggaacggtcgtacgtacttacgtttaccgtgtacgtcacggtaccggaccggaacgacgtaaaaggttcggatacgaactaagttcgaggtaggtcggggtttgggtcggttacgggacgggaacgggtaacgtaaacgtccggtaccggtccgtacggtacgacgaccgaacggtccgtacccgtccccggtcggtacccgtaccgttcccgttacccggttcccccgtacccccgttcccgttcccttaccgttacccgttccttccggttaacggccgggtcgggtaccggtacgggaccggtaacggtccgaccgtaagtacggtcgatacgtcgagtagcgtnctacncngtgn

SEQ ID NO: 24623 - DNA, 855 bp, Homo sapiens
  misc_feature: GYAE6OF01A8R4C.21.22.B11.1.454.CMB.1.raw
tcagtcgtcgctcgcacgaccggtgctcgatttagacgacagctcagggggggggaagctcagcttcagctggtggtagagaagacaggactcaggacaatctccagcatcggccggccttccctctcctcctccaccctcctcactcactcgcgccgacgggtccctcggggcccacgttcgtcggtgtcgttgccgtaccgacgcccctaccccgttcgacggtccgtccggttcccgggggaccccccgggacgacggaaccggggttaccacccgtattccgtttcgtttcggtttcgttagggacggaccaaccgttaccaaacgtacggttacgggtaaaaggttaattttagttacgttacgtttccgttaggttatccaacgtacctaaccgtaccgacggtaacgtaccggaccccctaaaccgtccctactaccgtacgaacggtaaggtaactaacgtaccgacggaccccgggttacccgtacccgggacggggttaccccgtaggtaccccggtactttccgtcggttcggtacccgttaccggtaaccgttcctaaccgggtcccgtaccccttaccgtcccggtaccctacccgtaccgaccttaccgtacgtaaccggtcgggtcccggtaccggtaccggaacggtcgtggtaccgggtacgttaccgttacttacgttaccgttacgtaacggtctacccggtacgacccggtaaccgacgttaacccaggtacggtagtacgtaccgtaacgtcgggtagtcgggtttacgggttcggtcgggttacgggacggaacgtaaccgtacgggtaccgtaaccgtccggtacgtaccgg

SEQ ID NO: 24624 - DNA, 930 bp, Homo sapiens
  misc_feature: GYAE6OF01C8CFV.21.22.B11.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagacgacagctcgaggggggggaagctcagcttcagctgtggtagagaagacaggactcaggacaatctccagcagtcggccgtccttccctctccctcctccaccctcctcactcactgcgcgacgggtccgtcgggccctagtctgtcgtcgtacgtacctcgaccgccccacccgtcgcggtccgggtccggtaccgggggaccccggganagggtacggtaccactacttcgttcgttcggttcggagggacgacctaacctacaacgtacgttaccggaaagtttaattacggttagttactttagtaggttaactacgaacgtaccctaaaccggtaccgtaacggaaccgtacccccggtaacccctaaacgtccctaacgccctaacggaaggaaacgtaaacgttaacgccggacggccccggttacccggtacgggtaccggggtacccgtaacggacccttcgttaccgttacgtccgtccgtaaccgtacgttccgaccgttacccacgttaccgacccgtacctacccggtactaccgccggtacggtaccgggggttccggtacccggttacccgggtaggaacggtacggtacgggtaacgacccggttttacgttaacctttaacggttagtaccgggtaaccgtaccccgtaagggtaacccgggaccgggaaccggttaaaccggacggttaaagggtcccggtaaaagtaccgtaaaccgggtaacgtttgggggtacccggggttaagggggttcgggggtttaacggggtacccgggggttaacgggggaacccggggtaaacccccgggttaaccggttaaaccggtaccccggggttttacccggtaaaccgggttaaccccggtacccggggg

SEQ ID NO: 24625 - DNA, 757 bp, Homo sapiens
  misc_feature: GYAE6OF01CLBHH.21.22.B11.1.454.CMB.1.raw
  modified_base (223)..(223): a, c, t, g, unknown or other
  misc_feature (223)..(223): n is a, c, g, or t
  modified_base (626)..(626): a, c, t, g, unknown or other
  misc_feature (626)..(626): n is a, c, g, or t
tcagtcgtcgctcgcacgaccggtgctcgatttagacgacagctcgagggggggggaagctcagcttcagctgtggtagagaagacaggactcaggacaatctccagcatggccggcttccctcgtcctcctccaccctcctcacttccactgcgcgtacgggtcctgggcccagtctgtgctgactcacgccaccctgaggtcgtcgtcggggacccccggnaggacggtccactatcttcgttgttcgtacggacggtccaaactccaacgtagtacggtaaagttacttatcgtaattcgtaggtactccaggtccaaccgttcccgaaggaacgtcccggaccccctaaactcctcgaaccttacaaagggaactaaagtaagtccggaaggtccggtaacccgtggtaaccggggtccctaaggtacccgtaactttccgtacgtcggtcctaaccgtaacgtcgttaccgcgtacctacgtacctccctaacccgtacgacccgtattaccggtcgggtcggtaccccgtccgggtaacggtaggaaccgttcgggaccgtcgtaacgttaccgttaagtttccgtgtaccgacctaaacgggtccccaaacgggggttnaaaccctaacggttagccgggaatccgaactaacggttgggaacgtcggggttagggtccggttaaacgggtccgggaaccgggtaagtaaccccggttaggtaccggcccggttaggcccggtaaaccgg

SEQ ID NO: 24626 - DNA, 814 bp, Homo sapiens
  misc_feature: GYAE6OF01C0678.21.22.B11.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagacgacagctcgagggggggggaagctcagcttcagctgtggtagagaagacaggactcaggacaatctccagcatggccggtcttccctctcctcctccaccctcctcactcactcgcgcgacgggtcctgggcccagtctggtgtctgactcacgcccacctcaggcgtccggaccggggacccccggngacggacgggtccacctattcctttctttcggttcgtggggacgaccaaccttaccaacgtacgttaacggtaacgttaagtttagttacgtttaacgtttcggttaaggttactacgacgtaacctaaccctacccggaacgggtaaccgtaccccgggtaaccccctaaaccttccctaaccgtaccaccgtaacgggtaacgtaaattaaccgtaccgaccgggtcccggtacccggtcgggtaacccggggttccgtaaccggtaccgttacttccgttcggttccgtaccttaccgtaacgttcggtaccgtacccgtaccttccgccttcccgtaccgtcgtaccctacgtccggtacgggaccgggtccgttaccgggtacggagtacgacggtacggtctacgtacttagtcggtacgtcgaacgtacgtaccggccgggtacacgggtaacgtagtacggtcgaagtaccgtacgttcggtacgggttcgggttaggggtttcgggtccgggtacggggtacggtaaccgggaaacccgttaacggaccggtttacccgggtaccggtcgggtaacccgg

SEQ ID NO: 24627 - DNA, 789 bp, Homo sapiens
  misc_feature: GYAE6OF01E0PR8.21.22.B11.1.454.CMB.1.raw
  modified_base (246)..(246): a, c, t, g, unknown or other
  misc_feature (246)..(246): n is a, c, g, or t
  modified_base (449)..(449): a, c, t, g, unknown or other
  misc_feature (449)..(449): n is a, c, g, or t
  modified_base (632)..(632): a, c, t, g, unknown or other
  misc_feature (632)..(632): n is a, c, g, or t
tcagtcgtcgctcgcacgaccggtgctcgatttagacgacagctcagggggggggaagctcagcttcagctgtggtagagaagacaggactcaggacaatcctccagcatcggccggctttccctctccctcctccaccctcctcacctcactcgcgcgacgggtcctcggggcccagtcgtgtcgctgacctcacgtaccccaccctcgacggtccggtcccggtccggggggaaccccccgggngaacgggtacgggtaccaacctacttccgtttcgtttggttaccggagggacggtaccaaccttaccgaaaacgtagtaccgggtaaagtttaattacgttagttacttccgttaggtactacgacgtaaccaacctacccggaaggtaacctcccggtaaccccctaaactcccgtaacaccgtagaacggaagtaataacncgaacgtcccggtcccgtacggtaccgggtccaacgtacctcgtttaccgcgtcggtcctacgtacgttcacggtaccctcgtacctacgtccccttacgaccgtacgttacgcgtccggggtccggtccgtcccgggtacggtaggtacgtaggtccgtacttacgtaacttacgtttacgngtaacgtcgtaaccggtaccggacggtaccaacggtaacgtaggtaccggtaatacgaacgtccgtacggtagggttacgggttcgggggttcggttccggggtacgggaacgggttaacgaaccgtaccgacggttaccgtcggtaaggtaccccg

SEQ ID NO: 24628 - DNA, 744 bp, Homo sapiens
  misc_feature: GYAE6OF01DROYI.21.22.B11.1.454.CMB.1.raw
  modified_base (178)..(178): a, c, t, g, unknown or other
  misc_feature (178)..(178): n is a, c, g, or t
  modified_base (227)..(227): a, c, t, g, unknown or other
  misc_feature (227)..(227): n is a, c, g, or t
  modified_base (317)..(317): a, c, t, g, unknown or other
  misc_feature (317)..(317): n is a, c, g, or t
  modified_base (500)..(500): a, c, t, g, unknown or other
  misc_feature (500)..(500): n is a, c, g, or t
  modified_base (556)..(556): a, c, t, g, unknown or other
  misc_feature (556)..(556): n is a, c, g, or t
tcagtcgtcgctcgcacgaccggtgctcgatttagacgacagctcagggggggggaagctcagcttcagctgtggtagagaagacaggactcaggacaatctccagcatggccggtcttccctctcctcctccacctcctcactcactgcgcgagggtcctgggccctagtctggtcnctgactcgacgccacctcacgccggtccggtaccggggaccccccgggnacggtacgggtacctaaccgtcttcttctttcggttcgtacgggaaccgcctaaaccgtccaaacgtacgtacgggttaaaattaagttntagtttacttcgtaggtactagacgcctaaccgtccgaaaggtaaccgtcccgacccctaaccgttcctactaaccggtactaaggtaaacgtaatacgtaccgacggcccgaccgtaccgcgggggttcccacgaacggttctccgtacgcggtacctacgtacgttcggtacgccctaacnccgtaccgttacccctcgtaccacgtacctagggtccggtacggcccggtaccggnggaacgtaggtaccgacggttacgttacgttaacgttacttacgtcgggtaacacggtccggttacgacccggttaacacgttaacgaggtagtaaacgtctaacgtacgtccgtggggttacggcgggttttaggtccggggtacgggaccggtacaaccggtacgtaggtcccgtagtgggacccg

SEQ ID NO: 24629 - DNA, 716 bp, Homo sapiens
  misc_feature: GYAE6OF01BF8CL.21.22.B11.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (278)..(278): a, c, t, g, unknown or other
  misc_feature (278)..(278): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgacgggtccgtcgggcccagtctgtgctgactcacgcccaccctnacggtccgtaccgtccggggacccccggngaggacggtaccacctgttccttgttcgttcgtagggacgcctaacctccaanagtacggaattaattatgtattcgtaggtatcgacgacctaacctaccgaggtaaccgtacccggaacccctaaacctcccgtacactaccgaaggaacgtaactaacgtccgacggcccggtcccgtcggtaccggggttacccgtcgtacccgttacttaccgtccggtacgtaccgtaaccgtacgtcgtacggtaccctacccgtcgacccgtcccgtaccgtaccgtaccacgtacggtcggtcggtccgtccgggtaccgagggtagcggtaacggtacttacgtactttacgttcgtacgtcgtcctacggtacccggaacggtaccaacgtaacgtagtacgggatacgtaactacgtcggtacggtaggttcgggttagggtcggtaccggggacgaccgggtaacaccggtacgcggtacgcgtaccg

SEQ ID NO: 24630 - DNA, 859 bp, Homo sapiens
  misc_feature: GYAE6OF01B2JCR.21.22.B11.1.454.CMB.1.raw
  modified_base (137)..(137): a, c, t, g, unknown or other
  misc_feature (137)..(137): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcncactcactgcgcgagggtccgtcgggcccagtctgtgctgactcacgcccaccctcacgcgtcgtccggggacccccgggcgacggacgggtcacctacttcttcgtttcgttcgtgggacgaccaacctacaacagtacgtaaagttaattacgttattacttactggtactacgacgacctaacctcccgaaggtaaccgtcccggtaaccccctaacctccgtacctactaccgaaggtaacggtaaattaacgaccgtaacggcccgtacccgtccgggtaccgggttcccaaccggtaccttacttccgtcgtccgtcctaacgtacgttccgacggtaccctaccgttcccgaccgtaccccgttacccgtccggtaacccacggtaccggtaccggggttcccgggtccccgggttacccgggtacgggtaaccggtacggtaacggtaccgggttaccgttaacgtttaaacccgttttacgttaccgttacgggtacttaacccgggtaaccggtacccggggaacgttaaaccggaccgttaaacgggtcggtaaccggggttaataccggtaaaccccgttagttggggttaaccggttaggggggtttccgggttacgggggttaccgggttaccgggggaaacccgggtaaccgggttaccgtaaaccgggttaccccggaccggttaacccgggtacccggtaccggg

SEQ ID NO: 24631 - DNA, 551 bp, Homo sapiens
  misc_feature: GYAE6OF01BEU71.21.22.B11.1.454.CMB.1.raw
  modified_base (148)..(148): a, c, t, g, unknown or other
  misc_feature (148)..(148): n is a, c, g, or t
  modified_base (199)..(199): a, c, t, g, unknown or other
  misc_feature (199)..(199): n is a, c, g, or t
  modified_base (319)..(319): a, c, t, g, unknown or other
  misc_feature (319)..(319): n is a, c, g, or t
  modified_base (321)..(321): a, c, t, g, unknown or other
  misc_feature (321)..(321): n is a, c, g, or t
  modified_base (325)..(326): a, c, t, g, unknown or other
  misc_feature (325)..(326): n is a, c, g, or t
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (338)..(339): a, c, t, g, unknown or other
  misc_feature (338)..(339): n is a, c, g, or t
  modified_base (341)..(341): a, c, t, g, unknown or other
  misc_feature (341)..(341): n is a, c, g, or t
  modified_base (343)..(344): a, c, t, g, unknown or other
  misc_feature (343)..(344): n is a, c, g, or t
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcacngcgcgtacgggtcctcgggcccagtctgtgctagactcacgccctaccctnacgtcggtccgtacggggaccccccggataggtaacgggcaacctattcttaccgttgtttcgaggtacgcctaaactaccaaacgtagtacggtaattaagttatacgtagtttaccananagannanatanaganannanannantanananananananacgagagagacagagtanacgcaganananagagagacgacgagagagtacgagacgacacgagacganacagtagtagacgatatagtanagtanacgtacgacgacgaacgacgacgacgacgtacgacgtaagaactaacgtaacacacgagtagacgtaacgtacgtaacaacgtacgtagaagag

SEQ ID NO: 24632 - DNA, 840 bp, Homo sapiens
  misc_feature: GYAE6OF01AK2NT.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgagggtcctcgggcccagtctgtgctgactcacgccaccctcagccgtcgtccggggaccccggcaggacgggtccaccatctcttgttcgtggacgcactaccaacagtacggtaatattatgttacttcgtggtactcagccaacctccgaaggacgtaccggaccccctaaactcctacacgtaccgaaggaaggtaaattaacgacgtacggcccggtacccgtacggaccggggttaccctacggtaaccgtacttcgtcgtacggccttacccgaagttccgtacggtaccacccgtaccgtaccgtccccgttcccgtacggtaacccaccgttaccggtacgggttcccggggtacccgttccccggggtaccgtagggtaccgttcggggtaaccggtacgttacggttaacctttacggtttaccgttacgggttaccttaaccgggtaacccgttaccgggaaccccggggtaacgtaacccgaaacggttacggggtaacgggtaaccttacggtaaccgttaaacgggttacggttaaacggggcggggttttacccggggggttttacggggttaccggggttaccccggggggaacggggaacccgggttaaaccccggttaaccgggtaaccccggttaccccgggttaaccggttaacccgggtaaccccggg

SEQ ID NO: 24633 - DNA, 728 bp, Homo sapiens
  misc_feature: GYAE6OF01D64RD.21.22.B11.1.454.CMB.1.raw
  modified_base (122)..(122): a, c, t, g, unknown or other
  misc_feature (122)..(122): n is a, c, g, or t
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (561)..(561): a, c, t, g, unknown or other
  misc_feature (561)..(561): n is a, c, g, or t
tcagtcgtcgctcgcacgaccggtgctcgatttagacgacagctcagggggggggaagctcagcttcagctgtggtagagaagacaggactcaggacaatctcagcatggccgcttccctcncctcctcacctcctcactcactgcgcgtacgggtcctcgggcccagttctgtcgctgacctcgacgccctaccgtcacggccggtcgtaccggggaccccgggnacgggacggtaccaacctgttctacgtttcggtacgnggaacgcctaaactccaaagtacgtaacggtaattaagttagttacgttaacgttcgtacggtatacgacgactaacctaccgaacgactaccggacccctaactccgtatacctacgaaggtagtaaactagaccgacggtccggccctacggaccgggggttaccctacgtaaccgttcgttacgtcgtacggtaacctacgaacgtttcggacgtaccgacgttaccgaccgtcccttacgaccgaaccgtcgtacggtacggggtacggtaccgtaccgggtcgaacgggttanacggtacggtactacggttaacttacgtaacgttcgaccacgtacggtaaccgcgggaactaccgaaggttacgacggtacaagtactacgtacggtcggggtagtccgggttaggtcgggtaccggaacggtaaccggtacacggtaccgtacgtgaccgggtaac

SEQ ID NO: 24634 - DNA, 311 bp, Homo sapiens
  misc_feature: GYAE6OF01BU5ME.21.22.B11.1.454.CMB.1.raw
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
  modified_base (307)..(311): a, c, t, g, unknown or other
  misc_feature (307)..(311): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcgacgggacgacaacagtgggatgaacaatctgagtcgggttggtgttcggcggagggaaccaaactgaccgtccgtaggtcacgccgaaggcctccgcccccgtcgtcactctcgtccccgcctcctcctcgtctctactgngcggctggcaggcnatagnnnnn

SEQ ID NO: 24635 - DNA, 886 bp, Homo sapiens
  misc_feature: GYAE6OF01DJ5UI.21.22.B11.1.454.CMB.1.raw
tcagtcgtcgctcgcacgaccggtgctcgatttagacgacagctcagggggggaagctcagcttcagctgtggtagagaagacaggactcaggacaatctccagcatggcccggcttccctctcctcctccaccctcctcactcactgcgcgagggtcctgggcccagtctgtgcctgacctcacgcccacccctcacgccgtcgtccggggaccccccggcgaggacgggtaccaccgtacttcctttcgtttcgttcgtacggacgggacctaaccgtaccaacgtaacgttaccggtaaaggttaaattttaagttacgtttacgttttaccgtttacgggttaacttaccgaacggtaacctaaccccgtaccccgtaagggaaacggtttaccccgggaaccccccttaaacccgttccctaccttaaccgtcccaaagggaacggtaaagtaacctacgtacccgggccccgggtaccccttccgggtaaccggggttcccccgtaacggtacccttacgtttaccgttccgtccgggtcctaccgtaaacgtcgttccgaccgtacctccgaccttccccgtcctacccgaacccttctaccggagggttcccggtccgtacccgggttacgaccgggtgacggtacggtcccgaagttaccttaacgtttacctacgggttacgaccgttacgtcccggtaaacggggccaaccggttaacgagggttacggtaactaccggtacgtaacgtcggttaaccgggtcgggaccgggggtttttcggtcggggttaaccgggtaccggggttaaccccggtaccggtttaaaacggtcccgggtttaaacccggtacccgggtttaacggaacccccggg

SEQ ID NO: 24636 - DNA, 709 bp, Homo sapiens
  misc_feature: GYAE6OF01E3DBO.21.22.B11.1.454.CMB.1.raw
  modified_base (323)..(323): a, c, t, g, unknown or other
  misc_feature (323)..(323): n is a, c, g, or t
  modified_base (375)..(375): a, c, t, g, unknown or other
  misc_feature (375)..(375): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctccactcactgcgcagggtcctgggcccagtcctgtgctgactcagccaccctcagcgtcgtcggggacccccgggcaggacgggtcaccatccttcttgttcgtggaggcaactccaacagtacggaagtaatttatgtattctggtatcagcaacctaccaggaactcggacccccaaactccncactaccagaagaataatcgacgccgccctcgaccggggtccctcgaccgtnttctctggcctccgaagtccgtcggccacctacgaccgtcccttacccgtcgaacccgtactcggtacggttccgggtcccgttcccgggtacggacgggtagtacgggacggtctacggtaccttaacgtttccgnggttacncgtaaacgcccggaaacgggacgtaccaaagtacgtaggggtaacaccggtaactaacgttacggttacgggacggggttttccgggggttttcggggttccggggttaccggggggaacgggaaacccggggtaaaccccgtaaacggtttaccccggaaccccggttaaccgtacggggtaaccccgg

SEQ ID NO: 24637 - DNA, 619 bp, Homo sapiens
  misc_feature: GYAE6OF01BF4F5.21.22.B11.1.454.CMB.1.raw
  modified_base (147)..(147): a, c, t, g, unknown or other
  misc_feature (147)..(147): n is a, c, g, or t
  modified_base (259)..(259): a, c, t, g, unknown or other
  misc_feature (259)..(259): n is a, c, g, or t
  modified_base (338)..(338): a, c, t, g, unknown or other
  misc_feature (338)..(338): n is a, c, g, or t
  modified_base (603)..(604): a, c, t, g, unknown or other
  misc_feature (603)..(604): n is a, c, g, or t
  modified_base (607)..(607): a, c, t, g, unknown or other
  misc_feature (607)..(607): n is a, c, g, or t
  modified_base (610)..(610): a, c, t, g, unknown or other
  misc_feature (610)..(610): n is a, c, g, or t
  modified_base (613)..(619): a, c, t, g, unknown or other
  misc_feature (613)..(619): n is a, c, g, or t
tcagtcgtcgctcgcacgaccggtgctcgatttagacgacagctcagggtcctgggcccagtctgtgctgactcagcccaccctcagcgtcgtcgggaccccccgggcaggagggtcaccatctcttgttctggaggcaactccaanatcggaagtaattatgtattctggtatcagcaactcccaggaatcggacccccaaactcctcatccaaggaaggaataatcacgccggccctcggacgggtccctgaccgtnttctcgcggtcctaccgagtctggccacctcacgccctccctgaccactcgaggtcgggccgttccgggtaccggaggngtggaggtcctagtacttagttactgtgacgtacgtaccggaacggtacgaccaacgagtagggtatagaactaacgttcggaggtacggtggggtttgggtcggtacggggacgggtaacgggaaccgtaacgtcggaccgttacgtaggtacccgacgccgaacgcgtcccgccccgtcggtacctccgtccgtctccccgtccccttccgtcccgtctctcgtacgtcggacggcgtcggcgacgacggtcgacgcgtacgnngcncgncgnnnnnnn

SEQ ID NO: 24638 - DNA, 878 bp, Homo sapiens
  misc_feature: GYAE6OF01CGBBH.21.22.B11.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagacgacagctcgaggggggggaagctcagcttcagctgtggtagagaagacaggactcaggacaatcctccagcagtcggcccggtccttccctctcctcctccaccctcctcactcactcgcgacgtacgggtccgtcgggccctagttcgtgtcgctgacctcaccgccctacccgtcgacgtccggtccggtacccggggaccccggngacggaccgggtaccacctacgttctttcgtttcgttccgaggtacgacctaaccgtaccaaacgtacgtaacggttaaagtttaactttagttacgttacttcgttacgtactaccgacgaccgtaccgtaccgaacggtacctaccccgaaccctaacctcctacgacgtacgaagtaagtaactacgcgtacgccgtacgtcggtaccggtacctcgacgttcgttctacgcgtactacgtagtaccgcgtaccgaccttcgacccgtcctaccgacgtaacccgtcttacggggtacgggtcccggtaaccccgtacggggtaacgcggtttagcccgggtacgttaccctaaccgtttaaagtttacgtgttaaccggtgtaacccgtaaccgggttacccggaaagggtaaccctaacggtaacgggttacggtaccggtttaacgaacccgtttaaggtttccgtaaacgggggttttcgggggaccccgggttttttagggggtttacccgggggttaaacccggcggggggtaaaaccccggtttaaaaaccgggtaaccctttccccggggggtaaaccttttaaccccccggggggttaaagttcccccgggtaaaaaccgg

SEQ ID NO: 24639 - DNA, 756 bp, Homo sapiens
  misc_feature: GYAE6OF01ENNW4.21.22.B11.1.454.CMB.1.raw
  modified_base (474)..(474): a, c, t, g, unknown or other
  misc_feature (474)..(474): n is a, c, g, or t
  modified_base (683)..(683): a, c, t, g, unknown or other
  misc_feature (683)..(683): n is a, c, g, or t
  modified_base (737)..(737): a, c, t, g, unknown or other
  misc_feature (737)..(737): n is a, c, g, or t
  modified_base (744)..(746): a, c, t, g, unknown or other
  misc_feature (744)..(746): n is a, c, g, or t
  modified_base (748)..(748): a, c, t, g, unknown or other
  misc_feature (748)..(748): n is a, c, g, or t
  modified_base (750)..(750): a, c, t, g, unknown or other
  misc_feature (750)..(750): n is a, c, g, or t
  modified_base (752)..(756): a, c, t, g, unknown or other
  misc_feature (752)..(756): n is a, c, g, or t
tcagtcgtcgctcgcacgaccggtgctcgatttagacgacagctcagggtcctgggcccagtctgtgctgactcagccaccctcagcgtctcgggacccgggcagagggtcaccatctcttgttctggaggcaactccaacagtcggaagtaattatgtattctggtatcagcaactccaggaactcggacccctaaactcctcacgtccaggaaggtaacttaacacgaacggccgggtccccttacgaacgggggttccctacgaaccggtatttcctcgtggcctaccgaacgttcgtacggccacccttcgaacggtccccttcccgtacggaaccctacgttaccggaagggttcggggcccttttacccggggaccgggtacgggtaaccgtttggggaaacggtcggtttacggactttaacgtttaaccggttgtcggactacgtacggaccggaccgtacaacgnggtacgggatacggaactagtcgtggggacggtcggggtttcggggttcgttacgggggacggaacgggtaaaccaacgttacggtaacccggttacgtaacggggttaccaacggtacccgaacgggtcccgtacccggttccccgttaacggtccaacgttcccgttccgttacccccaccggttccttcccgttacggtttacccncgttaaccgtcggaaccggtgaccggttcggacgtcgggactccgaagtacggntcggacnnncncncnnnnn

SEQ ID NO: 24640 - DNA, 799 bp, Homo sapiens
  misc_feature: GYAE6OF01EVDKA.21.22.B11.1.454.CMB.1.raw
  modified_base (321)..(321): a, c, t, g, unknown or other
  misc_feature (321)..(321): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcacccctcctcactcactgcgcagggtccgtgggcccagtctgtgctgactcacgcccaccctcacgtcgtcgtcggggacccccgggcgaaggacgggtccacctacttcttccgttcgttcgtagggacggcctaacctaccaactagtacggtaaagttaattatgttacttcgtgtatcagaccaccnccgaaggactaccggtacccctaactcctacactaccgagaagtaactactacgacgcccggccctacggtaccggggttacccacggtacgtacttccgtcgtccggtacctaccgtaacggttccgtccggtaccctaccctccgaaccggttcccccttaccggtaaccgtaccctacgtaccgttacggggttacccgggtaccccggttacccggggtccggtaagggtacgttacgggtaaccgggtcgtaacggttaacctttacggtttacgtacggtcgacgttaccgtacccgggacccgggtaacgaccgtaaatacgggttacgggaagttaccggtaactacggtaccgggttagggtaccggggtttacggggtttcggggttaccgggtaccggggaacggggtaaaccgggtaacccggaacgttacccggggtaccgttaccccgggtaaggtaaccccgg

SEQ ID NO: 24641 - DNA, 754 bp, Homo sapiens
  misc_feature: GYAE6OF01CKE46.21.22.B11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagacgacagctcgaggggggggaagctcagcttcagctgtggtagagaagacaggactcaggacaatctccagcatggccggcttccctctcctcctccacctcctcactcactgcgcgagggtccgtcgggcccagtctgtgctgacctcacgcccaccctcacgccgtcgtaccggggaccccggnaggacgggtcaccgtattccttcgtttcggttcgtgggacgacctaaacctccaaacgacgttacgggtaaaagtttaaatttattcggttatttacgttaggttaactcgtaacgacctaaccctaccggaaagggtaaccgtacccggtaaccccctaaccttacctaccgactaccggaaggtaacggtaaaacttaacgtccgaacggcccggtacccgtacgggtaccggggttccctaacgaccgtttacgttctccgtacggtcctacgtaacgtcgtacgcctacccgtcgtacctcccgtacctacgacctctcggtacgggtcggtccgttacggtacgggaagtcgtacggtacgtcgtagttaccgttagtcttgacgtcgacgtacggaaccgggactacgtaacggaggttcgaagtacgtaacgtacgttaggtggtcggggtcggggtttaggttcggggtaccggtacggggaacgttaacgtaaacgggtcgtaccggttccgtacggtacccgg

SEQ ID NO: 24642 - DNA, 871 bp, Homo sapiens
  misc_feature: GYAE6OF01BW8T2.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcactggccgcttccctctcctcctcaccctcctcactcactcgcgcgacgggtccgtcgggccctagttctgtcgctcgacctcgacgccctaaccctcgacggtccgtccggtcccggggacccccggacgacggtacggtaccaccgttacttccgtttacgtttcggttccgtagggtaccgacctaaccgtaccgtaaacgtacgttacggttaaagttaacgtttacgttacgtttacttacgttacggttaactaccgtaacgtacccgtaaaccgttaccccgaacgggtaaccgtaccccggtaacccccttaaaccttccctaacgtaccgtaacgaaggtaacgtaaacttaaccggtacgaccggtaccggtacccgtacggtaccggggttccctacggtaacgttcgttccgtacgtacgtaccgtaaccgtacgtccgtcgaaccctaccgtaccgtaccgtacccgtaccgtaccgtaaccgtacgttacggacgggtacccgggtccgtaccggggtaccggtagtaacggtcggaaccgtccgttacgttaacgtttacgttcggtccgttacgacgttaaccggtaccgggaacgggtaccgtaacgaacgtacggtacgtacgacgttaacgttacggtaggtaccgggtacgggtttcggggttacgggttaacgggtccgggtaaaacgggtaacccgtaaccggttaacggttacccggtaccggttaacggacggtaacccgg

SEQ ID NO: 24643 - DNA, 866 bp, Homo sapiens
  misc_feature: GYAE6OF01A2PTD.21.22.B11.1.454.CMB.1.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgctagggtcctagggcccagtctgtgctgacctcacgcccaccctcacgtcgtcgtccggggaccccggnaggacgggtccacctntccttcttgtcgnggtacgcctaacctccaacgtagtaccggtaaagttaattataggttactttcgtaggttaactcagtacctaacccgtacccgaaggtaaccgtacccggaacccccctaaaaccgttccctaccgaacgttacccgaaggtaacggtaaaacttacgtaccggaacggtaccccggttccccgtaaccgggttaccgggggttacccctacgggtaaacccgttactttacccggttaccgttcccggggaaccttacccgtaaacggttcccggttaacgggacccccttaaaccccggttccgtaacccgttcccccgttaaccccgttcgtaaaccccgtaacgtttaccggtacgggttaacccgggtccccggttaaccggggtccggtaacggacgttacgggtacggtacctaccggttaattaccgtttacgtggtaccgtacggtacgtaccgggaacgggacgtaccgaacgtcggtaagggtacctagtaccgtagtacggcgggttaacggttcggggtttacgggttccgggaacccggggtagggtaaacccggtaacccgtaaccgggttccggaacccggttcggaaaccgggttaccccg

SEQ ID NO: 24644 - DNA, 373 bp, Homo sapiens
  misc_feature: GYAE6OF01A5CBI.21.22.B11.1.454.CMB.1.raw
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
  modified_base (322)..(373): a, c, t, g, unknown or other
  misc_feature (322)..(373): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacagtgggatgacaatctggagcggttgggtgttcgggcggagggaccaaacgtcgaccgtcctaaggtcacgccaaggctcgccccctggtcactctcgtcccgccctctcctcgtctctactgacgcggggtctggctaacgggngaccngtaacggntgccnnnnnnnnnnnnnnnnnnnnnnnnnnnnnnnnnnnnnnnnnnnnnnnnnnnn

SEQ ID NO: 24645 - DNA, 892 bp, Homo sapiens
  misc_feature: GYAE6OF01CNMTW.21.22.B11.1.454.CMB.1.raw
  modified_base (240)..(240): a, c, t, g, unknown or other
  misc_feature (240)..(240): n is a, c, g, or t
tcagtcgtcgctcgcacgaccggtgctcgatttagacgacagctcaggggggggaagctcagcttcagctgtggtagagaagacaggactcaggacaatctccagcatcggccggtccttccctctcctcctccaccctcctcacctcactgcgcgacgggtccgtcgggccctagtctgtcgctacgtacctcaccgccctaccgtcacggtccgtccggtacccgggggacccccggngacggtacggtaccacctactttcttcgtttcggttcgtacggacgtaccaacctccgtaaacgtacgtaacgggtaaatttaagtttacgttgttacgtttcgttaggaacttacgaccgtaccgtaaccctccggaaacgtaccggtacccctaaccccacttaccctacgacctaccggaagaacggttaactactaccgaccggccgtacccgtacgggtcccgggtacctaccggtaccgttacgttccgttaccgtacggtaacccgttacgttacggtttaccgccgtaaccccttacccgtaccgtaccccgtcccctacctacccgaaacctccggtaccggtacgggttcccgggtcccggttacccgggtaaccgggtacgggtaccgggttaacgaaccgggttccgttaaccgtttaccgtttaacggttcggttaacggtacgtccccgtaaaccggtcccgggaaaccgggtacccgtaaacggaccgggttaaagggtacggtaaccgtaagtaacccggttatacgggttcgggtaacggggttcggggttaacggggtcgggtaccgggtaaaccgggaccggtaaaccggtacccgtaccgggttaccgtacccgggtcccggtaaacccggg

SEQ ID NO: 24646 - DNA, 780 bp, Homo sapiens
  misc_feature: GYAE6OF01B95ZS.21.22.B11.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagacgacagctcaggggggggaagctcagcttcagctgtggtagagaagacaggactcacggacaatctccagcatggccggcttccctctcctcctccaccctcctcactcactcgcgcgtacgggtccgtcgggcccagtctgtcgctcgactcacgcccaccctcacgtcgtcgccggggaccccggnaggacggtcacctacgtcttcgttggttcgtggacgtaccaacctaccgaacagtacggtaaagttaactttagtacggtttacttccgtaggtactacgagacctacgtaccgaggtacgtcccgaacccctaacgtcctacgtactaccgaaggtaaggtaatacgtacgaaccggtcccggacccgttaccgggtaccgggttcccgtaacgtaccggtttacgtacgttcgtaccggtacctaacgtacgtccgtacgacctaccgtaccaccgtacccttaccgacgtaaccttacgtaccggtcggtcccgggtacccggtacccgggtaacgtaacgggtacgtacggaccggttacgtacctaaccggtttaacttcgtacggtccgtactaccggttaccggaacgttaccgaacgtaacggttaggcgggaacctaacgaacgttacgcggttacggccgggtttggggttacggttcggggtaccggaacgggtaacccggttaaccgtaacgggtaccgtacccgggtacggtacggtacccgg

SEQ ID NO: 24647 - DNA, 896 bp, Homo sapiens
  misc_feature: GYAE6OF01DZ8FJ.21.22.B11.1.454.CMB.1.raw
  modified_base (58)..(58): a, c, t, g, unknown or other
  misc_feature (58)..(58): n is a, c, g, or t
tcagtcgtcgctcgcacgaccggtgctcgatttagacgacagctcagggggggggaanctcagcttcagctgtggtagagaagacaggactcaggacaatctccagcatggccggtcttccctctcctcctccaccctcctcactcactgcgcagggtcctgggcccagtctgtgctcgacctcaccgccctaccctcgacggtccggttccggtaccggggaccccccgggtgaacgggtacgggtccaaccctacttccttcgtttcgtttcggtacgggaacggtacctaaaccgtaccaacgtaacggttacgggtaaattaagtttagtgttactttcgtaaggtactacgaccgacctaaccgtacccgtaagggtaccgtaccccggtaaccccctaaaccgttcctaccgtaacgtaccgtaaggtaacgtaaacttaacgaccgtacggaccccggtcccggtcggtaccggggttccctaacggtaccgttacgttccggtacgtcgttaaccgtacgtaacgttccggacggtaccctaccggtactacccggtcccgttacccgtacggtaacccgtacgttccggtaacggggttcccgggttacccgggttacccgggttaacgggtacgggtacgtacgggtaccgtaaccgtacggtttaacctttacggtttacgtacgtaccggtacgttaaccggtaccgggaaccggtaccgtaaccgtaaacggtacggttaggtaaaccgtacgtaagttaccggtaggttaccggggttacgggttacccggggttacgggggtttccggtaaccggggacggggtaaaccccgtaacgggtaaaccggttccgttaacccgggtacgttccggaaaccccgg

SEQ ID NO: 24648 - DNA, 759 bp, Homo sapiens
  misc_feature: GYAE6OF01AZPH0.21.22.B11.1.454.CMB.1.raw
  modified_base (189)..(189): a, c, t, g, unknown or other
  misc_feature (189)..(189): n is a, c, g, or t
  modified_base (226)..(226): a, c, t, g, unknown or other
  misc_feature (226)..(226): n is a, c, g, or t
  modified_base (393)..(393): a, c, t, g, unknown or other
  misc_feature (393)..(393): n is a, c, g, or t
tcagtcgtcgctcgcacgaccggtgctcgatttagacgacagctcaggggggggaagctcagcttcagctgtggtagagaagacaggactcgaggacaatctccagcatggcccggcttccctctcctcctcaccctcctcactcactgcgcgacgggtccgtcgggcccagtctgtcgctgactcacncccaccctcacgtcgtccggtccggggacccccgggnacggaggtccaccacttcttcttgttcgtggacgcaacctaccaactacgtacggaaagttaacttattggttactttcgtacggtatacagacctacctaccgaacgggaacgtcccggaaccccctaaacctcctacgtacctaccgaggaacggtaaattaacncgaacggcccggtccgtacggtaccggggtaccctacggaaccgttacttccgttaccgtcggtacccttacgtaacggttccgtacgggtaccctaaccgttccaccggttcccctacccgtacgacttaccgtcgtacgggtacggtcccgtccgggtaacggtagtacggtaggtcgtacgttcgtaacctttacgttcttacgggtcgtcgtaccggtaccgtacggggtaccacgtaacggtgtaggactacggtaacgacgtttggtacggggcgtttcggggtcgggttacgggtacggggtacggttaacccggggaacttaccggtaccggttacccgtccggtaagggttccccgg

SEQ ID NO: 24649 - DNA, 674 bp, Homo sapiens
  misc_feature: GYAE6OF01EYGSW.21.22.B11.1.454.CMB.1.raw
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
tcagtcgtcgctcgcacgaccggtgctcgattttagacgacagctcaggggtccctgaccgattctctggctccaagtctggcacctcagcctcctgaccatcagtgggctccggtccgaggatggagctgacttattacgtgtgctatcgacggacgacaatagtgggaattcggaactaacgtcgtaggaggtcgggtttgggttggttcgggacgggaacgggaacctaaacgttcgaccgttacgtacggtacgacgaccgtaaggcctaccgcccccgtggtacctacttccgttccgttcccgtacccttccgtccgttccgtccttaccttaacgttcggaacggtccggggtacgtacggaaaccggacggggacctacgttacgaacggtggtaaccngagtcgacgtncgtacgngttcgattcgatcanacagacgacgacgtcgacgacgacgtacgtcgagtacgtctacgtacgtacgacgtagacgtagcgtacgtagtagtactacgtacgacgtacgtacgtacgtactacgtacgtacgacgtacgtaagacggtacgtacggacggtacgtcgaacgacgtaacgtagacgtacgaagtagtaactacgacgtactaccgtacgtacgtacgtacgtacgtacgtacgtcgtacg

SEQ ID NO: 24650 - DNA, 835 bp, Homo sapiens
  misc_feature: GYAE6OF01E2WLV.21.22.B11.1.454.CMB.1.raw
  modified_base (235)..(235): a, c, t, g, unknown or other
  misc_feature (235)..(235): n is a, c, g, or t
  modified_base (416)..(416): a, c, t, g, unknown or other
  misc_feature (416)..(416): n is a, c, g, or t
  modified_base (730)..(730): a, c, t, g, unknown or other
  misc_feature (730)..(730): n is a, c, g, or t
tcagtcgtcgctcgcacgaccggtgctcgatttagacgacagctcgagggggggggaagctcagcttcagctgtggtagagaagacaggactcaggacaatctccagcagtcggccgtcttccctctccctcctaccaccctcctcactcactgcgacgacggggtcctcgggcccagtctgtcgactgactcgacgccctaccgtcaggtccgtccggcccggggaccccgggnaacggtacggtccacctattcttcgttcgttcgaggacggaccaaacgtaccaagtacgtaacggtaaagttattagttctagtttcgtaggtactaccgaacgtccaaccggtaccgtaaggaccgtaccccggaacccctaactcccgatacctaacgaaggtaaacgtaacgtaaccncggacggtccccggtacccggttacgggacccggtttaccgtaccgggaaccgttactttcccggacttccggtaccctaacgtaccggttcggtaaccggacccttccgaaccgtccccgttacccgtaaccgacccgtttacgtaaccgttcggttaacccgggggtacggtcccccggttacccggggtagtaacgggtagtcggtacggtaaccgttcttaaacgtgtttacggcgaacgtcgaacgaaccccgggtagggaaccttaccggaagggtacgtacgggtaactaacgggtacgttaccggngtttaacgggtcgggttaggggtttccggggtaacggttaccgggggaagggtaacccgtaaaccggttacccgtaacgggtccgttaccgggttaccgaaccgg

SEQ ID NO: 24651 - DNA, 762 bp, Homo sapiens
  misc_feature: GYAE6OF01EFM5Z.21.22.B11.1.454.CMB.1.raw
  modified_base (619)..(619): a, c, t, g, unknown or other
  misc_feature (619)..(619): n is a, c, g, or t
tcagtcgtcgctcgcacgaccggtgctcgatttagacgacagctcgaggggggggaagctcagcttcagctgtggtagagaagacaggactcaggacaatctccagcatggccggtcttccctctcctcctccaccctcctcactcacgtgcgcgtacgggtccgtcgggccctagttctgtgctcgtactcacgcccaccctcgacgtccgtccggaccggggacccccgggagaaggacgggtccaacctagttccttcgtttcgttcgtacggacgacctaacctacctaacgtagtaacggtaaagttaattagtagttacttcgtaggtactacgactaaccaaccgtacccgaaggtaccgtacccgtaccccctaaacttccaactactaccgaaggaacgtaatacgtcgaacccggtccggtacccgtaccggtacggggtccctaggtaccgtacttccgtcgtcggtacctaccgaacgtccgtcgtacctaccgtacgcccgtccctccgtacgtaacctacgtaccggtcgggtccgggtaccggtccggtaccgggtaggtacgttacggacgttcgtacgtaactttcgtaacgttcggtaacncgtacgtaccgggaccgaccgtacaacgtggtaggtaccgtagtaaccgttagtacggtagggtcggggtttacggttggggttaccggaccggggtacggaaccgttaccggaccgtacgttaccgtacgttacgggacccg

SEQ ID NO: 24652 - DNA, 737 bp, Homo sapiens
  misc_feature: GYAE6OF01CK0G3.21.22.B11.1.454.CMB.1.raw
  modified_base (59)..(59): a, c, t, g, unknown or other
  misc_feature (59)..(59): n is a, c, g, or t
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (592)..(592): a, c, t, g, unknown or other
  misc_feature (592)..(592): n is a, c, g, or t
tcagtcgtcgctcgcacgaccggtgctcgatttagacgacagctcgagggggggggaanctcagcttcagctgtggtagagaagacaggactcaggacaatctcagcatggccgcttccctctcctcctccaccctcctcactcactgccgcgtacggggtcctcgggccctagtctgtgccgtgacctcgacgccctaccctgagcgtcgccggggaccccgnaggtacggtcactntcttcttacggttcgngggactaccaactaccgaatagtacgggtaaattattagttagttacgttacgttaggttacaccgaacgtaacctaccgtaccgtaagggacttaccccgaaccccctaaactcctacaactaccgaaggtaaacgaaactacacgaccgaccggtccctacgggaccgggtcctacgaaccggtcttcgtaccgtcggtaacctacgtacggtcctacggtcccacgtaccgaccgtcccctaccgtacgaccgtacgtcggtaacgggttccgggtccgtaccgggtacggtaggacgtaggtacggtcctaagttaccgttatacggtagtacncgtaacgtaccgggaacgcgtaacgacgtaggtacgggataacggtaccgagttcggtacggtcggttacggggttcggtacgggaccggtaggggaacccggtactaaccggtaccggttaccccgtgggtaacccgtacccgg

SEQ ID NO: 24653 - DNA, 793 bp, Homo sapiens
  misc_feature: GYAE6OF01CWDUC.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctgggcccagtctgtgctgactcacgcccacctcagcgtcgtcgggaccccggnaggacgggtcaccatctcttgtcgtggacgcaactccaacgatcggaagttaattatgttattcgtagtactcgacgactacgtaccccgaaggtaactccggaaccccctaaacttccctacgaacctccgaaggaaggtaaaactaacgtccgacggccccggtaccctacggtaccggggttcccctaacggaacccggttactttcccgtacggtacggtaccctaaccgtaacggtccgttaccggaccctacccgttacgaccgttccccttacccgtacggaaccctacgttacgacgggttcgggtacccgttacccgggtacggaggtaacgcggtacgtcgtaacgtacgtttacgttactggtacgtacgtacgtaccggaacgggacctaaccgtaacgtacgggtacgggtaacttaacggaaaccgttacgttacggttacgggtaacgggtttccggggggtttacggggttaccgggtttaacccggggggacccggtaaaccggggttaaaaccctaaacgggtttcccgggaaaccccggtttccggttaaacgggtaaccccg

SEQ ID NO: 24654 - DNA, 799 bp, Homo sapiens
  misc_feature: GYAE6OF01EAE8Q.21.22.B11.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcgagggtcctgggacccagtctgtgctgactcacgcccacctcgacgtccgtcgtccggggacccccggngaggacgggtccacctatccttcgttaggttcgtggacggaccaaccttaccaacgtacgtacggaaagttaacttagtacgttattccgtagggttactacgacgtaccaaccgtcccgaaaggtacgtaccggtaacccccaaacggtttacccctacgtaacgttacccaagggtaacggttaaacttaactccgaaccgggtccccggtaacccgttacggtacgggggtaccctaggacccgttattccgtacgtacggtcctaacgtaacgtccgtacggcctaaccgtacggacctccccgttaccttcggaaccctagttacggtcgggtaccggtcccgtaccgggtaccgaaagggtccgttaaggccggtaaccgttggttaaccttacgttaacggtgttacgggaccttacgaccggtacggacctacgaacgtcggagggtactacggtaactaaccggtagttacggggaaccggtttcggggttagggttcggggttaccggggacgggttaaccggtaaacccgtaaggttaccccggaccgggtttcgttaacggaaccccgg

SEQ ID NO: 24655 - DNA, 818 bp, Homo sapiens
  misc_feature: GYAE6OF01DO5WY.21.22.B11.1.454.CMB.1.raw
  modified_base (124)..(124): a, c, t, g, unknown or other
  misc_feature (124)..(124): n is a, c, g, or t
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
tcagtcgtcgctcgcacgaccggtgctcgatttagacgacagctcgaggggggggaagctcagcttcagctgtggtagagaagacaggactcaggacaatctccgagcatcggccggcttcccnctcctcctaccaccctcctcactcacgtgcgcgtagggtccgtgggccctagtctggtgctgtactcgacgccacccgtcaggccgtccggtccgggaccccccggngaaggacggtccaccntcgttcttgtcgnggacgaccaactccaanagtagaagttattatgttacttcgtggtatacgacgactaaccgtccgaggtaacgtaccccggaacccctaaaccgtcctacaccgtaacgtaaggtaacggaacttaacgaccgacggcccggtaccgtaccgggaccgggtcccgtaacggtcccgtacgtttccgtcgtaccggtacgtaccggtaacgtccgtacccgtcgtacccgtccgacccgtcccttaccccgtaacacccggttacgtacgggtccggggtccggtacccggttcccgggtaccgggaacgggtatacccggggtacgtaccgttaggttaaccttttaaccggttcggttacgggttacgaaccggttacgggtaaccccgggaccggtaacccgataaaccgggttacgggtaggtaaacgtaacgaaccgtagttaccggtacggggttagggttgggggttccgggttacgggtaacccgggggacggttaaacccggaaccgtttaaccgggtccggtaacccggttcgttaccgggaaacccgg

SEQ ID NO: 24656 - DNA, 843 bp, Homo sapiens
  misc_feature: GYAE6OF01B6BYD.21.22.B11.1.454.CMB.1.raw
  modified_base (121)..(121): a, c, t, g, unknown or other
  misc_feature (121)..(121): n is a, c, g, or t
  modified_base (152)..(152): a, c, t, g, unknown or other
  misc_feature (152)..(152): n is a, c, g, or t
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
tcagtcgtcgctcgcacgaccggtgctcgatttagacgacagctcgaggggggggaagctcagcttcagctgtggtagagaagacaggactcaggacaatctcagcatggccgccttcccnctcctcctcaccctcctcactcacgtcgcgngacgggtccgtcgggacccngtctggnctgacctcacgcccaccgtgacgcggtccgccgggggaccccgngacggacggtcaacctgttctgttgtacggcggacgtaccaaaccgtccaaagtagtaacgggtaaatttaattagtacggtttagtacgttacggtaactacgaaccggtacaaaccctccggtaacgtaaaccgcccccggaacccctaacttacccgacaaccaaccacggtaaaggtaaactaacgccggaaccggcccggttaaccccgtacgggtaaaccgggggtcctttaacgggaccttactttaccgccggtaacggtaccctaaccggtaagttcccgtaaccgggcccttacgggtacccaccggttccccttaaccccgagtaaccccgtccgtacgggtaaccgggtcgggtaccgttaccccggggaacggtacgggttaaccggtccggggtaacgtaccgtccggttaacctaacggttcggtaccgtacgtaccggtaaccgaccgggttaaccggggaccgtaaccgtaaggtaccggttagggaaaccctagggaaacccttagggtaccggtaaggggttacgggtcggggtttaacggtcggggtacggaccggaccgggtaaacacgttaccgggaccctccgggtaaggtaccccg

SEQ ID NO: 24657 - DNA, 796 bp, Homo sapiens
  misc_feature: GYAE6OF01AP8B3.21.22.B11.1.454.CMB.1.raw
  modified_base (214)..(214): a, c, t, g, unknown or other
  misc_feature (214)..(214): n is a, c, g, or t
  modified_base (587)..(587): a, c, t, g, unknown or other
  misc_feature (587)..(587): n is a, c, g, or t
tcagtcgtcgctcgcacgaccggtgctcgatttagacgacagctcaggggggggaagctcagcttcagctgtggtagagaagacaggactcaggacaatctccagcatggccggcttcctctcctctcaccctctcactcactgcgcacgggtcctcgggccctagtctgtgctgactcacgccacctcgaggtccgtcgtacggggccccggngacggacgggtcaccgtctcttcgttgtcgtggagaccaaccgtcaactagtaccggtaagttaattagttagtacttcgttaggtactaccgacgacctaaccgtacccgaggtaacgtcccggaacccccttaaccgtcctacgtaccgtaccgaacggtaacggtaaactaacgtaccgccggtacccggtacccggtaccgggttaccggggtaccctacgggtaacccttagttcccggttacgtcggtaccttaacgttaaccggtccgttacgacccgtaacccgttcgacccgtcccttaccgtacgaacccttacgtacggtaccggggttaccggtcccgttaaccggggtccggtaacgggngttaccggggacttacccggtaagtacctttaacgttcctgtactaccggacgttaccgggaacccggtagtacctaggtacggtacgggtaaactagaaccgtaggttccggttagggtacgggtttcggggttacgggtcgttacccgggggacggtaacggaaacccgtttagggtaccccgttaacggttacggcgggtaacccg

SEQ ID NO: 24658 - DNA, 487 bp, Homo sapiens
  misc_feature: GYAE6OF01D2HLB.21.22.B11.1.454.CMB.1.raw
  modified_base (170)..(170): a, c, t, g, unknown or other
  misc_feature (170)..(170): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (441)..(487): a, c, t, g, unknown or other
  misc_feature (441)..(487): n is a, c, g, or t
tcagtcgtcgctcgcacgaccggtgctcgatttagacgacagctcagggggtccctgaccgattctctggctccaagtctggcacctcagcctccctgaccatcaggtgggccttccggtccgaggatggaggctgacttattacgtgtgcatccgacgggacgacaacngtgggatgaacaatcgtggaggtcgggttggggtggttcgggcgggaacgggaacctaaacgtcggtacccgtccgtacggtaccaccggacccgaacggtccgtcccggtaccccccgttcggttaccctaccgtttcccgttccgttacccccctaccccgtttccccttcccgttacccggttccttaccctttaccggtacgggaccggtccggggtaccgttcgggaaccgtaacggggtcccgtactaaggtacggntgctgngnnnnnnnnnnnnnnnnnnnnnnnnnnnnnnnnnnnnnnnnnnnnnnn

SEQ ID NO: 24659 - DNA, 864 bp, Homo sapiens
  misc_feature: GYAE6OF01AG8MS.21.22.B11.1.454.CMB.1.raw
  modified_base (251)..(251): a, c, t, g, unknown or other
  misc_feature (251)..(251): n is a, c, g, or t
  modified_base (545)..(545): a, c, t, g, unknown or other
  misc_feature (545)..(545): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactcgcgcgacgggtccgtcgggcccagttctgtcgctgactcacgaccctaccctcacggtcgtccggtaccggggaccccgggcacgggtacgggtccaaccgtnttccttcgtttcgttcggaggtacggacctaacctaccgaaacacgttacggtaaacgttaacgttatgttacttacgtggttactacgacgtaccaacctaccgacgtaacgtaccggtaccccaacgttccctaccactaccgaacggaactaaacgtaacaccgtacggaccggtaccgaccggtaccggggtacccttacggtacccgttacttccgttaccgtccggtaccttaccgtaacggttaccgtacgtccgtacctccgaacctcccgtaccgtaccgtaccngtacgttacgggtccggtccgtaccgggtaccgacggtacgtcgggtactaccgtttacacgttttacgtacgtttagggtccgtaagtacccggttaccgggaaccgggtacccgtaacgtaaccgttaacgggtacgggtaccgtaacggtaaccgttaaacggtaccgggttaacggggtttccgggggtttaaggggtttccgggggttaaacccggggtttaacccggggggcgggtttaaaaccccgggtaaccggtttaaaccccggggttaccgtaaccggggtttaacccgggttacccggaaaccgggg

SEQ ID NO: 24660 - DNA, 883 bp, Homo sapiens
  misc_feature: GYAE6OF01BLLGT.21.22.B11.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagacgacagctcgagggggggggaagctcagcttcagctgtggtagagaagacaggactcaggacaatctccagcatggccggcttccctctcctcctccaccctcctcactcactgcgcgacgggtcctcgggcccagtctgtgctgacctcacgcccaccctcgagccgtcgtaccggggacccccgganaggacggtccacctattccttcgttgttcgtggacgacctaacctaccgaaactacgtaacggtaaattaaatttagttacgttacgtttacgtaggttaacaccgaacggtacccctaaccgtaccccggtaagggtaaccgttaccccggtaaaccccccctaaaccgttccccttaaccgaacctaacccgggtaaaggtaaaaccggttaaaacttaacctaccggaccgggtacccccggtacccccggttacggggttaacccgggggtttacccctacgggttaaccccgttacctttcccggttaccgttccggtaacccttacccggtacgttccggtacgtacccctaacccgtccgtaacccgtcccccgttacccgacgttaacccacgtaccgggtacggggttccgggtccccggttaacccgggaccggaaggtcgtaggaccggtaccgttacgtaacctttcgttacgtacgttacggacgtaaccgtaccggggaaccgtaccgacgttacggagggtacgtaagtaccggaacttacgggtcggttacgggtcggggtttacgggttcggggtcgggttaccggggaaccggttaacggaaacccgttcgtaccgggtaccgttcggtcgtaacccggg

SEQ ID NO: 24661 - DNA, 753 bp, Homo sapiens
  misc_feature: GYAE6OF01EYM32.21.22.B11.1.454.CMB.1.raw
  modified_base (729)..(729): a, c, t, g, unknown or other
  misc_feature (729)..(729): n is a, c, g, or t
  modified_base (733)..(733): a, c, t, g, unknown or other
  misc_feature (733)..(733): n is a, c, g, or t
  modified_base (738)..(738): a, c, t, g, unknown or other
  misc_feature (738)..(738): n is a, c, g, or t
  modified_base (742)..(742): a, c, t, g, unknown or other
  misc_feature (742)..(742): n is a, c, g, or t
  modified_base (749)..(749): a, c, t, g, unknown or other
  misc_feature (749)..(749): n is a, c, g, or t
tcagtcgtcgctcgcacgaccggtgctcgatttagacgacagctcagggtcctgggcccagtctgtgctgactcagccaccctcagcgtcgtcggaccccgggcagagggtcaccatctcttgttctggaggcaactccaacagtcggaagtaattatcgtattctggtatcagacaacctaccgaaggaactccggaccccctaaactccctacactaccgaggaaggtaaataactcgacggccggtccctacgggtaccggggttcccgtacgaaccggtactttccgtcgttcgggaccttaccgtaacggttccgtacggtacccaccgtccgaaccgtccccttccttaccgacctaatccggaggtccggtccgtccggtaccggaggtacgtcggtaacggtcgtacgtaaccttacgtttacgtcgtcgaccgtcgtaccgggaaccggtacgaacgaacgtacggtggaactacgaactaacgtccgtaaggtcgggttaccggggttgggtacgggtacgggtacgggtaacggtaaccgtaacgtaccggtaccgttacgtacggtaccgacgtaacccgacgtcccgtaccccggtacccgtcgtaccgtaccgttcccgttcccgtaccccgtcccttccgtacccgttcgtacccttcgtaccgttcgggtaccggtcggtaccggacggtacgtacggtaccgcgtacggacncgcnctcgnagcngatcgcngacg

SEQ ID NO: 24662 - DNA, 798 bp, Homo sapiens
  misc_feature: GYAE6OF01BDFET.21.22.B11.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcagggtcctgggccctagtctgtcgctgactcacgcccaccctcacgcgtcgtccggggaccccgggnaggacgggtccacctatctcgttgtcgtgggacggactaacctccaacgacgtacggtaaagttaacttatagttacttcgttacggttactcgtaacgacctaaccgttaccccgaaagggtaccgtcccgggtaacccccctaaaacctcccgtacaaccgtacccgaaagggtaacggtaaattaacgtacgaccggtcccggacccgtaccgggtaccgggggtaccctacggtaacccgtactttacgtaccgtcggtacccgttaccgtaacggttcgtaccggtcctaccgtaccctacgttccccgtaccctacgaccctacgacggtacgggtacccgggtccgttaaccccgggtacggtaggtaacgtcgggtaccgtacgttactaccgtttaagttcgtacgggtcaccgtacgtacccgggaacgggtaccaacggtaacgtacgggtaggaactacgtaacgtacgttcgggtaacggtcggggttacgggttaggggtccgggttacgggacgggtaacccggaaaccgtacggttaccggacccggttcggaacggtacccgg

SEQ ID NO: 24663 - DNA, 735 bp, Homo sapiens
  misc_feature: GYAE6OF01BGDDQ.21.22.B11.1.454.CMB.1.raw
  modified_base (105)..(105): a, c, t, g, unknown or other
  misc_feature (105)..(105): n is a, c, g, or t
  modified_base (727)..(727): a, c, t, g, unknown or other
  misc_feature (727)..(727): n is a, c, g, or t
  modified_base (730)..(730): a, c, t, g, unknown or other
  misc_feature (730)..(730): n is a, c, g, or t
tcagtcgtcgctcgcacgaccggtgctcgatttagacgacagctcagggtcctgggcccagtctgtgctgactcagccaccctcagcgtcgtcgggaccccgggnaggtaggtcacctatctcttgttcgtggaggacaacctcaactagtacggtaattaattatgttattcgtggtactcacgcaacctcgaaggactccggaccccaatccgacactaccgaggaacgtaatactacgacggtccggtcccgttcggacccgggttacctaccgtaccgttacgttccgtacggtacggtacctaccgtaaggttcgtccggacctaccgtaccgaccgttacccgtcctacggtacctacttcggtaacgggttccggaaccgttccgggaacggtaacgtgtacggtacggtactacggtacttcgttacgtacgtcgtctacggtacgacggtacgaacgtaagtcggtacggtaactacggtaaactacggtttcgagggtcgggtttacggttcggggtacgtacgggacggtaacgtacgtacgtaccgtcgtacgtacgtacgaccgaccgtagtcccggtacctccgtaccgtcctacgtcccgttcccgtaccgtccccttcgtcccgttacgtccgtaccgtccgtacggtcgggaccgtcgtacggtacgacgtacgtaccgttagagtacctggccaggtcacgcgttaggnacngtgcg

SEQ ID NO: 24664 - DNA, 710 bp, Homo sapiens
  misc_feature: GYAE6OF01CDGZ9.21.22.B11.1.454.CMB.1.raw
  modified_base (58)..(58): a, c, t, g, unknown or other
  misc_feature (58)..(58): n is a, c, g, or t
  modified_base (231)..(231): a, c, t, g, unknown or other
  misc_feature (231)..(231): n is a, c, g, or t
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (538)..(538): a, c, t, g, unknown or other
  misc_feature (538)..(538): n is a, c, g, or t
  modified_base (549)..(549): a, c, t, g, unknown or other
  misc_feature (549)..(549): n is a, c, g, or t
  modified_base (697)..(697): a, c, t, g, unknown or other
  misc_feature (697)..(697): n is a, c, g, or t
tcagtcgtcgctcgcacgaccggtgctcgatttagacgacagctcgaggggggggaanctcagcttcagctgtggtagagaagacaggactcaggacaatctcagcatcggccgtccttcctctcctactccacctcctcactcacgtcgcgcgtacgggtccgtacgggcctagtctggtacgctacgtactcacgccctacctcgagccgtcgaccggggaccccggtnaggccggtcaacgtctccttgttgttccgngggtacacactaccaagngtaacggtaaagtttaattacgtagtttacgttcgtaacgtactacggaccttaaccgaaccctcggtaaagggacctcccgaaccccttaactccgactcggtaacgaaggtaactagaaacgtcgaaccggccgtaacccgtcgggtaaccggtcctaacgacgttttacaccgttcgtccgtaccgtaccgaagtccgtacggcctaaccgtcgaccgtcctcgtacgctaacgcgtggttaccgccgtacggtancgagtcgacgngtacgtctcgtatcgagtacctgtaaccgcggtacaacttacgagggtaccaagttacgaacccttgggtaccgtaaggggtccggtttagggagggttccgggaagtaccgggtaagaccgttaacgggacccgtaccgttacgggngttaacccccggg

SEQ ID NO: 24665 - DNA, 750 bp, Homo sapiens
  misc_feature: GYAE6OF01CDR53.21.22.B11.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (601)..(601): a, c, t, g, unknown or other
  misc_feature (601)..(601): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgccgcgagggtcctcgggcccagtctgtgctgactcacgccaccctcacgcgtcgtcgggaccccgggnaggacgggtccacactctcttgtcgtggacgcaactccaanagtacggaattaattatagtattcgtaggtactacacgactaacctacccgaaggtaaccgtcccggaaccccctaaacttccctaccgtactacccgtaaaggaacggaaattaacgtaccgaaccgtcccggtaccccgtacgggtaccggggttcccctaaggacccgttacttccgttccgtacggtcctaccgtaacgttcgtacggaccctacctaccggtaccgtcccttaccgtaccgaccgtacgttccggacgggttacgggtcccggtccgggtaacccgggagtcggtacggacgtaccgttaacggtacttaactttacggtgtacggtacnccggtaacgaccgggtacgaaccgaagttcgggacgagttaacggtacctaagttacggtcgggtacgggtttcggggttggggtacggtacccgggtacgggaaccggtacgtacggttaaccgggaccgttccggtacggtacccgg

SEQ ID NO: 24666 - DNA, 897 bp, Homo sapiens
  misc_feature: GYAE6OF01AUB69.21.22.B11.1.454.CMB.1.raw
tcagtcgtcgctcgcacgaccggtgctcgatttagacgacagctcgaggggggggaagctcagcttcagctgtggtagagaagacaggactcaggacaatctccagcatcggccggcttccctctcctcctccaccctcctcactcactgacgcgtaggtcctcgggccctagtcgtgtgactgacctcgacgtcccaccctcgacgccggtccgtacccggggacccccggtgacggacgggtaccaacctattacgttcgtttcggttccgtaggggacgtccaaaccgttaccccgaaagtacgtacggtaaagtttaaattacgttgttaacttccgttaggtactaccgaacgtacccgtaaacccgttaccccggaagggtaacccgtaccccggaaacccccctaacttaccccttaccgaaccggttacccaaaggggtaaaacttaaaacggttaaaccgtaccggtaaaccgggtcccccgggtaaccccgtaaccggggttaacccgggttcccccggttaaagtaccccgttaaatttccccggtacggtttaaacccggtacccgttaaccgtaaccggttaccgtacccggtaacccctaacccgggttaacccgaccccgttacccccgttaccccgtaacccgtaacccgttaaccgtaccggttaccgggtacggtacccgggttacccggtaccgggtaacggtacgtacggtacggtaccgtacgtaccgttaacgttacgtacgtcgtaacgtacgtacggaccggtaacgactacgtagagacgtacgacgtacgtacgtaggtaggtacgggttacgggttggtaccccccccggaggaaccggtacgtaacgtaccgtacgtcgtacgtaccgg

SEQ ID NO: 24667 - DNA, 893 bp, Homo sapiens
  misc_feature: GYAE6OF01BKF2I.21.22.B11.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagacgacagctcaggggggggaagctcagcttcagctgtggtagagaagacaggactcaggacaatctccagcatggccgcttccctctcctcctcaccctacctcactcactgcgacgcgggtccgtcgggcccagtctggtgctgacctcacgcccctacctcagtccgtccgccggggaccccggnaggtacgggtccacctctcttcgttgttcgtaggacgtaccaacgtaccaaacgacgtacggtaaagttaatttagttacgttactttcgtaggtactcaacggtacctaaccgtacccgaaggaccgttacccggaacccccttaaacctcctaccgaactaccgaagtaacggtaaatacgtaccgaccggaccccggtcccgtacccgggtaccggggtaccgtaccggtacgttacccgttccgtccgggtcgtaccctacggtaaccgttccgtaccggtacctcctaccgtacccttccccgttacccaccgtaacccgtacgtacggttccgggtccgggtacccgggttacccgggtaccgggtagtacggtacggtacgggttccttacgttaacggttatttaccgtacgggttacaaccggtaccggtaccgggaacccgggtaacctaacggggaacgttacggggtacgtaacccggtaagtaaacccgtttccgtaacgggtttacggggttcccgggggttttacgggggtttacgggggttcccgggttaaccgggggggtaaccccgggtaaaccgggggttaaaaccccgttacccggggttaaaccccgggttaacccccgggtttacgggttccccgggtaaacccccggg

SEQ ID NO: 24668 - DNA, 838 bp, Homo sapiens
  misc_feature: GYAE6OF01EJMH4.21.22.B11.1.454.CMB.1.raw
  modified_base (528)..(528): a, c, t, g, unknown or other
  misc_feature (528)..(528): n is a, c, g, or t
  modified_base (653)..(653): a, c, t, g, unknown or other
  misc_feature (653)..(653): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgcgcgacgggtccgtcgggccctagtctgtgctcgactcacgccctaccctcgagtccgtcggtccggggaccccggacgaggtacgggtaccacctacttccttcgtttcgttcgtgggacggaccaacctaccgaaacgtacgttaacggtaagttaaattttagtagtttaacgtttcgttaggttaactaccacggtaaccctaaccgacccggtaacggtaaccgtacccggtaaacccccctaaaccttccgtactaacctaccgaaaggaacggtaaataaccgtacgacggtaccccggcccgtacgggtaccggggttacccgtaccgtaaccgtccgtttcgacgtccggtccttaaccgaacgttcccgnggtcccaaccgtcctaacccgtcccctacctaccgtaacccgtgtaccggtacggggtccggttacccgtccgggtaacgggacggtacgtacgggacgtacgtagtaccttattcgtacgtacncgtacgtaacggaccgggtaacaacgtaaccggaagtacgggtaacgacttaaccgtacggttacggtcgggttacggggttacggggttccggggttacgggtaccggggtaacggggaaacccgggtaacccggttaaacggttaccccgggtaaccgggtttaccggaccggttaacccggg

SEQ ID NO: 24669 - DNA, 809 bp, Homo sapiens
  misc_feature: GYAE6OF01BI98U.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtccgtgggcccagtctgtgctgactcacgcccaccctcacgcgtcgtccgggacccccggnaggacggtccacctattccttcttgtcgtggacggacaactaccaacacgtacggaagttaattatagttacttacgtggtaactcgaacgacctaaccgtacccgaagggtaaccgtacccggtaacccccctaaaacttcccgtacctaaccgtacccgaaggaaaacggtaaacttaaaccgtaccgtaccggtaccccggtaccccgttaccgggaaccggggtttaccccgtaacggaaccccggttaactttcccgtcggttccgtacccgttaaccgtaacggttcccggtacggaccctacccgtaccgacccggttaccccttacccgtacggtaaaccctacgttaccggacgggttcccggtacccgtacccggggtaccgaagggtactacgggtacgtcgttacggttaacttacgttcggtccgtacgcgtaaccgtacccggtagggaacctacgaagtaggtacggaacgtagaacttacggacggttaggcgggtttacggggtcggttcggggtaccggaaggggtaacccggtaaacctacgtaacccgggttcccgtaacggtccggtaacccg

SEQ ID NO: 24670 - DNA, 851 bp, Homo sapiens
  misc_feature: GYAE6OF01CP3JG.21.22.B11.1.454.CMB.1.raw
  modified_base (58)..(58): a, c, t, g, unknown or other
  misc_feature (58)..(58): n is a, c, g, or t
  modified_base (236)..(236): a, c, t, g, unknown or other
  misc_feature (236)..(236): n is a, c, g, or t
  modified_base (398)..(398): a, c, t, g, unknown or other
  misc_feature (398)..(398): n is a, c, g, or t
tcagtcgtcgctcgcacgaccggtgctcgatttagacgacagctcgaggggggggaanctcagcttcagctgtggtagagaagacaggactcaggacaatcctccagctagtcggcccggtccttccctctcctcctccaccctcctaccactcactgcgcgtacgggtcctcgggaccctgtcgtgtcgctacgcacacgccctaccgtgacgcggtccgaccggggaccccggngaacggtaggtacccaccgtattcgtttcgttacgtcggtcggacggtacctaaacctcaaacgttggtacgtaaagtttaattagttcgttagttacgtagtaacgttcaacggacctaaaccgtacgaacgtaaccgtaccccgaaccccttaactaccnctaacccgtacgaaaggtaactaaacgtaccgtcggaacccggcccggtacccgtttcggggaacccgggttccctaacggtaaccctttccgtcgtttccggtcgttacccgacgtaccgtacgtccccgggaacctaccgttacgaccccgtcccgtccctaccgtaccgtacgtacggtccgggtacggtcccggttaccggaacccggttaggacgggtacggtacgtaccgtacgttaaccgttacgttacgttacgtacggtccgtaccggtaccgggtaaaccggtaccgaacgtaaccgtaaggggttacgacgttaaccgtaaaacgtcggttattaccggggtgggttccggggtttacgggttaccgggtaccggggaccggggttaaccggtaaacccggtacggttaacccggtaccggtaccgggtacggtaacccggg

SEQ ID NO: 24671 - DNA, 851 bp, Homo sapiens
  misc_feature: GYAE6OF01DBSC7.21.22.B11.1.454.CMB.1.raw
  modified_base (318)..(318): a, c, t, g, unknown or other
  misc_feature (318)..(318): n is a, c, g, or t
  modified_base (415)..(415): a, c, t, g, unknown or other
  misc_feature (415)..(415): n is a, c, g, or t
  modified_base (507)..(507): a, c, t, g, unknown or other
  misc_feature (507)..(507): n is a, c, g, or t
tcagtcgtcgctcgcacgaccggtgctcgatttagacgacagctcgaggggggggaagctcagcttcagctggtggaagagaagacaggactcgaggacaatcctccagctagtcggcccggtcctttccctctccctcctccacccttcctctacctcgactcggcgtccggacggggttcccgtcgggaccctaggttcgtcggtcgactcggtacctaccgaccgtcccaacccctggaccggtccgttacccgggaccccggggaccccggtagaacggtcgggaccaacctcttacgtttccggttgtacggngggaaccacctaacccgtacgaacgtaaggtaaccggttaattaacgttgtacgtttaagttcgtagtaccacgaaccgtaacctaccgaccggtanaaccggtcccaaccccttacgtctaccgaccgtaagaaggaaacgtactaaccgccggtacgaccccgtacgtacgggtccgtccccgtaanacggtttccctcggttcgacccggttacctaacgtaggtccggccctaaacccgttcgaaccctacccggttccctaacgtcgacctacggtcgaacgggttccggtacggtacccgtaacgggagtaacggtcgtaccggtacttacgttaacgttcttacggtacgtaacgaacgtaccggtaacgggaccaacgtacgaagggtacgtacgtaacaaccgttagtaccggtcgggaacggggttgggtaccggggttgggtaaacgggttaccggaaccggggtttaacccggaaaccggttaaccggtaccggttaccccggaaaaggttcccggaaccg

SEQ ID NO: 24672 - DNA, 1007 bp, Homo sapiens
  misc_feature: GYAE6OF01CR9F4.21.22.B11.1.454.CMB.1.raw
  modified_base (144)..(144): a, c, t, g, unknown or other
  misc_feature (144)..(144): n is a, c, g, or t
tcagtcgtcgctcgcacgaccggtgctcgatttagacgacagctcaggggggggaagctcagcttcagctgtggtagagaagacaggactcaggacaatctccagcatggcccggtcttccctctcctcctaccaccctcctcnctcactgcgcgacgggtcccgtcgggaccctgtctcgtgcctagtacctcgaccgtccctaaccctcgtacggccggttaccggtcccgggggaaccccccgggagaacggtaccggggttacccaaccgtacttccgttacgtttcggttaccgtagggaccggtacctaaaccctaccgtaaaacgtaacggttaaacggttaaaacgtttaactttaacggttacgtttaacgtttaccggttaacggttaacctaccgaaccgtaaccgtaaccccggtaaccggtaacggtaaccccggttaacccccgtaaacccccttaaccttaccctaaccgtaaccgtaaccgggtaaaggtaaacgttaaaccgtaccgtaccggtaccggtccccgggttacccgtaaccggggttaccccggttaccgtaccggttaaccgtttccgttccgttacggtaccgttaccgttaccggttaacgttccgtaacccgtacccgttaccgtacccgtaccccggttaccctacccgtaacggtacccgtaaccggttacgggtacccggggttccccgggttacccggttaaccgggtacgggtacgggtacggtacgggtaacccgtaacgttacgttaacgtttacgggttcacggttacgtaccgtaccggtacccggtaaccggtaactaaccggtaaggttccggggtaagtaaccgttaaccgtaacggttaccgttacgggttaccggggttacggggtttacggggttaccggggtccgggttaaaccgggggacccggtaaaccggttaaacccgttaccggtaccggttacccggtacggtaaccggtacccgg

SEQ ID NO: 24673 - DNA, 784 bp, Homo sapiens
  misc_feature: GYAE6OF01B2IQ0.21.22.B11.1.454.CMB.1.raw
  modified_base (144)..(144): a, c, t, g, unknown or other
  misc_feature (144)..(144): n is a, c, g, or t
  modified_base (697)..(697): a, c, t, g, unknown or other
  misc_feature (697)..(697): n is a, c, g, or t
  modified_base (764)..(764): a, c, t, g, unknown or other
  misc_feature (764)..(764): n is a, c, g, or t
  modified_base (771)..(771): a, c, t, g, unknown or other
  misc_feature (771)..(771): n is a, c, g, or t
  modified_base (778)..(778): a, c, t, g, unknown or other
  misc_feature (778)..(778): n is a, c, g, or t
  modified_base (781)..(781): a, c, t, g, unknown or other
  misc_feature (781)..(781): n is a, c, g, or t
  modified_base (783)..(784): a, c, t, g, unknown or other
  misc_feature (783)..(784): n is a, c, g, or t
tcagtcgtcgctcgcacgaccggtgctcgatttagacgacagctcagggtcctgggcccagtctgtgctgactcagccaccctcagcgtcgtcgggacccccgggcagagggtcaccatctcttgttctggaggcaactccaanatcggaagtaattatgtattcgtggtatcagaccaacctcccgaaggaactccggaccccctaaactccctacactaccgagtaaggaaactaactccgaacggtcccggaccccttaccgggtaccgggggttcccctacggaacccgttacttccgtcgttcgggacccttacccgaaggttccgtcggacccctaccggttaccacccggtcccccttccctacgaaccccgtacgtaccgtacggggttccgggacccggttccccgggtacggaggtaacgtcggacggtcctaagtaacctttacgttacgtggttacacgtacgtaaccggaccgggactacgaacgtcggtacggtactaacgaacgtacgtacggtaggtacggggtcgggtttacggggtcgggtacgggacgggaaccggtaacctaacggtaccgtaccggtaccggttacgacccgtaaccggaccgacggtcccgccccgtcccgtacgcctacccgttccgtcccgttacccctcccgttcctcccgtacgttacccnccgtacgtcggaccgtacgggtccacgggaccgtaccggaccgttacgaccgttgccttaggccacngtccganacgtacncgngnn

SEQ ID NO: 24674 - DNA, 745 bp, Homo sapiens
  misc_feature: GYAE6OF01CRVMR.21.22.B11.1.454.CMB.1.raw
  modified_base (58)..(58): a, c, t, g, unknown or other
  misc_feature (58)..(58): n is a, c, g, or t
  modified_base (122)..(122): a, c, t, g, unknown or other
  misc_feature (122)..(122): n is a, c, g, or t
  modified_base (131)..(131): a, c, t, g, unknown or other
  misc_feature (131)..(131): n is a, c, g, or t
  modified_base (137)..(137): a, c, t, g, unknown or other
  misc_feature (137)..(137): n is a, c, g, or t
  modified_base (176)..(176): a, c, t, g, unknown or other
  misc_feature (176)..(176): n is a, c, g, or t
  modified_base (183)..(183): a, c, t, g, unknown or other
  misc_feature (183)..(183): n is a, c, g, or t
  modified_base (199)..(199): a, c, t, g, unknown or other
  misc_feature (199)..(199): n is a, c, g, or t
  modified_base (220)..(220): a, c, t, g, unknown or other
  misc_feature (220)..(220): n is a, c, g, or t
tcagtcgtcgctcgcacgaccggtgctcgatttagacgacagctcgaggggggggaanctcagcttcagctgtggtagagaagacaggactcgaggacaatctcagcatcggccgtcttccnctctctccncctccncactcacgtgacgcgacggtccgtcggccctagtctgtntcgtacnctacacgtccaccgtnacgcgtccgaccgggacccgntaacggcgtaccacgtattcgtcgttgtcgtaggacgtacaaacaccaagtaagtagtaacgtaatttgtacggtacttacgtacggtaacactaacgtaaccaccgtacgaacgtaccgaaccgtaacccacgtcctacgaactacgaaggtaactaactaacgcgaccggaccgtccgtacggtacgggtctacgtacttcctcgtacgtctaacctacggtacgcgtacgaacctacctacgacccttcgtaacctacgtacgacgtacggtacggtaccgtaccgtaacggtacgtacggtacgaggtaccgtacgtacgtaacgttactacgtagtacgtaaccggacgacccggtaacggaccgtaacgtaacgggaacgttacggtaccgtaaacgtaccgtaacggtacggttaacgggttaacgggttgggttaaccggggtcgggttaaccgggaaccgggtaaaccggtaaccgtaaacgttccggtaaaccgggttcgtaacccggtaaccgg

SEQ ID NO: 24675 - DNA, 668 bp, Homo sapiens
  misc_feature: GYAE6OF01B4137.21.22.B11.1.454.CMB.1.raw
  modified_base (57)..(57): a, c, t, g, unknown or other
  misc_feature (57)..(57): n is a, c, g, or t
  modified_base (219)..(219): a, c, t, g, unknown or other
  misc_feature (219)..(219): n is a, c, g, or t
  modified_base (354)..(354): a, c, t, g, unknown or other
  misc_feature (354)..(354): n is a, c, g, or t
tcagtcgtcgctcgcacgaccggtgctcgatttagacgacagctcaggggggggaanctcagcttcagctgtggtagagaagacaggactcaggacaatctcagcatggccgcttccctctccctcctcaccctcctcactcactgcgcgacgggtccgtgggcccagttctgtcgctagactcacgcccaccctcagccgtcgtccgggaccccgggnaggacggtcacctatcttcttgttcgaggacgtacaacctcaaactagtacggtaagttattagtcttagttcgtagtactcagtaccactaccgagtacgtccgaccccatcacactaccgagacgaatacacncggacgcctacgacgggtccacgaactctccgtactcggccctaagtacgtcaccgtcgacctccctcgcccttcccggacaccgtacgtacgtaccggtcgggtaccgtccgggaacgtcgggagacggtcggtacctacgtaccttaactcgttcgacgtcgaccggtcggaaacgtcgaactaacgtggtacggtagtacgtactaacgtcggtacggtaacggggttcgggtttacggtcggggttaccgggaacgggtaacccgtaaccggttacgtacccggtacgtttaccggaaccggtaaccccg

SEQ ID NO: 24676 - DNA, 894 bp, Homo sapiens
  misc_feature: GYAE6OF01E0ZZ5.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcacgcgtccgtccggggaccccccgggcaggacggggtccacctattccttcgtttcgttcgtcgggacggaccaaccttacccgaaactacgttacgggtaaagtttaaatttagttggttatttaccgttagggttaactacgaacggacctaaacccgttaccccgaagggtaaccgtacccgggtaacccccccctaaaactttcccctaccgaaccgttaccccgaaaggaaacgggtaaacttaaacgtaccgtaacggcccccggttaccccgttaccgggtaccgggggttaccccctacggtaacccgtacgttttcctccgtttcggtaccttacccggtaaacgttccgtaccggccctaaacccgttcacccggtccccttacccgtaccggaacccttacgtaccggtacgggttcggggtaccccgtcccgggttaccggaacgggttacctagggtaccggtacgtacgttactttaacgttacgtcgggtactaccgttacgtacccggggaaccggtaccgaaccgtaaacgtcgggttacgggtaactaccggttaaactaacgggttcgtaacgggggttggttaccggggggtttacggtccggggtttaaccggggaccgggaaaacgggtaacccgtaaacggttacccgggtacccggttaccggtaaccgggtacccggg

SEQ ID NO: 24677 - DNA, 312 bp, Homo sapiens
  misc_feature: GYAE6OF02I9OOM.21.22.B11.1.454.CMB.1.raw
  modified_base (289)..(289): a, c, t, g, unknown or other
  misc_feature (289)..(289): n is a, c, g, or t
  modified_base (295)..(312): a, c, t, g, unknown or other
  misc_feature (295)..(312): n is a, c, g, or t
tcagtcgtcgctcgcacgaccggtgctcgatttagacgacagctcaggggtcccgtgaccgattctctggctccaagtctggcacctcagcctccctgaccatcagtgggctccggtccgaggatgaggctgactattactgtgcatcacgggacgcaacatgggatgacaatctgagcggttgggtgttcggcgagggaccaaactgaccgtctaggtcagccaaggctgcccctggtcactctgttcccacctcctcctcgtctctactgagcgggctggcaaggcncatagnnnnnnnnnnnnnnnnnn

SEQ ID NO: 24678 - DNA, 355 bp, Homo sapiens
  misc_feature: GYAE6OF02GX46R.21.22.B11.1.454.CMB.1.raw
  modified_base (345)..(355): a, c, t, g, unknown or other
  misc_feature (345)..(355): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcgacgggacacaacagtgggatgaacaatctaggaggtcgggttgggttggttcgggacgggacgggaaccaaagtcggacccgtcgtaggtcaccgacccgaaggtctccgccccgtcggtaccacttcgtccgtccccgcccttcctcctcgtcctactactgacggccggtctcggacaagggccgactaagtggnnnnnnnnnnn

SEQ ID NO: 24679 - DNA, 303 bp, Homo sapiens
  misc_feature: GYAE6OF02F2WV7.21.22.B11.1.454.CMB.1.raw
  modified_base (299)..(303): a, c, t, g, unknown or other
  misc_feature (299)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccgcctcctcctcgtctctactgagcgggctggcaaggcgcatagnnnnn

SEQ ID NO: 24680 - DNA, 283 bp, Homo sapiens
  misc_feature: GYAE6OF02HPIQP.21.22.B11.1.454.CMB.1.raw
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (278)..(283): a, c, t, g, unknown or other
  misc_feature (278)..(283): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcgggtgtggtcgaggnggccaatagcnctagcagccagctgccccnggtcactcngttccacctctctcgtctctactgagcgggctggcaaggcgcatagnnnnnn

SEQ ID NO: 24681 - DNA, 303 bp, Homo sapiens
  misc_feature: GYAE6OF02ILJCL.21.22.B11.1.454.CMB.1.raw
  modified_base (299)..(303): a, c, t, g, unknown or other
  misc_feature (299)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggagggaccaaactgaccgtcctaggtcagcccaaggctgccccctggtcactctgttccccgccctcctcctcgtctctactgagcgggctggcaaggcgcatagnnnnn

SEQ ID NO: 24682 - DNA, 305 bp, Homo sapiens
  misc_feature: GYAE6OF02HFJRI.21.22.B11.1.454.CMB.1.raw
  modified_base (300)..(305): a, c, t, g, unknown or other
  misc_feature (300)..(305): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccaccctcctcctcgtctctactgagcgggctggcaaggcgcatagnnnnnn

SEQ ID NO: 24683 - DNA, 307 bp, Homo sapiens
  misc_feature: GYAE6OF02JP4T6.21.22.B11.1.454.CMB.1.raw
  modified_base (298)..(307): a, c, t, g, unknown or other
  misc_feature (298)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccgcctcctcctcgtctctactgagcgggctggcaaggcgcatagnnnnnnnnnn

SEQ ID NO: 24684 - DNA, 301 bp, Homo sapiens
  misc_feature: GYAE6OF02HQ4RV.21.22.B11.1.454.CMB.1.raw
  modified_base (299)..(301): a, c, t, g, unknown or other
  misc_feature (299)..(301): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccgcctcctcctcgtctctactgagcgggctggcaaggcgcatagnnn

SEQ ID NO: 24685 - DNA, 302 bp, Homo sapiens; identical to SEQ ID NO: 23925
  misc_feature: GYAE6OF02F23N6.21.22.B11.1.454.CMB.1.raw
  modified_base (298)..(302): a, c, t, g, unknown or other
  misc_feature (298)..(302): n is a, c, g, or t

SEQ ID NO: 24686 - DNA, 318 bp, Homo sapiens
  misc_feature: GYAE6OF02GUWX7.21.22.B11.1.454.CMB.1.raw
  modified_base (303)..(318): a, c, t, g, unknown or other
  misc_feature (303)..(318): n is a, c, g, or t
tcagtcgtcgctcgcacgaccggtgctcgatttagacgacagctcaggggtccctgaccgattctcctggctccaagtctggcacctcagcctccctgaccatcagtgggctccggtccgaggatgaggctgactattactgtgctatcacgggacgctaaacatgggatgacaatctgagcggttgggtgttcggcggaggggaccaaactgaccgtcctaggtcgagcccaaggctgccccctggtcactctgttcccgcctcctcctcgtctctactgagcggctggcaaggcgcatagnnnnnnnnnnnnnnnn

SEQ ID NO: 24687 - DNA, 491 bp, Homo sapiens
  misc_feature: GYAE6OF02HOHP1.21.22.B11.1.454.CMB.1.raw
  modified_base (336)..(336): a, c, t, g, unknown or other
  misc_feature (336)..(336): n is a, c, g, or t
  modified_base (480)..(491): a, c, t, g, unknown or other
  misc_feature (480)..(491): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttgggtgttcgggcggagggaccaaacgtgaccgtctaggtcagcccaaggcctcgcccctcggtcactctcgtcccacctcctcctcgtctctactgagcgggctggcaggcgcatgnnnnnnnnnnnn

SEQ ID NO: 24688 - DNA, 301 bp, Homo sapiens
  misc_feature: GYAE6OF02GPTGU.21.22.B11.1.454.CMB.1.raw
  modified_base (298)..(301): a, c, t, g, unknown or other
  misc_feature (298)..(301): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccgcctcctcctcgtctctactgagcgggctggcaaggcgcatagnnnn

SEQ ID NO: 24689 - DNA, 491 bp, Homo sapiens
  misc_feature: GYAE6OF02ITIVX.21.22.B11.1.454.CMB.1.raw
  modified_base (340)..(340): a, c, t, g, unknown or other
  misc_feature (340)..(340): n is a, c, g, or t
  modified_base (381)..(381): a, c, t, g, unknown or other
  misc_feature (381)..(381): n is a, c, g, or t
  modified_base (475)..(475): a, c, t, g, unknown or other
  misc_feature (475)..(475): n is a, c, g, or t
  modified_base (481)..(491): a, c, t, g, unknown or other
  misc_feature (481)..(491): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggccccaaactcctcatccagaggaataatcagcggcctcaggggtccctgaccgattctctggctccaagtctggcacctcagcctcctgacccatcagtcggggctccgggtccgaggatggaggctgactattactgtgcatcgacgggacncaaacatgggatgaacaatctgagcggttgggtgttcgggnggagggaccaaactgaccgtctaggtcagccaaggctcgcccctggtcactctcgttcccacctcctcctcgtctctctgagcggctgcaggcncagtgnnnnnnnnnnn

SEQ ID NO: 24690 - DNA, 551 bp, Homo sapiens
  misc_feature: GYAE6OF02IFVYA.21.22.B11.1.454.CMB.1.raw
  modified_base (209)..(209): a, c, t, g, unknown or other
  misc_feature (209)..(209): n is a, c, g, or t
  modified_base (353)..(353): a, c, t, g, unknown or other
  misc_feature (353)..(353): n is a, c, g, or t
  modified_base (455)..(455): a, c, t, g, unknown or other
  misc_feature (455)..(455): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggcccccaaatcctcatccagagaataatcagccgcctcgacggggtccctgaccgattcnctggctaccaagtctggccacctcacgccctccctgaccatcaggtgggcctccgggtccgaggatggacggctgaccttatactgtgcatcgaacgggacncaacagtgggatagaacattcgtaggaggtccgggttggggtgttaccgggagggtacgggaacccaaacggttcggaacccgttccgtaggtccg

SEQ ID NO: 24691 - DNA, 302 bp, Homo sapiens
  misc_feature: GYAE6OF02G0G69.21.22.B11.1.454.CMB.1.raw
  modified_base (298)..(302): a, c, t, g, unknown or other
  misc_feature (298)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctggtcactctgttcccgccctcctcctcgtctctactgagcgggctggcaaggcgcatagnnnnn

SEQ ID NO: 24692 - DNA, 302 bp, Homo sapiens
  misc_feature: GYAE6OF02F39G1.21.22.B11.1.454.CMB.1.raw
  modified_base (298)..(302): a, c, t, g, unknown or other
  misc_feature (298)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctcggtcactctgttcccgcctcctcctcgtctctactgagcgggctggcaaggcgcatagnnnnn

SEQ ID NO: 24693 - DNA, 300 bp, Homo sapiens
  misc_feature: GYAE6OF02H0W3T.21.22.B11.1.454.CMB.1.raw
  modified_base (292)..(292): a, c, t, g, unknown or other
  misc_feature (292)..(292): n is a, c, g, or t
  modified_base (298)..(300): a, c, t, g, unknown or other
  misc_feature (298)..(300): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccacctcctcctcgtctctactgagcgggctggcaaggcncatagnnn

SEQ ID NO: 24694 - DNA, 302 bp, Homo sapiens
  misc_feature: GYAE6OF02F6FYW.21.22.B11.1.454.CMB.1.raw
  modified_base (299)..(302): a, c, t, g, unknown or other
  misc_feature (299)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctcggtcactctgttcccaccctcctcctcgtctctactgagcgggctggcaaggcgcatagnnnn

SEQ ID NO: 24695 - DNA, 351 bp, Homo sapiens
  misc_feature: GYAE6OF02JC602.21.22.B11.1.454.CMB.1.raw
  modified_base (313)..(316): a, c, t, g, unknown or other
  misc_feature (313)..(316): n is a, c, g, or t
  modified_base (318)..(331): a, c, t, g, unknown or other
  misc_feature (318)..(331): n is a, c, g, or t
  modified_base (334)..(351): a, c, t, g, unknown or other
  misc_feature (334)..(351): n is a, c, g, or t
tcagtcgtcgctcgcacgaccggtgctcgatttagacgacagctcaggggtccctgaccgattctctggctccaagtcctggcacctcagtcctccctgaccatcagtgggctccggtccgaggatggacggctgactattacgtgtgcatcgtacgggacgcaacattgggatgacaatctgagcggttgggtgttcggcggagggtaccaaacgtgaccgtcctaggtccagcccaaggctgccccctggtcactctgttcccgcctcctcctcgtctctactgagtcgggcttggcaaggcgcataggcnnnngnnnnnnnnnnnnnnaannnnnnnnnnnnnnnnnn

SEQ ID NO: 24696 - DNA, 505 bp, Homo sapiens
  misc_feature: GYAE6OF02FWN6V.21.22.B11.1.454.CMB.1.raw
  modified_base (407)..(407): a, c, t, g, unknown or other
  misc_feature (407)..(407): n is a, c, g, or t
  modified_base (439)..(439): a, c, t, g, unknown or other
  misc_feature (439)..(439): n is a, c, g, or t
tcagtcgtcgctcgcacgaccggtgctcgatttagacgacagctcagggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccggcagagggtcaccatctcttgttctggaggcaactccaacatcggaagtaattatgtattctggtatcagcaactcccaggaatcggcccccaaactcctcatccagaggaataatcagcggccctcgacggggtccctgaccgattctctggctcaagtctggcacctcagcctccctgaccatcagtcggctccggtccgagntgagctgactattactgtgcatcgacgggacncaacatgggatgacatctaggagcggttgggtgttcggcggaggaccaacgtgaccgtctaggtcc

SEQ ID NO: 24697 - DNA, 567 bp, Homo sapiens
  misc_feature: GYAE6OF02GT6J2.21.22.B11.1.454.CMB.1.raw
tcagtcgtcgctcgcacgaccggtgctcgatttagacgacagctcaggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgtctggagcaactccaacatcggaagtaattatgtattctggtatcagcaactcccaggaatcggacccccaaactcctcatccagagaataatcagcggccctcgacggggtccctgaccgattcctcgtggctccaagtctggccacctcagccctccctgacccatccaggtgggcctccgggtccgagatgaggctgactattctgtgcatccgaacggggacacaaacgagtgggatagaaccatcgtaggaacggtcgggtttggggtacgtttccggggaccgggaacggggtaaccccaaaacgtttcggaccccggttaccgtaggttaccg

SEQ ID NO: 24698 - DNA, 304 bp, Homo sapiens
  misc_feature: GYAE6OF02HC04D.21.22.B11.1.454.CMB.1.raw
  modified_base (300)..(304): a, c, t, g, unknown or other
  misc_feature (300)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccaccctcctcctcgtctctactgagcgggctggcaaggcgcatagnnnnn

SEQ ID NO: 24699 - DNA, 304 bp, Homo sapiens; identical to SEQ ID NO: 24698
  misc_feature: GYAE6OF02GTCRT.21.22.B11.1.454.CMB.1.raw
  modified_base (300)..(304): a, c, t, g, unknown or other
  misc_feature (300)..(304): n is a, c, g, or t

SEQ ID NO: 24700 - DNA, 344 bp, Homo sapiens
  misc_feature: GYAE6OF02GKF3J.21.22.B11.1.454.CMB.1.raw
  modified_base (312)..(344): a, c, t, g, unknown or other
  misc_feature (312)..(344): n is a, c, g, or t
tcagtcgtcgctcgcacgaccggtgctcgatttagacgacagctcagggggtcccgtgaccgattctctggctcccaagtcgtggcaccgtcacgcctccctgaccatcagtgggctccggtccgaggatggaggcctgactattactgtgcattcacgggacgcaacatgggatgacaatctgagcggttgggtgttcggcggagggaccaaactgaccgtcctagggtcagcccaaggctgcccctggtcacgtcctgttccccgaccctcctacctcgtctctactgagcgggctggcaggcgcatagnnnnnnnnnnnnnnnnnnnnnnnnnnnnnnnnn

SEQ ID NO: 24701 - DNA, 395 bp, Homo sapiens
  misc_feature: GYAE6OF02JBAG4.21.22.B11.1.454.CMB.1.raw
  modified_base (260)..(260): a, c, t, g, unknown or other
  misc_feature (260)..(260): n is a, c, g, or t
  modified_base (343)..(343): a, c, t, g, unknown or other
  misc_feature (343)..(343): n is a, c, g, or t
  modified_base (346)..(395): a, c, t, g, unknown or other
  misc_feature (346)..(395): n is a, c, g, or t
tcagtcgtcgctcgcacgaccggtgctcgatttagacgacagctcaggggtcccgtgaccggattctctggctccaagtctggcacctcagcctccctgaccatccagtgggctccggtccgacgggatgaggctgacgtattactgtggtcatcacgggacggcaacatgggatgacaatctgagcggtgggtggttggtcggagggccgaaactgaccgtccgtagtaccgacgaccgaacgacgcgcccgtccgtcnctctcgttcctacccctccctccctccgtcctcctaccgtcgaacgtccgggacgtcgggcgtaacgggcgacgacgtacganagnnnnnnnnnnnnnnnnnnnnnnnnnnnnnnnnnnnnnnnnnnnnnnnnnn

SEQ ID NO: 24702 - DNA, 302 bp, Homo sapiens
  misc_feature: GYAE6OF02G58LS.21.22.B11.1.454.CMB.1.raw
  modified_base (297)..(302): a, c, t, g, unknown or other
  misc_feature (297)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccacctcctcctcgtctctactgagcggctggcaaggcgcatagnnnnnn

SEQ ID NO: 24703 - DNA, 303 bp, Homo sapiens
  misc_feature: GYAE6OF02GOXGS.21.22.B11.1.454.CMB.1.raw
  modified_base (298)..(303): a, c, t, g, unknown or other
  misc_feature (298)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctcggtcactctgttcccacctcctcctcgtctctactgagcgggctggcaaggcgcatagnnnnnn

SEQ ID NO: 24704 - DNA, 310 bp, Homo sapiens
  misc_feature: GYAE6OF02G19T1.21.22.B11.1.454.CMB.1.raw
  modified_base (297)..(310): a, c, t, g, unknown or other
  misc_feature (297)..(310): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctggtcactctgttcccacctcctcctcgtctctactgagcgggctggcaaggcgcatagnnnnnnnnnnnnnn

SEQ ID NO: 24705 - DNA, 503 bp, Homo sapiens
  misc_feature: GYAE6OF02JA85D.21.22.B11.1.454.CMB.1.raw
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (485)..(485): a, c, t, g, unknown or other
  misc_feature (485)..(485): n is a, c, g, or t
  modified_base (491)..(503): a, c, t, g, unknown or other
  misc_feature (491)..(503): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcagggtccctgaccgattctctggctccaagtctggcacctcagccctcctgacccatcagtgggctccggtccgaggatgaggctgactattactgtgcatcacgggacncaacntgggatgacaatctgagtcgggttgggtcgttcgggcggagggaccaaacgtcgaccgtccgtaggtcagcccaaggctcgccccgtcggtcactctcgtcccgccctcctcctccgtctctactgacgcggctgcacggcncagtgnnnnnnnnnnnnn

SEQ ID NO: 24706 - DNA, 501 bp, Homo sapiens
  misc_feature: GYAE6OF02FU5OW.21.22.B11.1.454.CMB.1.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (488)..(501): a, c, t, g, unknown or other
  misc_feature (488)..(501): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctcctgaccatcagtgggctccggtccgaggatgaggctgactattactgtgcatcacgggacncaacntgggatgacaatctgagcggttgggtgttcgggcggagggaccaaacgtgaccgtccgtaggtcagcccaaggcctcgccccctcggtccactctcgttcccaccctcctcctcgtcctactcgacgcggctggcaaggcgcatagnnnnnnnnnnnnnn

SEQ ID NO: 24707 - DNA, 538 bp, Homo sapiens
  misc_feature: GYAE6OF02JINYP.21.22.B11.1.454.CMB.1.raw
  modified_base (235)..(235): a, c, t, g, unknown or other
  misc_feature (235)..(235): n is a, c, g, or t
  modified_base (290)..(290): a, c, t, g, unknown or other
  misc_feature (290)..(290): n is a, c, g, or t
  modified_base (355)..(355): a, c, t, g, unknown or other
  misc_feature (355)..(355): n is a, c, g, or t
  modified_base (506)..(506): a, c, t, g, unknown or other
  misc_feature (506)..(506): n is a, c, g, or t
  modified_base (521)..(521): a, c, t, g, unknown or other
  misc_feature (521)..(521): n is a, c, g, or t
  modified_base (526)..(527): a, c, t, g, unknown or other
  misc_feature (526)..(527): n is a, c, g, or t
  modified_base (530)..(530): a, c, t, g, unknown or other
  misc_feature (530)..(530): n is a, c, g, or t
  modified_base (532)..(534): a, c, t, g, unknown or other
  misc_feature (532)..(534): n is a, c, g, or t
  modified_base (536)..(538): a, c, t, g, unknown or other
  misc_feature (536)..(538): n is a, c, g, or t
tcagtcgtcgctcgcacgaccggtgctcgatttagacgacagctcagggtcctgggcccagtctgtgctgactcagccaccctcagcgtctcggggacccccgggcaggagggtcaccatctcttgttctggaggcaactccaacatcggaagtaattatgtattctggtatcagcaactcccaggaatcggaccccaaacctcctcactccagaaggaataatacacgcggccncgtccagggggtcccgtgaccgattctctcggctccaagtctcggcacctccacngccctccctgaccagtcacggtcgggcgtccggtccgaggatgaggctgactattactgtgcgancacgggacgcgaacatggatgacaatcgtggaggtcggtgggtggtcggacggagggaaccgaaactagaccgtaccgtacggtacgacgaccgaacggcgtcgcccgtccggtcacctcctcgttcccaccctcctcctcgtctctctgngcgcgtcgcagcgcngtagnngcncnnncnnn

SEQ ID NO: 24708 - DNA, 601 bp, Homo sapiens
  misc_feature: GYAE6OF02H87M4.21.22.B11.1.454.CMB.1.raw
  modified_base (244)..(244): a, c, t, g, unknown or other
  misc_feature (244)..(244): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctggacccagtctgtgctgactcagccacctcagcgtctcgggaccccggcagagggtcaccatctcttgttctggaggcaactccaanatcggaagtaattatgtattctggtatcagcaactcccagatcggaccccaaactcctcatccagagaataancagcggcctcgaggggtcccngaccgattctcnggctaccagtctggccacctnacgccctccngacccatcaggtggtctcccgggtcgaggtactggacggtctagaaccttagttacgtggtgaccaagttccgaaccggggacaccgtaaacgacggttagggaacttaggaacctaagttccgtagggaacggtcggggtttggggtaccggtttacgggaccgggtaacgggaacccctaaaacggttcggaaccccggtttacccgaagggtacccg

SEQ ID NO: 24709 - DNA, 305 bp, Homo sapiens
  misc_feature: GYAE6OF02GITUZ.21.22.B11.1.454.CMB.1.raw
  modified_base (299)..(305): a, c, t, g, unknown or other
  misc_feature (299)..(305): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccacctcctcctcgtctctactgagcgggctggcaaggcgcatagnnnnnnn

SEQ ID NO: 24710 - DNA, 307 bp, Homo sapiens
  misc_feature: GYAE6OF02ISAAZ.21.22.B11.1.454.CMB.1.raw
  modified_base (294)..(294): a, c, t, g, unknown or other
  misc_feature (294)..(294): n is a, c, g, or t
  modified_base (300)..(307): a, c, t, g, unknown or other
  misc_feature (300)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctgttccccaccctcctcctcgtctctactgagcggctggcaaggcncatagnnnnnnnn

SEQ ID NO: 24711 - DNA, 493 bp, Homo sapiens
  misc_feature: GYAE6OF02G1MPW.21.22.B11.1.454.CMB.1.raw
  modified_base (338)..(338): a, c, t, g, unknown or other
  misc_feature (338)..(338): n is a, c, g, or t
  modified_base (369)..(369): a, c, t, g, unknown or other
  misc_feature (369)..(369): n is a, c, g, or t
  modified_base (483)..(493): a, c, t, g, unknown or other
  misc_feature (483)..(493): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgacccatcagtgggctccggtccgaggatgaggctgactattactgtgcatcacgggacncaacatgggatgacaatctgagcggttgggngttcgggcggagggaccaactgaccgtctaggtcagcccaaggcctcgcccctcggtcactctcgttcccaccctcctcctcgtcttactgacgcgggctggcaggcgcatagnnnnnnnnnnn

SEQ ID NO: 24712 - DNA, 529 bp, Homo sapiens
  misc_feature: GYAE6OF02JFWVA.21.22.B11.1.454.CMB.1.raw
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (476)..(476): a, c, t, g, unknown or other
  misc_feature (476)..(476): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatcggcccccaaatcctcatccagaggaataatcagcggccctcgacggggtccctgaccgattctctggctccaagtctggccacctcacgccctccctgacccatcaggtcgggcctccgggtccgaggatggagctagactattacngtgcatcgacgggacncaacngtggatgaacagtcnggaggtcggttgggtgttcgggacggagggaccaagtcgaccgtcgtaggtcc

SEQ ID NO: 24713 - DNA, 303 bp, Homo sapiens; identical to SEQ ID NO: 23949
  misc_feature: GYAE6OF02ILY08.21.22.B11.1.454.CMB.1.raw
  modified_base (299)..(303): a, c, t, g, unknown or other
  misc_feature (299)..(303): n is a, c, g, or t

SEQ ID NO: 24714 - DNA, 640 bp, Homo sapiens
  misc_feature: GYAE6OF02HDTIU.21.22.B11.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggacccccaaactcctcatccagaggaataatcagccggccctcgacggggtcccctaggacccgtattcctcgtggctaccaagtctggccacctcacgccctccctgaccatccaggtcgggctcccgggtccgaggatggacggctacgaccttatttacctggttcgacctaagttccgaaccgggggacctaccgaaacgtaggttaggggaacttaggaacctaagttccgttagggaacgggtccggggttttagggggtcggtttaccgggggaccgggtaacgggggtaaacccctaaaaccggttccgggtaaccccggttaccggtaacgggtacccg

SEQ ID NO: 24715 - DNA, 546 bp, Homo sapiens
  misc_feature: GYAE6OF02FTYF7.21.22.B11.1.454.CMB.1.raw
tcagtcgtcgctcgcacgaccggtgctcgatttagacgacagctcagggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcgaggggtccctgaccgattctctggctcaagtctggcactcagcctcctgaccatcagtgggcctccggtccgaggatgaggctgacctattactgtgcagtccgacgggaccgcaacgatggggaatgaacaatccgtggaaggtcgggtttgggtcggttccgggacgggtaacgggacccgtaaaacgtggaacccgttccgtagggtaccc

SEQ ID NO: 24716 - DNA, 517 bp, Homo sapiens
  misc_feature: GYAE6OF02H25UT.21.22.B11.1.454.CMB.1.raw
  modified_base (210)..(210): a, c, t, g, unknown or other
  misc_feature (210)..(210): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagtcgtcgctcgcacgaccggtgctcgatttagacgacagctcagggggggaagctcagcttcagcttgtggtagagaagacaggactcaggacaatctccagcatggccggcctccgtgtacctctcaccctcctcacctcactgcgcagggtcctggcccagtctcgtgctgactcagccacctcacgcgtctcgggacccccggnaggagggtcaccatctcgttgttcnggagcaactccaantcggaagtaattatgtattctggtatcagcaactcccaggaactcggacccccaaactcctcatccagagaataatcagcgcctcaggggtccctgaccgattctctggctccaagtctggcacctcacgcctcccngaccatcagtggcctcggcgagatgagctgactattcntgcatcgacggcncaacgngtggatcgaacatcgtgagtcgggttgggtcgttcgggcggtaagggacccaaacgtgaccgttcgtaggtccg

SEQ ID NO: 24717 - DNA, 525 bp, Homo sapiens
  misc_feature: GYAE6OF02GHXHM.21.22.B11.1.454.CMB.1.raw
  modified_base (412)..(412): a, c, t, g, unknown or other
  misc_feature (412)..(412): n is a, c, g, or t
  modified_base (445)..(445): a, c, t, g, unknown or other
  misc_feature (445)..(445): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggcctcacggggtccctgaccgattctctggctccaagtctggcacctcacgcctccctgaccatcaggtcggctccggtcgaggntggagctgactattactgtgcatcgacgggacncaacagtgggatgaacatcgtagaggtcggtttgggtgttcgggcggtagggaccaaacgtcgacccgtccgtaggtccg

SEQ ID NO: 24718 - DNA, 537 bp, Homo sapiens
  misc_feature: GYAE6OF02GJVV1.21.22.B11.1.454.CMB.1.raw
  modified_base (209)..(209): a, c, t, g, unknown or other
  misc_feature (209)..(209): n is a, c, g, or t
  modified_base (450)..(450): a, c, t, g, unknown or other
  misc_feature (450)..(450): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatggcccccaaactcctcatccagaggaataatcagccggccctcgacggggtccctgaccgattctctggctccaagtctggcacctcagccctccctgaccatcagtgggctccggtccgaggatggaggctgacttattactgtgcatcgacgggacncaacagtgggatgacaatctaggacgtcgggtttgggtcgtttcgggacgggacgggaccaaacgtcggacccgttccgtaggtccg

SEQ ID NO: 24719 - DNA, 555 bp, Homo sapiens
  misc_feature: GYAE6OF02IQTIZ.21.22.B11.1.454.CMB.1.raw
  modified_base (209)..(209): a, c, t, g, unknown or other
  misc_feature (209)..(209): n is a, c, g, or t
  modified_base (466)..(466): a, c, t, g, unknown or other
  misc_feature (466)..(466): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgttctggaggcaactccaacatcggaagtaattatgtattctggtatcagcaactcccaggaatcggcccccaaactcctcatccagagaataatcagcggccctcacggggtccctgaccgattctctggctccaagtctggcacctcagccctccctgacccatccaggtcgggcctcccgggtaccgaggtatggaggtcctgacttattacctgtcgctacgtcgacggggaccncaaacagtgggaatgacatctggacgtcgggttgggtgttcgggacggtacgggaccctaaacggtcggacccggttaccgtaggtccg

SEQ ID NO: 24720 - DNA, 498 bp, Homo sapiens
  misc_feature: GYAE6OF02JCPTE.21.22.B11.1.454.CMB.1.raw
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
  modified_base (486)..(498): a, c, t, g, unknown or other
  misc_feature (486)..(498): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgacccatcagtgggctccggtccgaggatgaggctgactattactgtgcatcacgggacncaacntgggatgacaatctgagcggttgggtnttcgggcggagggaccaaactgaccgtcctaggtcagcccaggctcgcccctcggtcactctgttcccgccctcctcctcgtctctactgacgcgggctggcaacggcgcagtgnnnnnnnnnnnnn

SEQ ID NO: 24721 - DNA, 549 bp, Homo sapiens
  misc_feature: GYAE6OF02HSBH2.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatcggacccccaactcctcatccagagaataatcagcggcctcgacggggtcccagaccgtattctctggctccgaagtctggcacctcacgccctcctgacctatcgagtgggctccggtacgaggagtcggacgtctgtaactattacgtgtagctagtccgaacggggacacaacgtagtaggatagaactatcgtaggaggtcgggttgggtcgtcggacgggtaggaccgtaacgtcggaccgttcgtagtccg

SEQ ID NO: 24722 - DNA, 633 bp, Homo sapiens
  misc_feature: GYAE6OF02JA3VD.21.22.B11.1.454.CMB.1.raw
  modified_base (250)..(250): a, c, t, g, unknown or other
  misc_feature (250)..(250): n is a, c, g, or t
  modified_base (297)..(297): a, c, t, g, unknown or other
  misc_feature (297)..(297): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
  modified_base (622)..(622): a, c, t, g, unknown or other
  misc_feature (622)..(622): n is a, c, g, or t
  modified_base (624)..(625): a, c, t, g, unknown or other
  misc_feature (624)..(625): n is a, c, g, or t
  modified_base (627)..(633): a, c, t, g, unknown or other
  misc_feature (627)..(633): n is a, c, g, or t
tcagtcgtcgctcgcacgaccggtgctcgatttagacgacagctcagggtcctgggcccgacggtctgtgctgactcagccaccctccacgcgtctgggacccccgggccgacggaggggtcgaccatcctcttgttctggtaggcaactccaacatcggaagtaattatgtattctggtatcagcaactcccaggaactgggcccccaaactccctaccatcccagacggaataagtcagcggcccctnacgggggtcccctggacccgattcctcttggccttccaagtctggcncctcacgcctccctgacccatcaggtggcgtccggtccggagcgtgaggctcgactatttactgtgcctntacgacgggcgacaacacgngggtatggaacatacgtgaaggtcgggttagggtcggtttacggggcgggtacggggaacccgtaaacgtacggtaacccggtacccgtaggtaccgacggacccgaacggtcctacccggccccttccgggtacccacctccgttacctttcccccgaccccgtttccctcccgttccctcgtttacccgactcggtacggcgggtctcgggcgacggcgacgacggagtcagnanncnnnnnnn

SEQ ID NO: 24723 - DNA, 306 bp, Homo sapiens
  misc_feature: GYAE6OF02FGP2I.21.22.B11.1.454.CMB.1.raw
  modified_base (293)..(293): a, c, t, g, unknown or other
  misc_feature (293)..(293): n is a, c, g, or t
  modified_base (299)..(306): a, c, t, g, unknown or other
  misc_feature (299)..(306): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctcggtcactctgttcccaccctcctcctcgtctctactgagcgggctggcaaggcncatagnnnnnnnn

SEQ ID NO: 24724 - DNA, 323 bp, Homo sapiens
  misc_feature: GYAE6OF02GZZ06.21.22.B11.1.454.CMB.1.raw
  modified_base (300)..(323): a, c, t, g, unknown or other
  misc_feature (300)..(323): n is a, c, g, or t
tcagtcgtcgctcgcacgaccggtgctcgatttagacgacagctcaggggtccctgaccgattctctggctccaagtctggcacctcagcctcctgaccatcagtgggctccggtccgaggatgaggctgactattactgtgcatcacgggacgcaacatgggatgacaatctgagcggttgggtgttcggcggagggaccaaacgtgaccgtctaggtcagcccaaggcctacccctggtcacgtctgttccccgccttcctccgagccgacgactgagcggctggcaaggcgcatagnnnnnnnnnnnnnnnnnnnnnnnn

SEQ ID NO: 24725 - DNA, 307 bp, Homo sapiens
  misc_feature: GYAE6OF02IQF6I.21.22.B11.1.454.CMB.1.raw
  modified_base (301)..(307): a, c, t, g, unknown or other
  misc_feature (301)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttccccgccctcctcctcgtctctactgagcgggctggcaaggcgcatagnnnnnnn

SEQ ID NO: 24726 - DNA, 303 bp, Homo sapiens
  misc_feature: GYAE6OF02GHYGH.21.22.B11.1.454.CMB.1.raw
  modified_base (299)..(303): a, c, t, g, unknown or other
  misc_feature (299)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaaactgaccgtcctaggtcagcccaaggctgccccctggtcactctgttcccgcctcctccgagcgacgactgagcgggctggcaaggcgcatagnnnnn

SEQ ID NO: 24727 - DNA, 321 bp, Homo sapiens
  misc_feature: GYAE6OF02JR5B6.21.22.B11.1.454.CMB.1.raw
  modified_base (230)..(230): a, c, t, g, unknown or other
  misc_feature (230)..(230): n is a, c, g, or t
  modified_base (306)..(321): a, c, t, g, unknown or other
  misc_feature (306)..(321): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccgaanggcctggccccctggtccactcctcgttcccaccctcctcctcgtctctactgagcgggctggcaaggcgcatagnnnnnnnnnnnnnnnn

SEQ ID NO: 24728 - DNA, 303 bp, Homo sapiens
  misc_feature: GYAE6OF02HFA60.21.22.B11.1.454.CMB.1.raw
  modified_base (299)..(303): a, c, t, g, unknown or other
  misc_feature (299)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccaccctcctcctcgtctctactgagcggctggcaaggcgcatagnnnnn

SEQ ID NO: 24729 - DNA, 307 bp, Homo sapiens
  misc_feature: GYAE6OF02IJAB6.21.22.B11.1.454.CMB.1.raw
  modified_base (298)..(307): a, c, t, g, unknown or other
  misc_feature (298)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggagggaccaaactgaccgtcctaggtcagcccaaggctgccccctggtcactctcgttcccacctcctccgagcgacgactgagcgggctggcaaggcgcatagnnnnnnnnnn

SEQ ID NO: 24730 - DNA, 306 bp, Homo sapiens; identical to SEQ ID NO: 23978
  misc_feature: GYAE6OF02I6EXG.21.22.B11.1.454.CMB.1.raw
  modified_base (300)..(306): a, c, t, g, unknown or other
  misc_feature (300)..(306): n is a, c, g, or t

SEQ ID NO: 24731 - DNA, 300 bp, Homo sapiens
  misc_feature: GYAE6OF02FHH2R.21.22.B11.1.454.CMB.1.raw
  modified_base (300)..(300): a, c, t, g, unknown or other
  misc_feature (300)..(300): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttccccaccctcctcctcgtctctactgagcgggctggcaaggcgcatagn

SEQ ID NO: 24732 - DNA, 640 bp, Homo sapiens
  misc_feature: GYAE6OF02IN5R2.21.22.B11.1.454.CMB.1.raw
  modified_base (394)..(394): a, c, t, g, unknown or other
  misc_feature (394)..(394): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggcagagggtcaccatctcttgttctggaggcaactccaacatcggaagtaattatgtattctggtatcagcaactcccaggaatcggacccccaaatcctcatccagagaataatcagcgccctcgacgggtccctgaccgtattcctcgtggctaccaagtctggccacctcacgtccctcccngaacccatcgaggtcgggcctcccgggtacgaggtatcggacggtcctagtaacctttacgttaccgtggtcgacctaagttccggaaccgggggaccacgaaaacctagggtacggggtaactacggaaacctagttccgtagggacgggttacggggtttggggttacgggttaccggggaccgggtaaccggggtaaccctaaacggttccgggaaccccggtttaccgtaacgggtacccgg

SEQ ID NO: 24733 - DNA, 303 bp, Homo sapiens; identical to SEQ ID NO: 24679
  misc_feature: GYAE6OF02F9BVL.21.22.B11.1.454.CMB.1.raw
  modified_base (299)..(303): a, c, t, g, unknown or other
  misc_feature (299)..(303): n is a, c, g, or t

SEQ ID NO: 24734 - DNA, 777 bp, Homo sapiens
  misc_feature: GYAE6OF02HTPIR.21.22.B11.1.454.CMB.1.raw
  modified_base (227)..(227): a, c, t, g, unknown or other
  misc_feature (227)..(227): n is a, c, g, or t
tcagtcgtcgctcgcacgaccggtgctcgatttagacgacagctcaggggggaagtcttcggagcgttcagctcgtggtagaggaagacaggactcaggacaatctccgacgcatggccggcttccggtctcctctcacctcctcacgttccacgtcgccgcgagggtcctgggcccagtcctgtgctcgactcacgccaccctcagtcgtctcgggacccccggtnaggagggtacaccgattctaccttgttcctaggtaggccggaacctccgaacaggttccggtaaagtaacttaagtcgtagtttcgtcggttagtctagcaacgtacccgaacgggaagtaccgggacccccctaaaaacgttccctacgaacttcccgaaggtaggtaaacttaagtccgaacgtcccggtacccgtttacggaaacggggggtttccccgtaccggtaaccgtagtttaccgtcgtacgggtccgtaccaaggttccgtacggcctaaccgtcaacggtcccttcccgtacgaccctactccgaaggttcgggacttcccggtacgacggtacgtcggacggtcctaggtaaccttatttcgtacgttagtaccgttattccgacgggaactacgaaaccgttacggttaccgggtaaccgttgtaaccgacggttcggtaacgggaagggtttccggggttagggttccggtttaccggggaacggtaaccgggttaacgaaccggttacgggacccggttaccgtaggttaacccg

SEQ ID NO: 24735 - DNA, 530 bp, Homo sapiens
  misc_feature: GYAE6OF02F5KUI.21.22.B11.1.454.CMB.1.raw
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaatcctcatccagaggaataatcagcggccctcgaggggtccctgaccgattctctggctccaagtctggcacctcagcctccctgaccatcagtcggctccggtcgaggatggaggctgacttatactgtgcatcgacgggacncaacngtgggatgactatcgtaggaggtccgggttgggtcgttcgggacggtagggacccaaagtcggaccgtccgtaggtccg

SEQ ID NO: 24736 - DNA, 528 bp, Homo sapiens
  misc_feature: GYAE6OF02G9BOB.21.22.B11.1.454.CMB.1.raw
  modified_base (340)..(340): a, c, t, g, unknown or other
  misc_feature (340)..(340): n is a, c, g, or t
  modified_base (516)..(528): a, c, t, g, unknown or other
  misc_feature (516)..(528): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggccctcaggggtccctgaccgattctctggctccaagtctggcacctcagcctcctgaccatcagtgggctcccgggtccgaggatgaggctgacttattactgtgcatcgacgggacncaacagtgggatgacaatctgagtcgggttgggtgttcgggacgggacgggaccaaacgtcgaccgtccgtaggtcacgcccgaaggcctcgccccgtcggtccactcctcgttccccacccttcctccctcgtcctctaccgtcgcgccgggtctcgggacacggcgcagtacgnnnnnnnnnnnnn

SEQ ID NO: 24737 - DNA, 548 bp, Homo sapiens
  misc_feature: GYAE6OF02INEX1.21.22.B11.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgacagctcagggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaattatgtattctggtatcagcaactcccaggaatggcccccaaactcctacatccagaggaataatcagcggcctcgaggggtccctgaccgattctctgctcaagtctggcactcagcctcctgaccatcagtggctccggtcgaggatcgaggctgactattacgtgtcgacattaccgaacggggaccactaaaccgagtacggggaattgaaccaagttctacggaggtcgggtttgggtcgttacgggcgggaacggtaaccaaacgttcggacccgttacgtacggtacg

SEQ ID NO: 24738 - DNA, 520 bp, Homo sapiens
  misc_feature: GYAE6OF02GFXR1.21.22.B11.1.454.CMB.1.raw
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcatccagaggaataatcagcggccctgacggggtccctgaccgattctcgtggctccaagtctggccacctcagcctccctgaccatcagtcgggctccggtcgaggatgagctgactatatgncatcgacgggcncaaacntgggatgacatcgtagngtcgggttggngttcggcggtacgggacccaaacgttcggaccgttccgaggtccg

SEQ ID NO: 24739 - DNA, 499 bp, Homo sapiens
  misc_feature: GYAE6OF02IGY8S.21.22.B11.1.454.CMB.1.raw
  modified_base (342)..(342): a, c, t, g, unknown or other
  misc_feature (342)..(342): n is a, c, g, or t
  modified_base (487)..(499): a, c, t, g, unknown or other
  misc_feature (487)..(499): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgaggggtccctgaccgattctctggctccaagtctggcacctcagcctccctgaccatcagtggctcccggtccgaggatggaggctgacttattactgtgcatcgacgggacncaacagtgggatgacaatctgagcggttgggtgttcgggcgggagggaccaacgtcgaccgtcgtaggtcagcccaaggctcgccctcgtcactctcgtcccaccctcctcctcgtctctactgacgcggctgcgaggcgcatgnnnnnnnnnnnnn

SEQ ID NO: 24740 - DNA, 496 bp, Homo sapiens
  misc_feature: GYAE6OF02GF32I.21.22.B11.1.454.CMB.1.raw
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (484)..(496): a, c, t, g, unknown or other
  misc_feature (484)..(496): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgacccatcagtgggctccggtccgaggatgaggctgactattactgtgcatcacgggacncaacntgggatgacaatctgagcggttgggtgttcgggcggagggaccaaacgtgaccgtctaggtcagcccaaggcctgtccctcggtcactctcgttcccgccctcctcctcgtctctactgacgcggctggcaggcgcagtgnnnnnnnnnnnnn

SEQ ID NO: 24741 - DNA, 871 bp, Homo sapiens
  misc_feature: GYAE6OF02GZWCI.21.22.B11.1.454.CMB.1.raw
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcatcggccggggccccgagaggacggacgacactctcgttcgttcgtaggacgacacctaccaactacgtaaggtaacgttaattagttagttacgtttcgttaggtactacacgaacctaacccgtaccggtaacggtaacggtaccccggtaaccccctaaccctacctacctacctaccgaacggtaaacggtaaacgtaactaccggaccggacccggtacccgtaccgggtaccgggttacccgtacccgtacggttacctttaccgttccggtacggtacccgtaaccgtaaccggtttacggtaccggtacccgtaccctaccggtacccgtcccccgtttaccccgtaccggaaaccttaccgtacgggttccggggttaccggggtccccgggttaccccgggtaaccggggtaacgttaacggtcggggtacggttacccggtaacgtttaaaccgtttaacgttttaccggtgggtacccgtaaccgtacccggtaccggggaaacccgggaacggtaaaccctaaaccggtaggggtaacgggtataaccggtaacgtacttagggtacgggtaccggggtttcggggggttcggtttacgggggtacccggggaacgggggtaaccgaaccggttaaccgtaccgggttcccggtaaccggttacggg

SEQ ID NO: 24742 - DNA, 319 bp, Homo sapiens
  misc_feature: GYAE6OF02GF89D.21.22.B11.1.454.CMB.1.raw
  modified_base (301)..(319): a, c, t, g, unknown or other
  misc_feature (301)..(319): n is a, c, g, or t
tcagtcgtcgctcgcacgaccggtgctcgatttagacgacagctcaggggttcccgtgaccgattctctggctccaagtctggcacctcagcctcccctgaccatcagtgggctccggtccgaggatgaggctgactattactgtgcatcacgggacgcaacatgggatgaccaatcctgagcggttgggtgttcggcggagggaccaaactgaccgtctaggtcagcccaaggctgccccctcggtcactctgttcccacctcctctcgtctctactgagcggctggcaaggcgcatagnnnnnnnnnnnnnnnnnnn

SEQ ID NO: 24743 - DNA, 531 bp, Homo sapiens
  misc_feature: GYAE6OF02I04OM.21.22.B11.1.454.CMB.1.raw
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagtaattatgtattctggtatcagcaactcccaggaatcggcccccaaactcctcatccagagaataatcagcggccctcgaggggtccctgaccgtattctcgtggctccaagtctggcacctcacgccctccctagaccatcagtcgggctccgggtcgaggatgaggctgacttattacngtnctatcgaacgggcncaacngtgggaatgactagtctaggaggtcggttagggtcgttcggacggaggaccaagtcgacccgttcgtaggtccg

SEQ ID NO: 24744 - DNA, 698 bp, Homo sapiens
  misc_feature: GYAE6OF02GYZRU.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcaggagggtcaccatctcttgttctggaggcaactccaacatcggaagtaattatgtattctggtatcagcaactcccaggaatcggacccccaaactcctcatccagaggaaataatcagccggcctcgacggggtccctgaccgtattctctggctaccaagtctcggcaccctcacgtccctcccgtagaccctagttacggtcgggtcccttcccgggtacccggaagggtactcgggaacgggtccttacggtaacctttaagtttaaccgtgggttacgaccgtaacgtttacccgggaaaccgggggtaccgaaccgtaaaaccgtaagggtttcgggggtaacttaacgggaaaccttaaacgttcggttagggaacgggttccgggggttttagggggttcggtttaccgggggaccgggtaacggggtaacccctaaacgttccgggtaccccggttaccgttacgggtccaacccggg

SEQ ID NO: 24745 - DNA, 302 bp, Homo sapiens
  misc_feature: GYAE6OF02F9TUD.21.22.B11.1.454.CMB.1.raw
  modified_base (297)..(302): a, c, t, g, unknown or other
  misc_feature (297)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctggtcactctgttcccacctcctcctcgtctctactgagcgggctggcaaggcgcatagnnnnnn

SEQ ID NO: 24746 - DNA, 577 bp, Homo sapiens
  misc_feature: GYAE6OF02H4B68.21.22.B11.1.454.CMB.1.raw
  modified_base (312)..(312): a, c, t, g, unknown or other
  misc_feature (312)..(312): n is a, c, g, or t
  modified_base (483)..(483): a, c, t, g, unknown or other
  misc_feature (483)..(483): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggaccccccgggcagagggtcaccatctcttgttctggaggcaactccaacatcggaagtaattatgtattctggtatcagcaactcccaggaatcggacccccaaactccncatccagaggaataatcagccggccctcgacggggtcccctggaccgtatttcctcgtcggcctaccaagtcctggccaccctcacgccctcctgacccatcaggtcgggcctcccgggtcgaggtatggaggctgtaacttagttactgtgcagtcgaacggggcacaangtgggaatgaacagtcgtaggacggtccgggtttgggtcggttccggacgggtacgggaacccaaacgttcggaacccggttccgtaggtaccg

SEQ ID NO: 24747 - DNA, 312 bp, Homo sapiens
  misc_feature: GYAE6OF02I5BNX.21.22.B11.1.454.CMB.1.raw
  modified_base (289)..(289): a, c, t, g, unknown or other
  misc_feature (289)..(289): n is a, c, g, or t
  modified_base (306)..(312): a, c, t, g, unknown or other
  misc_feature (306)..(312): n is a, c, g, or t
tcagtcgtcgctcgcacgaccggtgctcgatttagacgacagctcagggtccctgaccgattctctggctccaagtctggcacctcagcctccctcgaccactcagtgggctccggtccgaggactgaggcgtgactattactgtgcatcacgggacgcaacatgggatggacaatctgagcggtgggtgttcggcggagggaccaaagtgaccgtcctaggtcagcccaaggctaggccccctggtcactctgttcccaccgtcctcctcgtctctactgacgcgggntcggcaaggcgcatagnnnnnnn

SEQ ID NO: 24748 - DNA, 303 bp, Homo sapiens
  misc_feature: GYAE6OF02G6IJK.21.22.B11.1.454.CMB.1.raw
  modified_base (298)..(303): a, c, t, g, unknown or other
  misc_feature (298)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccaccctcctcctcgtctctactgagcggctggcaaggcgcatagnnnnnn

SEQ ID NO: 24749 - DNA, 548 bp, Homo sapiens
  misc_feature: GYAE6OF02GTV9X.21.22.B11.1.454.CMB.1.raw
  modified_base (210)..(210): a, c, t, g, unknown or other
  misc_feature (210)..(210): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggacccccaaactcctcatccagagaataatcagcggccctcgacggggtccctgaccgattctctcggctaccaagtctggccaccctcgacgccctccctgacccatcgacggtgggcctcccgggtccgaggatgacggctgactattactgtgcatcgacgggacncaacgngtggatcgacattcgaggaggtcgggtttgggtggttccgggacgggacggaccaaacgtcggacccgtccgtaggtcc

SEQ ID NO: 24750 - DNA, 306 bp, Homo sapiens
  misc_feature: GYAE6OF02IGIPD.21.22.B11.1.454.CMB.1.raw
  modified_base (301)..(306): a, c, t, g, unknown or other
  misc_feature (301)..(306): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctcgttcccaccctcctcctcgtctctactgagcgggctggcaaggcgcatagnnnnnn

SEQ ID NO: 24751 - DNA, 304 bp, Homo sapiens; identical to SEQ ID NO: 23976
  misc_feature: GYAE6OF02HB1Q8.21.22.B11.1.454.CMB.1.raw
  modified_base (300)..(304): a, c, t, g, unknown or other
  misc_feature (300)..(304): n is a, c, g, or t

SEQ ID NO: 24752 - DNA, 493 bp, Homo sapiens
  misc_feature: GYAE6OF02HZ9BY.21.22.B11.1.454.CMB.1.raw
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (479)..(479): a, c, t, g, unknown or other
  misc_feature (479)..(479): n is a, c, g, or t
  modified_base (484)..(493): a, c, t, g, unknown or other
  misc_feature (484)..(493): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtcgaggatgaggctgactattacngtgcatcacgggacncaacngtgggatgacaatctgagtcggttgggtgttcgggcggagggaccaaacgtggaccgtcgtaggtcacgcccgaaggcctcgcccctcggtcactctcgtcccaccctctcctcgtctctcngngcggcngcaggcncatgnnnnnnnnnn

SEQ ID NO: 24753 - DNA, 302 bp, Homo sapiens
  misc_feature: GYAE6OF02GRALJ.21.22.B11.1.454.CMB.1.raw
  modified_base (297)..(302): a, c, t, g, unknown or other
  misc_feature (297)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctggtcactctgttcccgccctcctcctcgtctctactgagcggctggcaaggcgcatagnnnnnn

SEQ ID NO: 24754 - DNA, 303 bp, Homo sapiens
  misc_feature: GYAE6OF02HZ38L.21.22.B11.1.454.CMB.1.raw
  modified_base (300)..(303): a, c, t, g, unknown or other
  misc_feature (300)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccgccctcctcctcgtctctactgagcgggctggcaaggcgcatagnnnn

SEQ ID NO: 24755 - DNA, 549 bp, Homo sapiens
  misc_feature: GYAE6OF02I41JL.21.22.B11.1.454.CMB.1.raw
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (471)..(471): a, c, t, g, unknown or other
  misc_feature (471)..(471): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgttattctggtatcagcaactcccaggaatcggcccccaaatcctcatccagaggaaataatcagccggccctcgacggggtccctgaccgattctcgtggctccaagtctggccacctcacgccctccctgacccatcaggtcgggcctccgggtccgaggatggaggctgaactattacnggtncatcgaacgggcacaacgtagnggatgaactatcgtaggacggttcgggttgggtcggttcgggacggaacggaccaaacgtcggacccgttcgaggtcc

SEQ ID NO: 24756 - DNA, 607 bp, Homo sapiens
  misc_feature: GYAE6OF02H8OE5.21.22.B11.1.454.CMB.1.raw
  modified_base (211)..(211): a, c, t, g, unknown or other
  misc_feature (211)..(211): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagagggtcaccatctcttgttctggagcaactccaacatcggaaataattatgtattctggtatcagcaactcccaaggaactcggacccccaaactcctacactccaagaggaataatcaggccggccctcgaggggtcccctgaccgtattctcgtggctaccgagtctggccacctnacgccctccngaccatcgaggtcgggcctccgggtaccgaggtatcggacggtctagtacttaatcgngtgacaacgtcgaacgggaccacaagcgtagggaactacgactaagttcgtaggtagggtccggtttaggggttcggttaccggggaccgggtaacgggggaaccctaaaaccggttccgggaaccccgtttccggtaagggtacccg

SEQ ID NO: 24757 - DNA, 607 bp, Homo sapiens
  misc_feature: GYAE6OF02G9PBR.21.22.B11.1.454.CMB.1.raw
  modified_base (206)..(206): a, c, t, g, unknown or other
  misc_feature (206)..(206): n is a, c, g, or t
  modified_base (302)..(302): a, c, t, g, unknown or other
  misc_feature (302)..(302): n is a, c, g, or t
  modified_base (318)..(318): a, c, t, g, unknown or other
  misc_feature (318)..(318): n is a, c, g, or t
  modified_base (471)..(471): a, c, t, g, unknown or other
  misc_feature (471)..(471): n is a, c, g, or t
  modified_base (499)..(499): a, c, t, g, unknown or other
  misc_feature (499)..(499): n is a, c, g, or t
tcagtcgtcgctcgcacgaccggtgctcgatttagacgacagctcaggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaataattatgtattctggtatcagcaactcccaggaatcggacccccaaatccncatccagaggaataancagccggccctcgaggggtcccctgaccgtattctcgtggcctaccgaaagttcctggccaacccttcgaacgtcccctaccctgaaccctatccaaggttcgggccttcccggggtccgaaggatggagggccttaggaaccttattaccgnggtacgcattccgacggggacacaacgngtgggatcgaactaattcgtaggacgggttcgggtttggggttacggttcggggtacgggaacgggtaaccctaaacggtcggtaaccccggttccgtaagggtaccc

SEQ ID NO: 24758 - DNA, 528 bp, Homo sapiens
  misc_feature: GYAE6OF02FLZ6F.21.22.B11.1.454.CMB.1.raw
  modified_base (209)..(209): a, c, t, g, unknown or other
  misc_feature (209)..(209): n is a, c, g, or t
  modified_base (444)..(444): a, c, t, g, unknown or other
  misc_feature (444)..(444): n is a, c, g, or t
  modified_base (458)..(458): a, c, t, g, unknown or other
  misc_feature (458)..(458): n is a, c, g, or t
  modified_base (501)..(501): a, c, t, g, unknown or other
  misc_feature (501)..(501): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgtctggaggcaactccaacatcggaagtaattatgtattctggtatcagcaactcccaggaatcggcccccaaaactcctcatccagaggaaataatcagcggccctcgaggggtccctgacccgattctctggctccaagtctggcacctcagccctccctgacccatccaggtcgggcctccgggtccgaggatggaggcttgactattactgtncatcgacggggacncaacatgggatgacatctggacggtcgggttgggtgttccggnggaggaccaaagtcgaccgtcaggtcg

SEQ ID NO: 24759 - DNA, 522 bp, Homo sapiens
  misc_feature: GYAE6OF02HRL57.21.22.B11.1.454.CMB.1.raw
  modified_base (376)..(376): a, c, t, g, unknown or other
  misc_feature (376)..(376): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
tcagtcgtcgctcgcacgaccggtgctcgatttagacgacagctcaggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcatccagaggaataatcagcggccctcgaggggtccctgaccgattctctggctccaagtctggcacctnacgccctcctgacccatcagtgggctccgggtcgaggatggacgctgactattactgtgcatcgacggggacncaaacntgggatgacatcgtaggaggtcggttgggtgttcggcggaggacccaaagtcgaccgtcgtaggtcg

SEQ ID NO: 24760 - DNA, 302 bp, Homo sapiens; identical to SEQ ID NO: 23945
  misc_feature: GYAE6OF02IEIKE.21.22.B11.1.454.CMB.1.raw
  modified_base (298)..(302): a, c, t, g, unknown or other
  misc_feature (298)..(302): n is a, c, g, or t

SEQ ID NO: 24761 - DNA, 403 bp, Homo sapiens
  misc_feature: GYAE6OF02HCAED.21.22.B11.1.454.CMB.1.raw
  modified_base (393)..(403): a, c, t, g, unknown or other
  misc_feature (393)..(403): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgtggacgggacggaaacctaacgtaccggtacccgttacggtacggtacgacccgaacccggaacggtccgtcccccgtcccccggttccggtacctaccttccgttccccggttcccccgtccccttccccttcccgttccgttcccttaccttacgtacggaccgggccggtcggtcggaacggaacggccgactaagtgnnnnnnnnnnn

SEQ ID NO: 24762 - DNA, 660 bp, Homo sapiens
  misc_feature: GYAE6OF02HNNES.21.22.B11.1.454.CMB.1.raw
  modified_base (209)..(209): a, c, t, g, unknown or other
  misc_feature (209)..(209): n is a, c, g, or t
  modified_base (357)..(357): a, c, t, g, unknown or other
  misc_feature (357)..(357): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnaggaggtcaccatctcttgttctggagcaactccaacatacggaaagttaattatgtattctggtatcagcaactcccaaggaactccggacccccaaactcctcactccagaagaatatcagccgcctgacggggtccctgaccgtnttctcgtcggcctaccgaagtcgtcggacctaccctacgaccgtccctcccgtacgaccctagtccgtaggtccgggccgttcccgggtaccggaggtacgtcgggacggtccttagtaaccttagttaccgtggtacgacctacgtaccggaacgggtaccgacctaaacgtaggtacgggaattacgaactaacgttcgttaagggacgggttcggggtttggggttacggtttacccggggacggggtaacgggtaacccgtaaacgttccgggtaacccggttaccggttaggtacccg

SEQ ID NO: 24763 - DNA, 548 bp, Homo sapiens
  misc_feature: GYAE6OF02H1W4S.21.22.B11.1.454.CMB.1.raw
  modified_base (212)..(212): a, c, t, g, unknown or other
  misc_feature (212)..(212): n is a, c, g, or t
  modified_base (461)..(461): a, c, t, g, unknown or other
  misc_feature (461)..(461): n is a, c, g, or t
  modified_base (483)..(483): a, c, t, g, unknown or other
  misc_feature (483)..(483): n is a, c, g, or t
tcagtcgtcgctcgcacgaccggtgctcgatttagacgacagctcaggggggggaagctcagcttcagtctgtggtagagaagacaggactcaggacaatctccagcatggccggcttccctctcctcctcaccctcctcactcactgcgcagggtcctgggcccagtctgtgctgactcagcccacctcagcgtctcggggacccccgggnagagggtcaccatctcttgttctggaggcaactccaacatcggaaagttaatttatgtattctggtatcagcaactcccaggaactcggacccccaaatcctcatccagagaataatcagccggccctcgacggggtccctgaccgtattctcgtggctaccaagtccgtggacctacctcgacgtccctccgtgacccatccgaggtcggcctccgggtcgaggtctggacggtctaggacttatacngtgctatcgacgggctcaacgngtggatgactatcgtggagtcggttggtgtccggcggacggaccaacgtggaccttcgtagaccg

SEQ ID NO: 24764 - DNA, 714 bp, Homo sapiens
  misc_feature: GYAE6OF02IMS1X.21.22.B11.1.454.CMB.1.raw
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (708)..(708): a, c, t, g, unknown or other
  misc_feature (708)..(708): n is a, c, g, or t
  modified_base (712)..(713): a, c, t, g, unknown or other
  misc_feature (712)..(713): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcactccagaggaataatcagcggccctcgacggggtccctggacccgattctcgtggcctccaagtctggcacctcagcctccctgaccatcaggtcgggcctccggtccgaggatggaggctgacttattactgngcatcgacgggcacaacngtgggatcggaacaatcgtaggacggtcgggtttaggggtcggtttaccgggacgggtaacggggaacccgtaaacgttacgggaaccccggttacccggttaacgggttcccgaaccggtaccccggtaaacggggtcccgttacccgggccccccccggttacgggtttaccccctaacccgtttccccgttacccggtttacccccctaccccccgtttccccgtttccccgtttacccgggtttcccttaccccgtttaaccgttccgggaccgggtcccggggtaccgtccgggaccgtaaaccgggccggtaccgtaacggtaacggctctagcgtgctacgcancgcnnc

SEQ ID NO: 24765 - DNA, 653 bp, Homo sapiens
  misc_feature: GYAE6OF02GZ6GP.21.22.B11.1.454.CMB.1.raw
  modified_base (310)..(310): a, c, t, g, unknown or other
  misc_feature (310)..(310): n is a, c, g, or t
  modified_base (345)..(345): a, c, t, g, unknown or other
  misc_feature (345)..(345): n is a, c, g, or t
  modified_base (640)..(640): a, c, t, g, unknown or other
  misc_feature (640)..(640): n is a, c, g, or t
  modified_base (648)..(648): a, c, t, g, unknown or other
  misc_feature (648)..(648): n is a, c, g, or t
  modified_base (650)..(650): a, c, t, g, unknown or other
  misc_feature (650)..(650): n is a, c, g, or t
  modified_base (652)..(653): a, c, t, g, unknown or other
  misc_feature (652)..(653): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggccccaaatcctcatccagaggaataatcagcggccctcgaggggtccctgaccgattcctctggctccaagtctggcacctcagcctccctgacccatcagtcgggcctccgggtccgaggntggaggctgacttattactgtgcatcgacgggacncaacagtgggatgaacaagtcgtaggacggtcgggtttggggtcggttaccgggacgggtaacgggaaccctaaacggtcggaacccggttaccgtaacgggtccaacggacccgaaacgggtcccgtcccggtccccccgttacgggtccctaccgttcccgttcccgtttacccccaccccgtttccccgttacccgttcccggttccctttaccgttaaccgttcggaccgggtcccggggtccttacgggaccgtaacggggccgtaccgtaacgtacggcacgtcgagcncgtgcgcncncnn

SEQ ID NO: 24766 - DNA, 548 bp, Homo sapiens
  misc_feature: GYAE6OF02G2F5Q.21.22.B11.1.454.CMB.1.raw
  modified_base (384)..(384): a, c, t, g, unknown or other
  misc_feature (384)..(384): n is a, c, g, or t
  modified_base (432)..(432): a, c, t, g, unknown or other
  misc_feature (432)..(432): n is a, c, g, or t
  modified_base (450)..(450): a, c, t, g, unknown or other
  misc_feature (450)..(450): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaagtaattatgtattctggtatcagcaactcccaggaatcggcccccaaatcctcatccagagaatatcagcgccctcgaggggtccctgaccgattcctctggctaccaagtctggcacctcacgccctcccngacccatcaggtcggctccgggtcgaggatggaggctgacttattacngtgcatccgacgggccanaacagtgggaatgaactatcgtaggaacggtcgggtttgggtcgttcgggacggtaacgggaccctaaaagttcgggaacccgttccgtaggtacccg

SEQ ID NO: 24767 - DNA, 531 bp, Homo sapiens
  misc_feature: GYAE6OF02FWFVH.21.22.B11.1.454.CMB.1.raw
  modified_base (209)..(209): a, c, t, g, unknown or other
  misc_feature (209)..(209): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcgagccaccctcagcgtctgggacccccgggnagagggtcaccatctcttgttctggagcaactccaacatcggaagtaattatgtattctggtatcagcaactcccaggaatggcccccaaatcctcatccagaggaataatcagcggccctcaggggtccctgaccgattctctggctccaagtctggcacctcagcctcctgaccatcagtggctccggtcgaggatgagctgactatactgtncatcgacgggacncaacntcgggatgacatcgtagaggtcgggttggggtgtttccgggacgggtacgggaccctaaacgtcggtaacccggtcccgtagggtcccg

SEQ ID NO: 24768 - DNA, 564 bp, Homo sapiens
  misc_feature: GYAE6OF02JEA7L.21.22.B11.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (428)..(428): a, c, t, g, unknown or other
  misc_feature (428)..(428): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaacntcggaagtaattatgtattctggtatcagcaactcccaggaatcggcccccaaaactcctcatccacgaggaataatcagcggccctcaggggtccctgaccgattctctggctcaagtctggcacctcagcctccctgaccatcagtcggcctccggtccgaggatcgagctgactattacngtgctagtccgacggggacgccaaagcgtggggataggaacctaattcgtaggaaggtccggggttttgggggtgtttccggggcggaaacggggtaccctaaaacggtcgtaccccggttacccgtagggtaccc

SEQ ID NO: 24769 - DNA, 709 bp, Homo sapiens
  misc_feature: GYAE6OF02J25J1.21.22.B11.1.454.CMB.1.raw
  modified_base (212)..(212): a, c, t, g, unknown or other
  misc_feature (212)..(212): n is a, c, g, or t
  modified_base (287)..(287): a, c, t, g, unknown or other
  misc_feature (287)..(287): n is a, c, g, or t
  modified_base (581)..(581): a, c, t, g, unknown or other
  misc_feature (581)..(581): n is a, c, g, or t
tcagtcgtcgctcgcacgaccggtgctcgatttagacgacagctcagggggggaaggcgtcagcttcagctgtggtagagaagacaggactcaggacaatctccagcatggccggcttccctctcctcctcaccctcctcactcactgcgcagggtcctgggcccagtctgtgctgactcagccacctcagcgtcgtcgggaccccccgggnacggagggtcaccgactccttcttcgttcctaggtacggccaaccgtccaacgagtccggaaagttaacttagtnttattctggtaatccgagcctaaacgtcccaagggtaactcggacccccctaaaacttcctcacttaccaaggaacggtaaacttaaacgtccaaggtcccggaccctcggtaccgggggtacccctggaaccccgtatttcctccgtcgggtcctaccgaacggtccttacggccctaaccgtcctacgccccttcccgtagaacccgtatccgtaacgggttcggggccctttcccgggaccggtaacgggacttgggtaaccggtctttacggaacctttacgttttaccncggtttaggacctacgttaccggaacgggaccgtaaccgaaatccgggtaggactacaacggacctggttacggaggtccggggttgtccgggtcgaggaccggtacaacgttgcccgttcgcggtac

SEQ ID NO: 24770 - DNA, 562 bp, Homo sapiens
  misc_feature: GYAE6OF02F4EAR.21.22.B11.1.454.CMB.1.raw
  modified_base (209)..(209): a, c, t, g, unknown or other
  misc_feature (209)..(209): n is a, c, g, or t
  modified_base (393)..(393): a, c, t, g, unknown or other
  misc_feature (393)..(393): n is a, c, g, or t
  modified_base (440)..(440): a, c, t, g, unknown or other
  misc_feature (440)..(440): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgtctggaggcaactccaacatcggaagtaattatgtattctggtatcagcaactcccaggaatcggcccccaaatcctcatccagagaataatcagcggccctcgaggggtccctgaccgtattcctcgtggctccaagtctggcacctcagccctccctgacccntcaggtcgggcctccgggtccgaggatggaggctgacttattactgngcatccgacgggcncaacngtgggatgactaagttcgtggaaggtcgggtttaggggtcgttaccgggacgggtaacggggacctaaaaccggttggaaccccggttcccgtagggtacccg

SEQ ID NO: 24771 - DNA, 529 bp, Homo sapiens
  misc_feature: GYAE6OF02GNRCS.21.22.B11.1.454.CMB.1.raw
  modified_base (353)..(353): a, c, t, g, unknown or other
  misc_feature (353)..(353): n is a, c, g, or t
  modified_base (412)..(412): a, c, t, g, unknown or other
  misc_feature (412)..(412): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctgaggggtccctgaccgattcnctggctccaagtctggcacctcacgcctccctgacccatcagtgggctccggtcgaggntggagctgactattctgtgcatcgacgggacncaacngtgggatcgacatctggaggtcgggtttgggtgttaccgggcggaagggacccaaacgttggaacccggttcgtaggtcc

SEQ ID NO: 24772 - DNA, 599 bp, Homo sapiens
  misc_feature: GYAE6OF02JCDRR.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggatcggccccaaatcctcatccagaggaataatcagccggccctcgacggggtcccctagaccgattcctctggcctaccaagtccgtggccacctcacgccctccctcgaccctatccgaggtcgggcctcccgggtccgacggatggacggtctgaaccttattccgtgtcgcgtatccgaaccggggacgacaaacgtgtgggaatcgaactagtccgtagggacggtcggggttttaggggtcgttcggggacgggtaaccggggaaccctaaacggttccggaaccccggttccgttagggtaccc

SEQ ID NO: 24773 - DNA, 674 bp, Homo sapiens
  misc_feature: GYAE6OF02G41MM.21.22.B11.1.454.CMB.1.raw
  modified_base (413)..(413): a, c, t, g, unknown or other
  misc_feature (413)..(413): n is a, c, g, or t
  modified_base (460)..(460): a, c, t, g, unknown or other
  misc_feature (460)..(460): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccggcagacgggtcaccatctcttgttctggagcaactccaacatcggaagtaattatgtattctggtatcagcaactcccaggaatcggacccccaaactcctcactccagaggaataatcaggccggccctcgacggggtccctagacccgtattcctcgtcggctaccgaagttcctggaccacctcacgtccctccctgaccngtcaggtcgggctccgggtcgaggatgacggcttagacttattacgngtcgactacgttccggaacgggggtaccaccgtaaaacgtgggtacgggaaacttacggaaacctaagttccgggttaagggaccggggtttcccgggggtttttaggggggttaccggttttaccccggggggaacgggggttaaaccggggtaacccctaaaacgggtttcccggggtaaacccccggttttccggttaacggggtacccgg

SEQ ID NO: 24774 - DNA, 588 bp, Homo sapiens
  misc_feature: GYAE6OF02GWOH2.21.22.B11.1.454.CMB.1.raw
  modified_base (383)..(383): a, c, t, g, unknown or other
  misc_feature (383)..(383): n is a, c, g, or t
  modified_base (454)..(454): a, c, t, g, unknown or other
  misc_feature (454)..(454): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcatccagaggaataatcagcgccctcgacggggtccctgaccgtattctctggcctacgaagtctggaccaccctnacgccctccctagaccctagtcaggtcgggcctccgggtccgagggatggacggctagtaccttattacgngttcgactacgtacgaccggggacacaacgagtggatagaactagtcgtaggacggtcggggtttagggtcggtttaccgggacgggtaacgggtaaccctaaacgttcgggtaacccgttccgtaggtacccg

SEQ ID NO: 24775 - DNA, 305 bp, Homo sapiens
  misc_feature: GYAE6OF02IIO6W.21.22.B11.1.454.CMB.1.raw
  modified_base (301)..(305): a, c, t, g, unknown or other
  misc_feature (301)..(305): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctcgttcccaccctcctcctcgtctctactgagcgggctggcaaggcgcatagnnnnn

SEQ ID NO: 24776 - DNA, 543 bp, Homo sapiens
  misc_feature: GYAE6OF02GAOET.21.22.B11.1.454.CMB.1.raw
  modified_base (109)..(109): a, c, t, g, unknown or other
  misc_feature (109)..(109): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (356)..(356): a, c, t, g, unknown or other
  misc_feature (356)..(356): n is a, c, g, or t
  modified_base (524)..(524): a, c, t, g, unknown or other
  misc_feature (524)..(524): n is a, c, g, or t
  modified_base (526)..(527): a, c, t, g, unknown or other
  misc_feature (526)..(527): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (540)..(540): a, c, t, g, unknown or other
  misc_feature (540)..(540): n is a, c, g, or t
tcagtcgtcgctcgcacgaccggtgctcgatttagacgacagctcaggggtccctgggcccaacgtctgtgctgactcagccaccctcagcgtcgtgggacccccgggnagagggtcaccaattctcttgttctggaggcaactccaacacttcggaagttaattatgtagttctggtatccacgcaacctcccaggaatcggcccccaaatcctcatccagaggatatcagcggcctcagggtcccngaccgnttctcgtggcctccgaagtcctggcacctcagcctcctgacccagtccagtgggctccggtccgaggatgaggctggactattacgtgtgcatcacgggacncaacatgggatgaacaatcgagacgcgggttagggtgtttcgggcgggagggtaccaaacgttgaccgtcctaggtcagcccaaggcgtcgccccgtcggtccacgtcctgttcccgccttcctcctcgtctctctgacgcggctcggcacggcacgtacgttcggcngnngangngtnatgangcg

SEQ ID NO: 24777 - DNA, 648 bp, Homo sapiens
  misc_feature: GYAE6OF02GV0G9.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcatccagaggaataatcagcggccctcgacggggtccctgaccgtattctctcggctaccaagtcctggcctaccgtcacgtccctccctgacccatccgaggtcgggccttcccgggccgagggtactggacggtccttaggtaaccttagttaccttgggtcgctaagttcccggaacgggggaccaccaaaccgtgggtacgggaattcggaacctaacgttccggtagggtaacgggttcccggggttttgggggtcggtttacccgggggacggggtaaccggggtaacccctaaaacggttccgggtaacccggtttcccggtaagggtcccg

SEQ ID NO: 24778 - DNA, 307 bp, Homo sapiens
  misc_feature: GYAE6OF02J07MW.21.22.B11.1.454.CMB.1.raw
  modified_base (298)..(307): a, c, t, g, unknown or other
  misc_feature (298)..(307): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaacgtgaccgtctaggtcagcccaaggctcgccccctggtcactctcgttcccgccctcctcctcgtctctactgagcgggctggcaggcgcatgnnnnnnnnnn

SEQ ID NO: 24779 - DNA, 556 bp, Homo sapiens
  misc_feature: GYAE6OF02I58G2.21.22.B11.1.454.CMB.1.raw
  modified_base (209)..(209): a, c, t, g, unknown or other
  misc_feature (209)..(209): n is a, c, g, or t
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
  modified_base (466)..(466): a, c, t, g, unknown or other
  misc_feature (466)..(466): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggaccccaactcctacactccagagaataatcagccgcctcgacggggtccctgaccgtattctcgtggcctaccgaagtctggaccacctcacgccctccctgaccatcgaggtcggcctccggaccgagntgagctagactattacngtcgactatcgacgggacacaacgngtcggatacgaacattcgaggacgggtcggtttggggtcgttcggggacggtaacgggaccctaaagtcggaacccgttcgtaggtaccg

SEQ ID NO: 24780 - DNA, 575 bp, Homo sapiens
  misc_feature: GYAE6OF02G73C6.21.22.B11.1.454.CMB.1.raw
  modified_base (456)..(456): a, c, t, g, unknown or other
  misc_feature (456)..(456): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaaactccctcatcccaggaggaaataatcagccggccctcgacggggtccctgaccgtattctctggctccaagtctggccacctcacgccctccctgacccagtcaggtcgggcctcccgggtcgaggactggaggctgacttattactgtcnctagtccgacgggacacaacgagtgggaatcgaacagtccgtaggcggtcgggttgggttcggttcgggacgggtaacgggacccgtaaaccgttcggaaccccgttcggtaggtaccg

SEQ ID NO: 24781 - DNA, 589 bp, Homo sapiens
  misc_feature: GYAE6OF02GVHY0.21.22.B11.1.454.CMB.1.raw
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
  modified_base (323)..(324): a, c, t, g, unknown or other
  misc_feature (323)..(324): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
tcagtcgtcgctcgcacgaccggtgctcgatttagacgacagctcagggggggaaggcgtcagcttcagctgtggtagagaagacaggactcaggacaatctccagcatgccggcttccctctcctcctcaccctcctcactcactgcgcaggtcctggcccagtctgtgctgactcagccaccctcagcgtctcggggacccccggcgagacgggtcaccatcctcttgttctggaggcaactccaacatcggaagtaattatgtattntggtatcagcaactcccaggaatcgaccccaaactcctcanccagagaataannagcggcctacgacggggtccctgaccgtattctacctggctaccaaagtcctaggtccacctcagtccctacccgcgaccntaccnggtacgggtctacccgggtccaagggtatcggaaggtccttacggaaactttaacgtttacgtaggttcgcaaggttcccgaacggggtacgaccaacgaagtgggactagactaatccgaggaggttcggtggttaggccggtacggaagggtaccaaagttgaacccgttcgtagcg

SEQ ID NO: 24782 - DNA, 353 bp, Homo sapiens
  misc_feature: GYAE6OF02IA92E.21.22.B11.1.454.CMB.1.raw
  modified_base (249)..(249): a, c, t, g, unknown or other
  misc_feature (249)..(249): n is a, c, g, or t
  modified_base (301)..(302): a, c, t, g, unknown or other
  misc_feature (301)..(302): n is a, c, g, or t
  modified_base (304)..(353): a, c, t, g, unknown or other
  misc_feature (304)..(353): n is a, c, g, or t
tcagtcgtcgctcgcacgaccggtgctcgatttagacgacagctcgaggggtccctgaccgattctctggctccaagtctggcacctcagcctcccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggcactcngttcccgcctcctcctcgtctctactgagcgggactggcaaggcgcactagnntnnnnnnnnnnnnnnnnnnnnnnnnnnnnnnnnnnnnnnnnnnnnnnnnnn

SEQ ID NO: 24783 - DNA, 639 bp, Homo sapiens
  misc_feature: GYAE6OF02HM3C4.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaagttaattatgttattctggtatcagccaactcccaggaactcggacccccaaactcctcactccagagaataatcagccgcctcgacggggtccctgaccgtattctcgtggcctaccaagtctcggccacctcacgtccctccctacgacctatcgaggtcgggccttcccgggtccgaagggtatcggacggtcctaggtaacttacgtttacgtggtacgacctacgtaccgaacggggacaacgtaaaaggtgggaatacggaactaagttcgtaggtacgggtcggggtttaggggttcgggttaccggggaccgggtaaggggtaacccctaaacgggttcggtaaccccggtttaccgttacgggtacccaaccgggg

SEQ ID NO: 24784 - DNA, 556 bp, Homo sapiens
  misc_feature: GYAE6OF02FMUW2.21.22.B11.1.454.CMB.1.raw
  modified_base (207)..(207): a, c, t, g, unknown or other
  misc_feature (207)..(207): n is a, c, g, or t
  modified_base (468)..(468): a, c, t, g, unknown or other
  misc_feature (468)..(468): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaacatcggaagtaattatgtattctggtatcagcaactcccaggaactcggacccccaaactcctcatccagaggaataatcagccggcctcgacggggtccctgaccgtattctctggctacaagtctggcacctcacgtccctcctgaccatccgaggtcgggcctccgggccgaggatggacgtctagactattacgtgcgcagtccgaaccgggtacacaacgngtaggatacgaactatcgtggaaggtcgggttgggtcgttcgggacgggtaacgaacctaaacgtcggacccggttacgtaggtaccg

SEQ ID NO: 24785 - DNA, 564 bp, Homo sapiens
  misc_feature: GYAE6OF02GYLWT.21.22.B11.1.454.CMB.1.raw
  modified_base (208)..(208): a, c, t, g, unknown or other
  misc_feature (208)..(208): n is a, c, g, or t
  modified_base (473)..(473): a, c, t, g, unknown or other
  misc_feature (473)..(473): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggacccccaaatcctcatccagaggaataatcagcggccctcgacggggtccctgaccgtattcctcgtggctaccaagtcctggcctacctcacgccctccctgaccctatccaggtcgggcctcccgggtccgaggatggaggctagacttattactgtcgctatcgacgggacacaacngtaggatgaactatcgtaggacggtcgggttgggtcgttcggggacgggaacgggtaccctaaacggtcggtacccgttccgtaggtaccg

SEQ ID NO: 24786 - DNA, 523 bp, Homo sapiens
  misc_feature: GYAE6OF02I8LKF.21.22.B11.1.454.CMB.1.raw
  modified_base (208)..(208): a, c, t, g, unknown or other
  misc_feature (208)..(208): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
  modified_base (473)..(473): a, c, t, g, unknown or other
  misc_feature (473)..(473): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgttctggaggcaactccaacatcggaagtaattatgtattctggtatcagcaactcccaggaatcggacccccaaactcctcatccagaggaataatcagcggccctcgaggggtccctgaccgtattcctctggctccaagtctggccacctcagccctccctgacccntcagtggctccgggtcgagntgaggctgacttatactgtgcatcgacgggacncaacngtgggatgacatcgtaggnggtcggttgggtgttcggaggacggaccaaacgtgacccgtcgtaggtcc

SEQ ID NO: 24787 - DNA, 550 bp, Homo sapiens
  misc_feature: GYAE6OF02FV0H0.21.22.B11.1.454.CMB.1.raw
  modified_base (355)..(355): a, c, t, g, unknown or other
  misc_feature (355)..(355): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggagcaactccaacatcggaagtaattatgtattctggtatcagcaactcccaggaatcggcccccaaatcctcatccagaggaataatcagcggccctcgacggggtccctgaccgattcnctggctccaagtctggcacctcacgcctcctgaccatcagtggcctccggtccgaggatggagctgacctattactgtgcatcgacgggacncaacgngtagggatgaactatcgtaggacggtcgggtttggggtgtttccgggacgggtaacgggacctaaaccggttcggaaccccggttcgtaagggtccg

SEQ ID NO: 24788 - DNA, 522 bp, Homo sapiens
  misc_feature: GYAE6OF02I24Z1.21.22.B11.1.454.CMB.1.raw
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (511)..(512): a, c, t, g, unknown or other
  misc_feature (511)..(512): n is a, c, g, or t
  modified_base (517)..(518): a, c, t, g, unknown or other
  misc_feature (517)..(518): n is a, c, g, or t
  modified_base (520)..(522): a, c, t, g, unknown or other
  misc_feature (520)..(522): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggccccaaatcctcatccagaggaataatcagcggccctcaggggtccctgaccgattctctggctccaagtctggcacctcagcctcctgaccatcagtgggctccggtccgagatgaggctgactattacngtgcatcgacgggacncaacatgggatgacatctagagcggttgggtgttcgggacggagggaccaacgtgacccgtcgtaggtcagacccgaaggctcgccccgtcggtcactcgtcgttcccgcccttcctcccgtcgcctcctacgtcggacgtcgggctcggcgaacggcgacgacgtaggcngncgtnntcgcnncnnn

SEQ ID NO: 24789 - DNA, 309 bp, Homo sapiens
  misc_feature: GYAE6OF02G1S31.21.22.B11.1.454.CMB.1.raw
  modified_base (300)..(302): a, c, t, g, unknown or other
  misc_feature (300)..(302): n is a, c, g, or t
  modified_base (304)..(309): a, c, t, g, unknown or other
  misc_feature (304)..(309): n is a, c, g, or t
tcagtcgtcgctcgcacgaccggtgctcgatttagacgacagctcagggggtccctgaccgattctctggcctccaagtcctggcacctcagcctccctgaccatcagtgggctccggtccgaggatgaggctgactattactgtgcatcacgggacgcaacatgggatgacaatctgagcggttggtgttcggcggagggaccaaactgaccgtctaggtcagcccaaggctgccccctggtcactctgttccccgcctccctcgtctctactgacgcgggctggcaaggtcgcatagnnncnnnnnn

SEQ ID NO: 24790 - DNA, 623 bp, Homo sapiens
  misc_feature: GYAE6OF02GX9LT.21.22.B11.1.454.CMB.1.raw
  modified_base (348)..(348): a, c, t, g, unknown or other
  misc_feature (348)..(348): n is a, c, g, or t
  modified_base (499)..(499): a, c, t, g, unknown or other
  misc_feature (499)..(499): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcaggagggtcaccatctcttgttctggaggcaactccaacatcggaagtaattatgtattctggtatcagcaactcccaggatcggccccaaatcctcactccagagaataactcacgccggccctgacggggtcccngaccgtattctcgtggcctaccgaagtctcggccacctcacgtccctccctacgaccatcagggtcgggccttcccggggtcgaaggtctggacggtctacgacttacgtttactggtcactacgttccggaacggggtaccacctaaagnggttacgggaacttagaacctacgttcgtagggacgggttccggggtttaggggtcggttacgggggaccgggtaacgggaaaccctaacggttccgggaaccccggtttccgaagggtacccg

SEQ ID NO: 24791 - DNA, 602 bp, Homo sapiens
  misc_feature: GYAE6OF02GNNFU.21.22.B11.1.454.CMB.1.raw
  modified_base (503)..(503): a, c, t, g, unknown or other
  misc_feature (503)..(503): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctaggtatcagcaactcccaggaatcggacccccaaactcctcatccaagagaaataatcagccggccctcgacggggtccctgaccgtattcctcgtggcctaccgaagtcctggacctaccctcacgtcccctccctagacccagtcgaggtcgggtcctcccgggtaccgaggactggacggccttggaaccttagttactggtcgactagtccgaacggggacacaaacgngttagggatagacctaagtccgtaggacggtcgggtttggggtcggttccgggacgggtaacgggaccctaaacgttcggaaccccggttctaggtccg

SEQ ID NO: 24792 - DNA, 595 bp, Homo sapiens
  misc_feature: GYAE6OF02HQMD2.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggaccccaaactcctcatccagagaataatcagccgcctcgacggggtccctgaccgtattctctggctccaagtctggccacctcacgtccctccgtacgacccatccgagtcgggctccgggtcgaggatcggaggtctacgtacttagttactggtcgccaagttccgaacggggaccaccaaacgtagtagggaacttgaactaacttcgtaggacggttcgggtttgggtacggttaccggggacgggaacgggtaacccaaacgttcgggaaccccggtttccggtaagggtacccg

SEQ ID NO: 24793 - DNA, 304 bp, Homo sapiens
  misc_feature: GYAE6OF02HRU45.21.22.B11.1.454.CMB.1.raw
  modified_base (299)..(304): a, c, t, g, unknown or other
  misc_feature (299)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctcgttcccacctcctcctcgtctctactgagcgggctggcaaggcgcatagnnnnnn

SEQ ID NO: 24794 - DNA, 503 bp, Homo sapiens
  misc_feature: GYAE6OF02HEXAI.21.22.B11.1.454.CMB.1.raw
  modified_base (209)..(209): a, c, t, g, unknown or other
  misc_feature (209)..(209): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (474)..(474): a, c, t, g, unknown or other
  misc_feature (474)..(474): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (499)..(503): a, c, t, g, unknown or other
  misc_feature (499)..(503): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgttctggaggcaactccaacatcggaagtaattatgtattctggtatcagcaactcccaggaatcggcccccaaactcctcatccagaggaataatcagcggccctcgacggggtccctgaccgtattctctggctccaagtctgcacctcacgcctccctgaccatcgagtcgggctccggtccgaggatgacggctgaacttattactgttcagtccgacgggacncaacngtgggatgacatcnggagcgggctggcaaggcananagnnnnn

SEQ ID NO: 24795 - DNA, 584 bp, Homo sapiens
  misc_feature: GYAE6OF02IIU08.21.22.B11.1.454.CMB.1.raw
  modified_base (209)..(209): a, c, t, g, unknown or other
  misc_feature (209)..(209): n is a, c, g, or t
  modified_base (444)..(444): a, c, t, g, unknown or other
  misc_feature (444)..(444): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcgggacccccgggnagagggtcaccatctcttgttctggagcactccaacatcggaagtaattatgtattctggtatcagcaactcccagaatcggacccccaaactcctcatccagaggaataatcagccgcctcgaggggtccctgaccgtattctctggctccgaagttctggccacctcgacgtccctcctagacccatcaggtgggcctacccggtcgaggatggacggtctgacttagttacngtgctacgtccgaccggggacacaacgtgtagggatgaactagttcgtggaacgggttcgggttagggttcggttaccgggacgggtacggggtaaacccctaaaggttccgggaaccccggtttccgtaagggtacccg

SEQ ID NO: 24796 - DNA, 509 bp, Homo sapiens
  misc_feature: GYAE6OF02JGIE4.21.22.B11.1.454.CMB.1.raw
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (496)..(497): a, c, t, g, unknown or other
  misc_feature (496)..(497): n is a, c, g, or t
  modified_base (499)..(501): a, c, t, g, unknown or other
  misc_feature (499)..(501): n is a, c, g, or t
  modified_base (503)..(509): a, c, t, g, unknown or other
  misc_feature (503)..(509): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctcctgacccatccagtcggcctccggtccgaggatgaggctgactattactgtgcatcacgggacncaacntgggatgacaatctgagcggttgggtgttcgggcgagggaccaacgtgaccgtctaggtcagcccgaaggcctcgcccctcggtccacgtcctcgttcccgccctcctcctccgtctctactgacgccgggctcggcaaggcgacgagtcgnngnnncnnnnnnn

SEQ ID NO: 24797 - DNA, 590 bp, Homo sapiens
  misc_feature: GYAE6OF02G74XX.21.22.B11.1.454.CMB.1.raw
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccaaggtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcacggggtccctgacccgattctctggctccaagtctggcacctcagccctccctgacccatcagtcgggcctccgggtccgaggatggaggcctggacttattactgtgcagtccgacgggtacncaaacgngtcggggaatcggaactaagtccgtagggaacggtccggggttttaggggtcggtttccggggacggggtacggggtaaccctaaaaccggttcggtaaccccggttacccgtagggtacccg

SEQ ID NO: 24798 - DNA, 592 bp, Homo sapiens
  misc_feature: GYAE6OF02IRGZV.21.22.B11.1.454.CMB.1.raw
  modified_base (579)..(579): a, c, t, g, unknown or other
  misc_feature (579)..(579): n is a, c, g, or t
  modified_base (581)..(592): a, c, t, g, unknown or other
  misc_feature (581)..(592): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggccccaaactcctcatccagaggaataatcagcggccctcgaggggtccctgaccgattctctggctccaagtctggcacctcagccctcctgaccatcagtcgggcctccggtcgacggagtgaggcgtcgacgtacttacttgtgtctactacgacgggacggacaaaagtaaggtgtagtacgaactacgtgaggtacgggttgggttggttcgggtacgggacgggaaccgaaacgtacggtaccggtaccgtacggtacgacgaccgaacggcgtccgtccccgtcccggtccgtaccttccgttccgttccccgtcccctccctcccgttccgtcccttcctacctcgacggccgggtccgtcggcgaacggccgctacgtagcncnnnnnnnnnnnn

SEQ ID NO: 24799 - DNA, 304 bp, Homo sapiens
  misc_feature: GYAE6OF02FR1XL.21.22.B11.1.454.CMB.1.raw
  modified_base (299)..(304): a, c, t, g, unknown or other
  misc_feature (299)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccgccctcctcctcgtctctactgagcgggctggcaaggcgcatagnnnnnn

SEQ ID NO: 24800 - DNA, 547 bp, Homo sapiens
  misc_feature: GYAE6OF02INT37.21.22.B11.1.454.CMB.1.raw
  modified_base (214)..(214): a, c, t, g, unknown or other
  misc_feature (214)..(214): n is a, c, g, or t
  modified_base (398)..(398): a, c, t, g, unknown or other
  misc_feature (398)..(398): n is a, c, g, or t
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (453)..(453): a, c, t, g, unknown or other
  misc_feature (453)..(453): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccacccctcagccgtctgggaccccccgggnaggagggtcaccatctcttgttctggaggcaactccaacatcggaagtaattatgtattctggtatcagcaactcccaggaatcggacccccaaactcctcactccagagaatatcagcgccctgacgggtccctgaccgtattctctggctcaagtctcggcacctcacgccctccctgaccntcaggtcggctccggtaccgaggntggagctagactattacngtncatcgacggnacaagagtggaatgaactagtcgtaggcggtcgggttgggtcgttcggggacggacgggaccctaaacgtcggtaacccggtccgtaggtaccg

SEQ ID NO: 24801 - DNA, 305 bp, Homo sapiens
  misc_feature: GYAE6OF02H8SS1.21.22.B11.1.454.CMB.1.raw
  modified_base (295)..(295): a, c, t, g, unknown or other
  misc_feature (295)..(295): n is a, c, g, or t
  modified_base (301)..(305): a, c, t, g, unknown or other
  misc_feature (301)..(305): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctcgttcccgccctcctcctcgtctctactgagcgggctggcaaggcncatagnnnnn

SEQ ID NO: 24802 - DNA, 304 bp, Homo sapiens
  misc_feature: GYAE6OF02F2XEN.21.22.B11.1.454.CMB.1.raw
  modified_base (299)..(304): a, c, t, g, unknown or other
  misc_feature (299)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccgcctcctcctcgtctctactgagcgggctggcaaggcgcatagnnnnnn

SEQ ID NO: 24803 - DNA, 550 bp, Homo sapiens
  misc_feature: GYAE6OF02FI870.21.22.B11.1.454.CMB.1.raw
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
tcagtcgtcgctcgcacgaccggtgctcgatttagacgacagctcagggggggggaagctcagcttcagctgtggtagagaagacaggactcaggacaatctccagcatggtcggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaataattatgtattctggtatcagcaactcccaggaatcggcccccaaactcctcatccagagaataatcagcgccctcgacggggtccctgaccgtattcctcgtggcctccaagtcctggccacctcacgccctccctgaccatccgaggtcgggcctcccgggtccgaggatggacggctgacctattactgtgcatcgacgggacncaacngtaggatagactatcgtggaacggtcggttgggtcgttacgggcggtacgggaccaaacggtgacccgttcgtaggtaccg

SEQ ID NO: 24804 - DNA, 500 bp, Homo sapiens
  misc_feature: GYAE6OF02FR5QL.21.22.B11.1.454.CMB.1.raw
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (489)..(493): a, c, t, g, unknown or other
  misc_feature (489)..(493): n is a, c, g, or t
  modified_base (495)..(500): a, c, t, g, unknown or other
  misc_feature (495)..(500): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcactcagcctccctgacccatcagtgggctccggtccgaggatgaggctgactattactgtgcatcacgggacgcaacntggggatggacaatcnggagcgggttgggtgttcgggcggagggaccaaacgtcgaccgtctaggtcagcccaaggctcgccccgtcggtcactctcgttcccaccctcctcctcgtctctactgagcggctggcgagcgcatagnnnnncnnnnnn

SEQ ID NO: 24805 - DNA, 524 bp, Homo sapiens
  misc_feature: GYAE6OF02GTRXL.21.22.B11.1.454.CMB.1.raw
  modified_base (208)..(208): a, c, t, g, unknown or other
  misc_feature (208)..(208): n is a, c, g, or t
  modified_base (329)..(329): a, c, t, g, unknown or other
  misc_feature (329)..(329): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctctgttctggagcaactccaacatcggaagtaattatgtattctggtatcagcaactcccaggaatcggacccccaaactcctcatccagagaataatcagcgcctnacggggtccctgaccgattctctggctcaagtctggcactcacgcctcctgaccatcagtggctccggtcgaggatgagctgactattacngtcgcagtcgacgggacacaacngtgggatgactagtctaggacggtcggttggggtgtttccgggaggtacgggaccaaacgtggacccgttccgtaggtccg

SEQ ID NO: 24806 - DNA, 781 bp, Homo sapiens
  misc_feature: GYAE6OF02IHB1O.21.22.B11.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagaggtcaccatctcttgttctggagcaactccaanatcggaagtaattatgtattctggtatcagcaactcccaggaactcggcccccaaatcctacatccagagaataatcagcgcctcgacggggtccctgaccgtattcctcgtcggcctaccgtaaacggttccttacggggcctaaccccgttcccgaaccggtccccctttaccccgttacggaacccctaagttcccgaaggggttccgggggcccttccccgggggttacccggaaaggggtacgttacggggaacgggtcccgttaagggtaacccttttaacgttttaaccgtgggttaccggactaaacggttcccggaaaccggggggtaaccaccgaaaaccgtagggttacgggggtaacttacgggaaacccttaaagttcccggttaaggggtaacgggttcccggggggttttagggggttaccgggttttacccgggggaacccgggggtaacggggtaaacccccttaaaaccggttccggggtaaccccggttttaccccggttaaggggtaacccccgg

SEQ ID NO: 24807 - DNA, 647 bp, Homo sapiens
  misc_feature: GYAE6OF02ILDRI.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgtctggagcaactccaacatcggaagtaattatgtattctggtatcagcaactccaggaatcggacccccaaatcctcactccgagagaatactcacgccgcctgacgggtccagacctattctcgtcgctaccgtaagtcgtcggacctacctcgacgtccctcccgtacgaaccctacgtacgtacgggtcgggtccgttcccgggtacggagtacgtggaacgtcgtacgtaacttactttacgtgtacgactacgttccggaaccgggacgtaaccgaaacgtaggtaggggtaactacggaaacctacgttcggtagggtacggggtttccgggttaggggttccggttacggggaaccgggtacgggtaaaccctaacggtacccgggaacccggtttaccggacggtacccg

SEQ ID NO: 24808 - DNA, 491 bp, Homo sapiens
  misc_feature: GYAE6OF02IHZJP.21.22.B11.1.454.CMB.1.raw
  modified_base (269)..(269): a, c, t, g, unknown or other
  misc_feature (269)..(269): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
  modified_base (454)..(454): a, c, t, g, unknown or other
  misc_feature (454)..(454): n is a, c, g, or t
  modified_base (479)..(482): a, c, t, g, unknown or other
  misc_feature (479)..(482): n is a, c, g, or t
  modified_base (484)..(491): a, c, t, g, unknown or other
  misc_feature (484)..(491): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctnagcctccctgaccatcagtggctccggtccaggatgaggctgactattactgtgcatcacgggacncaacntgggatgacaatcngagtcggttgggtcgttcgggcggaggaccaaacgtgaccgtctaggcacgccaaggctcgcccctggtcactctgtcccaccctctcctcgtctctacncgagcggctcggcgagcgcagtagnnnncnnnnnnnn

SEQ ID NO: 24809 - DNA, 302 bp, Homo sapiens
  misc_feature: GYAE6OF02IAATY.21.22.B11.1.454.CMB.1.raw
  modified_base (292)..(292): a, c, t, g, unknown or other
  misc_feature (292)..(292): n is a, c, g, or t
  modified_base (298)..(302): a, c, t, g, unknown or other
  misc_feature (298)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccacctcctcctcgtctctactgagcgggctggcaaggcncatagnnnnn

SEQ ID NO: 24810 - DNA, 300 bp, Homo sapiens
  misc_feature: GYAE6OF02GIVZ6.21.22.B11.1.454.CMB.1.raw
  modified_base (298)..(300): a, c, t, g, unknown or other
  misc_feature (298)..(300): n is a, c, g, or t
tcagtcgtcgctcgcacgaccggtgctcgatttagacgacagctcaggggtccctgaccgattctctggctccaagtctggcacctcagcctccctgaccatcagtgggcttcggtccgaggatgaggctgactattactgtgcatcacgggacgcaacatgggatgacaatctgagcggttgggtgttcggcggagggaccaaactgaccgtcctaggtcagcccaaggctcgcccctggtcattctgttcccaccctcctcctcgtctctactgagcggctggcaaggcgcatagnnn

SEQ ID NO: 24811 - DNA, 644 bp, Homo sapiens
  misc_feature: GYAE6OF02HDSKM.21.22.B11.1.454.CMB.1.raw
  modified_base (209)..(209): a, c, t, g, unknown or other
  misc_feature (209)..(209): n is a, c, g, or t
  modified_base (233)..(233): a, c, t, g, unknown or other
  misc_feature (233)..(233): n is a, c, g, or t
  modified_base (334)..(334): a, c, t, g, unknown or other
  misc_feature (334)..(334): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnaggagggtcaccatctcttgttcnggagcaactccaacatcggaagtaattatgtattctggtatcagcaactccaaggaatcggacccccaaatcctcatccagaggaataatcagccgccctnacggggtcccagacctattctcgtggcctaccgaagttctcggcctaaccctcgacgtcccctcccgtcgaaccctagtccgacgggttcgggccctccggggtccgagggtactggacggtctaggaaccttagttacgtgtcgactacgtacggaccgggtacncctaaacgnggttacgggattacgaaccttaagtccggttaggacgggttacccggggtttgggggttacgtttacccgggggaccgggtaacggggtaacccctaaagggttccggtaaccccggttccgtaacgggtacccg

SEQ ID NO: 24812 - DNA, 720 bp, Homo sapiens
  misc_feature: GYAE6OF02HFR9S.21.22.B11.1.454.CMB.1.raw
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
tcagtcgtcgctcgcacgaccggtgctcgatttagacgacagctcagggggggggaaggcgtcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggcaggagggtcaccatctcttgttcnggaggcaactccaanatcggaagtaattatgtattctggtatcagcaactccccaaggaatcggacccccaaatcctcatccagacggaataatcagccgtcctcgacggggtccctgaaccgattcgtactcggcctaccaagttccgtggtaccaccctcgaaccgtccccgttcccctacgaaccctactacgtaacgggttcgggccgttcccggggtccggaacgggtacgtcgggaacgggtctaggtaccttaatttaccgtggttcgtacctaacgtaccggtaaccggggaacccgtaacgaaaccgtaacgggttacgggaaagtaccggtaacgttaaacgttccggttagggaaacgggtttccggggggtttcggggttacggggttttcccggggaacggggttaacgggggaaaccccgtaaacggttaccggggtaaccccggtttacccgggaacggttaacccgg

SEQ ID NO: 24813 - DNA, 515 bp, Homo sapiens
  misc_feature: GYAE6OF02JF0F5.21.22.B11.1.454.CMB.1.raw
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaaatcctcatccagaggaataatcagccggccctcaggggtccctgaccgattctctggctccaagtctggcacctcagcctcctgaccatcaggtggctccggtcgagatgagctgactattactgtgcatcgacgggacncaacngtggatgacatctgaggtcggttgggtgttcgggcggtagggacccaaacgtggaccctcgtaggtcc

SEQ ID NO: 24814 - DNA, 581 bp, Homo sapiens
  misc_feature: GYAE6OF02GX6XD.21.22.B11.1.454.CMB.1.raw
  modified_base (385)..(385): a, c, t, g, unknown or other
  misc_feature (385)..(385): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccgaggaactcggacccccaaactcctcactccaaggaggaaataatcagccggccctcgacggggtccctgaccgtattctctggctccaagtctggccnccctcacgtccctccctgaccatcaggtcgggcctccggtcgagatggacgctagactattacgtgtgcatccgaacgggcacaactgtgggaatcgaactacgtcgtaggacggttcgggtttggggtcggttccgggaggggtaacgggtaacccgtaaaccggttcgggaaccccggttccgtagggtacccg

SEQ ID NO: 24815 - DNA, 596 bp, Homo sapiens
  misc_feature: GYAE6OF02H8G41.21.22.B11.1.454.CMB.1.raw
  modified_base (212)..(212): a, c, t, g, unknown or other
  misc_feature (212)..(212): n is a, c, g, or t
  modified_base (493)..(493): a, c, t, g, unknown or other
  misc_feature (493)..(493): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactcccaggaactccggaccccaaactcctcatccagagaataatcacggccggcctcgacggggtccctgaccgtattctcgtggctaccgaagtctggcctacctcacgtccctcctcgaccagtcgaggtcgggcctccgggtccgaggtcgtggacgtctgtaacttagttactgtacgactacgtacgacgggacacaaacgtagngggaatcgaactagttcgtaggtcgggtcgggtttgggtcggttaccgggacgggtaacgggtaacccaaaccggttcggaacccggttccggtaggtacccg

SEQ ID NO: 24816 - DNA, 548 bp, Homo sapiens
  misc_feature: GYAE6OF02GFQPG.21.22.B11.1.454.CMB.1.raw
  modified_base (359)..(359): a, c, t, g, unknown or other
  misc_feature (359)..(359): n is a, c, g, or t
  modified_base (423)..(423): a, c, t, g, unknown or other
  misc_feature (423)..(423): n is a, c, g, or t
  modified_base (444)..(444): a, c, t, g, unknown or other
  misc_feature (444)..(444): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggcagagggtcaccatctcttgttctggaggcaactccaacatcggaagtaattatgtattctggtatcagcaactcccaggaatcggcccccaaatcctacactccagaggaataatcagccgccctcgacggggtccctgaccgattcnctggctccaagtctggcacctcacgccctccctgaccatccaggtcgggctcccgggtcgaggntggagctgactattactgtcncatcgacgggacncaaacgngtgggatgactagtcgtaggacggtcggtttgggtggttcgggacgggtacggacccaaacgtcggaccgttccgtaggtaccg

SEQ ID NO: 24817 - DNA, 507 bp, Homo sapiens
  misc_feature: GYAE6OF02G9W0Z.21.22.B11.1.454.CMB.1.raw
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
  modified_base (498)..(507): a, c, t, g, unknown or other
  misc_feature (498)..(507): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaactcctcatccagaggaataatcagcggccctcgaggggtccctgaccgattctctggctccaagtctggcacctcagcctccctgaccatcaggtcgggctccgggtccgaggatggaggctggacttattactgtgcatcgacgggacacaacagtgggatgacaatctgagtcggttgggtgttcgggcggaggaccaagtcggaccgtcgtaggtcacgacccgaaggcctccgccccgtcggtccacctctcgtcccaccctcctcctcgtctctactgcgcggcncgcaggcnagtgnnnnnnnnnn

SEQ ID NO: 24818 - DNA, 315 bp, Homo sapiens
  misc_feature: GYAE6OF02HD7E2.21.22.B11.1.454.CMB.1.raw
  modified_base (303)..(315): a, c, t, g, unknown or other
  misc_feature (303)..(315): n is a, c, g, or t
tcagtcgtcgctcgcacgaccggtgctcgatttagacgacagctcaggggtccctgaccgattctctggctccaagttcgtggcacctcagcctcccctgaccatcagtgggctccggtccgaggatgaggctgactattactgtgcatcacgggacgcaacatgggatgacaatctgagcggttgggtgttcggcggagggaccaaactgaccgtctaggtcagcccaaggctgccccctggtcactctcgttcccgccctcctcctcgtctctactgacgcgggctggcaaggcgcatagnnnnnnnnnnnnn

SEQ ID NO: 24819 - DNA, 677 bp, Homo sapiens
  misc_feature: GYAE6OF02JWKXC.21.22.B11.1.454.CMB.1.raw
  modified_base (214)..(214): a, c, t, g, unknown or other
  misc_feature (214)..(214): n is a, c, g, or t
  modified_base (265)..(265): a, c, t, g, unknown or other
  misc_feature (265)..(265): n is a, c, g, or t
  modified_base (575)..(575): a, c, t, g, unknown or other
  misc_feature (575)..(575): n is a, c, g, or t
tcagtcgtcgctcgcacgaccggtgctcgatttagacgacagctcagggggggaaggcggtcagcttcagctgtggtagagaagacaggactcaggacaatctccagcatggccggcttccctctccctctccaccctcctcactcactgcgcagggtcctgggcccagtctgtgctgactcagccaccctcagcgtctcggggacccccgggnagaggtccaccctatcctctttggttctgggacggcaaacctccaaaacgntccggaagtaattactgtacttctggtatcagacaacgtcccaggtaatcggaccccctaaactccgtcatccagacggtaataaactcacgtcggcctaccgacggggtccctagaccgtatcctacgtttcggacttcccgtaaagtccctgggtcctaacccgtccgtaacgtccccgtcccgtcgaacccctactaccagggttcggacccgttccgggttacccgtacggacgttcgaggtccgtacgccgttaatttccgtagtcgccgtaagtccgacgggaaccgccgtaagacgtggtaangtaccaagttccgttgaccgggtaggtttcggggacgggttttccggacggggtaacggttaccggaaaaccgttggtacccggtaccggtttacggaccgg

SEQ ID NO: 24820 - DNA, 560 bp, Homo sapiens
  misc_feature: GYAE6OF02I6H1N.21.22.B11.1.454.CMB.1.raw
  modified_base (210)..(210): a, c, t, g, unknown or other
  misc_feature (210)..(210): n is a, c, g, or t
  modified_base (402)..(402): a, c, t, g, unknown or other
  misc_feature (402)..(402): n is a, c, g, or t
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaagtaattatgtattctggtatcagcaactcccaggaatcggacccccaaactcctcatccagaaggaataatcagccggccctcgacggggtccctgaccgtattcctctcggctaccaagtctggccacctcacgcctccctgaccntcgaggtcgggcctccggtccgaggatgacggctgacttattactgtagcatccgacgggacncaaacngtggatagaacagtctggacggtcgggtttagggtcgttaccgggacgggaacgggaaccctaaacgtcggacccgttcgtaggtaccg

SEQ ID NO: 24821 - DNA, 602 bp, Homo sapiens
  misc_feature: GYAE6OF02HLOWJ.21.22.B11.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctgggacccccggnagagggtcaccatctcttgttctggagcaactccaacatcggaagtaattatgtattctggtatcagcaactcccaggaatggacccccaaactcctcatccagaggaataatcagcgccctcaggggtccctgaccgattctctgctcaagtctggcacctcacgtcctccctgaccatccgaaggtcgggctccgggtccgaggtactggacggtctaggaccttagttacctggtgacctactaccgaacggggtaccactaaaccgagttagggaacttacggaacctaacgtttccgtaagggagggtcccgggtttagggggttacgtttccggggacgggtaacggggtaacccaaacggttccgggaacccgttcccgtaggtacccg

SEQ ID NO: 24822 - DNA, 525 bp, Homo sapiens
  misc_feature: GYAE6OF02JIMF5.21.22.B11.1.454.CMB.1.raw
  modified_base (206)..(206): a, c, t, g, unknown or other
  misc_feature (206)..(206): n is a, c, g, or t
  modified_base (474)..(474): a, c, t, g, unknown or other
  misc_feature (474)..(474): n is a, c, g, or t
  modified_base (494)..(494): a, c, t, g, unknown or other
  misc_feature (494)..(494): n is a, c, g, or t
tcagtcgtcgctcgcacgaccggtgctcgatttagacgacagctcaggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggaggcaactccaacatcggaagtaattatgtattctggtatcagcaactcccaggaatcggcccccaaatcctcatccagagaataatcagcggcctcgacggggtccctgaccgattctctggctccaagtctggccacctcacgtccctccctgacccatccgaggtcgggcctccgggtccgaggatggaggctgacttattacgtgtgctatcgacgggacacaacgagtggatgacatcnggacgcggttggtgttcggnggacggacaaacgtggaccgtcgtaggtacg

SEQ ID NO: 24823 - DNA, 542 bp, Homo sapiens
  misc_feature: GYAE6OF02F8QFL.21.22.B11.1.454.CMB.1.raw
  modified_base (417)..(417): a, c, t, g, unknown or other
  misc_feature (417)..(417): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcacggggtccctgaccgattctctggctccaagtctggccacctcacgccctccctgaccatcaggtgggcctccggtcgaggntgaggctgacttattactgtgcagtccgacgggacncaacgngtgggatgacagtctaggacggtcgggtttgggtgttcgggacggtaacgggaccctaaacgtcggacccgttcgtaggtccg

SEQ ID NO: 24824 - DNA, 561 bp, Homo sapiens
  misc_feature: GYAE6OF02GTQYI.21.22.B11.1.454.CMB.1.raw
  modified_base (209)..(209): a, c, t, g, unknown or other
  misc_feature (209)..(209): n is a, c, g, or t
  modified_base (460)..(460): a, c, t, g, unknown or other
  misc_feature (460)..(460): n is a, c, g, or t
  modified_base (518)..(518): a, c, t, g, unknown or other
  misc_feature (518)..(518): n is a, c, g, or t
tcagtcgtcgctcgcacgaccggtgctcgatttagacgacagctcagggggggaaggctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaacatcggaagtaattatgtattctggtatcagcaactcccaggaatcggacccccaaatcctcatccagaggaataatcagccggccctgacggggtcccctagacccgtattcctcgtggctccaaagtctggacctacctcacgtccctcccgtagaacctatccgaggtgggccctaccgggtccgaaggactggacggtctgactatttacnggtgcagttccgacgggacacaatagtggatgaactatcgtgaaggtcggtttgggtntacgggcggaacggtaccaaagtcggtaccgtactaggtaccg

SEQ ID NO: 24825 - DNA, 569 bp, Homo sapiens
  misc_feature: GYAE6OF02IYKT0.21.22.B11.1.454.CMB.1.raw
  modified_base (328)..(328): a, c, t, g, unknown or other
  misc_feature (328)..(328): n is a, c, g, or t
  modified_base (557)..(557): a, c, t, g, unknown or other
  misc_feature (557)..(557): n is a, c, g, or t
  modified_base (559)..(562): a, c, t, g, unknown or other
  misc_feature (559)..(562): n is a, c, g, or t
  modified_base (564)..(569): a, c, t, g, unknown or other
  misc_feature (564)..(569): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgaggggtccctgaccgattctctggctccaagtctggcacctcagccctcctgacccatcagtgggcctccgggtccgaggatggaggctgactattacngtgctatcgaacggggcacaacgagtggggatcggaacaatcgtaggacggtcggggtttggggtgttccgggacgggtagggaaccaaacgtcggacccggtccgtaggtcacgcccgaaggcctccgcccccgttcggtccacgttccgtccgttccccgcccttcccgttcctccgttcctccgtaccgtcggtcgccgggctcggaccgacgggccgctagtgcngnnnncnnnnnn

SEQ ID NO: 24826 - DNA, 679 bp, Homo sapiens
  misc_feature: GYAE6OF02HBIVX.21.22.B11.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggaggcaactccaanatcggaagtaattatgtattctggtatcagcaactcccaggaatcggacccccaatcctcatccagagaatatcagccgcctcgacgggtccctgaccgtattcctcgtggctaccgtaagtcctggaccacccgtcgaccgtccctaccccgtacgaaccctagtccgacgggttcgggtacccgttccccggggtaccgagggtactacgggtaacggtccttacggaaccgtttaacgtttaacgttcggacgtaccctacgttaccggacccgggggtaaccaccgtaaaaccgtgggttacggggaacttacggaaaccgtacgtttcgtaacggggtaacggttccggggttttgggggtaccggtttaccgggcgggtaaacgggtacccctaaacggtccggtaacccgggttctacggtacccgg

SEQ ID NO: 24827 - DNA, 859 bp, Homo sapiens
  misc_feature: GYAE6OF02G574T.21.22.B11.1.454.CMB.1.raw
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcgacgggtcctcgggcccagtctgtgctgacctcacgccacctcagcgtcgtccggggacccccggnaggagggtccaccatctcttgttcgngggacgaccaacctccaaactagtacggaaagttaattatgttattcgtaggtatacacgacaacctcccgaaggtaacgtacccggaaccccctaaactccctactactaccgaaggtaacgtaaactaacgtcgaaccggcccggtacccctacgggtaaccgggggttccctacggaaacccgttcttccgtcgtcgggtacccttacccgtaaaggttcccttacgggacccttaccgtaccgtaccgttacccccttcccgtaaccgacccgtaacgttaccggtaacggggtccggggtacccgttaccccggggtaaccgggaggttaaccgtaggggaccgggttccttaagggtaacccgtttaaagttttacccggtggtaaccgtaaccgtaacgggttaacccggaaaccgggggtacctaaaccgtaaacggtcggggttaggtaaaaccttacggaaacccgttactttacggtacgggggttaacccggggtttggggttttaacgggggggtccgtaaccgggggtaccgggggtaaacccggtaaacccgtaacggttacccggggtaacccctttaccggggtaaggtaacccccgg

SEQ ID NO: 24828 - DNA, 304 bp, Homo sapiens; identical to SEQ ID NO: 24799
  misc_feature: GYAE6OF02F4BS9.21.22.B11.1.454.CMB.1.raw
  modified_base (299)..(304): a, c, t, g, unknown or other
  misc_feature (299)..(304): n is a, c, g, or t

SEQ ID NO: 24829 - DNA, 500 bp, Homo sapiens
  misc_feature: GYAE6OF02FZYZY.21.22.B11.1.454.CMB.1.raw
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (448)..(448): a, c, t, g, unknown or other
  misc_feature (448)..(448): n is a, c, g, or t
  modified_base (483)..(483): a, c, t, g, unknown or other
  misc_feature (483)..(483): n is a, c, g, or t
  modified_base (489)..(500): a, c, t, g, unknown or other
  misc_feature (489)..(500): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcagggggtccctgaccgattctctggctccaagtctggcactcagcctccctgaccatcagtgggctccggtccgaggntgaggctgactatactgtgcatcacgggacncaacntgggatgacaatctgagtcgggttgggtgttcgggcgggagggaccaaacgtcgaccgtcctaggtcagcccgaaggctcgccccgtcgtccactcctcgttcccnccctcctcctcgtctctactgagcggctgcaggcncagtgnnnnnnnnnnnn

SEQ ID NO: 24830 - DNA, 434 bp, Homo sapiens
  misc_feature: GYAE6OF02F1D4P.21.22.B11.1.454.CMB.1.raw
  modified_base (386)..(386): a, c, t, g, unknown or other
  misc_feature (386)..(386): n is a, c, g, or t
  modified_base (415)..(434): a, c, t, g, unknown or other
  misc_feature (415)..(434): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcgacgggacacaacagtggatcgaactaatcgtaggacggttcggggtttggggttcggttccggggacggggaacgggaaaccctaaaacgtccggtaaccccggttaccgttacgggtaccgaccgaccccggaaaggtccgtccccgccccccggttccgggtacctaccgttccgttcccgttccccccgtccccttccccttccgtccgtcttacctacgtggacggcccgggtntcgggacgaacggccgacctaagtaggcnnnnnnnnnnnnnnnnnnnn

SEQ ID NO: 24831 - DNA, 305 bp, Homo sapiens
  misc_feature: GYAE6OF02G5KZ7.21.22.B11.1.454.CMB.1.raw
  modified_base (299)..(305): a, c, t, g, unknown or other
  misc_feature (299)..(305): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccgccctcctcctcgtctctactgagcggctggcaaggcgcatagnnnnnnn

SEQ ID NO: 24832 - DNA, 514 bp, Homo sapiens
  misc_feature: GYAE6OF02I5L0S.21.22.B11.1.454.CMB.1.raw
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (499)..(499): a, c, t, g, unknown or other
  misc_feature (499)..(499): n is a, c, g, or t
  modified_base (502)..(503): a, c, t, g, unknown or other
  misc_feature (502)..(503): n is a, c, g, or t
  modified_base (506)..(507): a, c, t, g, unknown or other
  misc_feature (506)..(507): n is a, c, g, or t
  modified_base (509)..(514): a, c, t, g, unknown or other
  misc_feature (509)..(514): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctcctgacccatcagtgggctccggtccgaggatgaggctgactattactgtgcatcgacgggcncaacntgggatgacaatctgagtcggttgggtgtcgggcggagggaccaacgtgaccgtcgtaggtcacgacccgaggcctcgccccgttacggccactcctcgtccccacccttccctcctccgtcctctactcgacgccggctggacacggcgcagtgnagnngcnncnnnnnn

SEQ ID NO: 24833 - DNA, 550 bp, Homo sapiens
  misc_feature: GYAE6OF02GV6VR.21.22.B11.1.454.CMB.1.raw
  modified_base (209)..(209): a, c, t, g, unknown or other
  misc_feature (209)..(209): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggacccccaaactcctcatccagaggaataatcagcggccctcgacggggtccctgaccgattctctggctaccaagtctggccacctcacgccctccctgacccatcaggtcgggctccgggtccgaggatggacggctgactagttactgtgcatccgacgggacncaacngtgggatgaactagtcgtggaggtcgggtttgggtgttccgggcgggtaacggacctaaacgtcggacccgttccgtaggtaccg

SEQ ID NO: 24834 - DNA, 624 bp, Homo sapiens
  misc_feature: GYAE6OF02GFGUA.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggcaggagggtcaccatctcttgttctggagcaactcaacatcggaatattatgtattctggtatcagcaacctcccaaggaactcggacccccaaactcctacactccaagaggaataactcacgccggccctcgacggggtcctgaccgtattctcgtggctcgaagtctcgccaccgtcacgtccctcctacgacctagtcgaggtcgggcctacccgggtcggaggacgtggacggtctacgtacttacttacgtgtacgactacgtccggaacgggaccgacgaacgtaggtaggaatcgtaactaagttcgtacgggtacgggttcggggtttacggggtcggttaccggggaacgggtaacggaacccgttaaacggtccgggtaacccggttaccggtaggtacccgg

SEQ ID NO: 24835 - DNA, 302 bp, Homo sapiens
  misc_feature: GYAE6OF02FNM3R.21.22.B11.1.454.CMB.1.raw
  modified_base (299)..(302): a, c, t, g, unknown or other
  misc_feature (299)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccgcctcctcctcgtctctactgagcgggctggcaaggcgcatagnnnn

SEQ ID NO: 24836 - DNA, 647 bp, Homo sapiens
  misc_feature: GYAE6OF02ILZBR.21.22.B11.1.454.CMB.1.raw
  modified_base (211)..(211): a, c, t, g, unknown or other
  misc_feature (211)..(211): n is a, c, g, or t
  modified_base (348)..(348): a, c, t, g, unknown or other
  misc_feature (348)..(348): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtccaccatctcttgttctggagcaactccaacatcggaagtaattatgtattctggtatcagcaactcccaaggaatcggacccccaaatcctcactccagagaataatcagcggcctcgacggggtcccngaccgtattcctctcggcctaccaagtccgtcggacctaccctccgacgtcccctcccgtacgacccaatccgagggttcgggccgtcccgggtaccggaagggtactgggacggtccttaggaacctttacgttacctggtgacctacgtccgtaaccggggacctacgaaaccgtaggtggggaaacttagggaacctaagtccgtagggaacgggttcgggtttggggtcgtttaccggggacgggtacgggtaaaccctaaacggtccggaacccggtttaccgtagggtacccg

SEQ ID NO: 24837 - DNA, 509 bp, Homo sapiens
  misc_feature: GYAE6OF02GOZGM.21.22.B11.1.454.CMB.1.raw
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
  modified_base (493)..(493): a, c, t, g, unknown or other
  misc_feature (493)..(493): n is a, c, g, or t
  modified_base (495)..(497): a, c, t, g, unknown or other
  misc_feature (495)..(497): n is a, c, g, or t
  modified_base (499)..(500): a, c, t, g, unknown or other
  misc_feature (499)..(500): n is a, c, g, or t
  modified_base (503)..(505): a, c, t, g, unknown or other
  misc_feature (503)..(505): n is a, c, g, or t
  modified_base (508)..(509): a, c, t, g, unknown or other
  misc_feature (508)..(509): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgacggggtcccctgaccgattcctctggctccaagtctggcacctcagccctcctgaccatcagtggctccggtccgaggntggaggctgactattactgtncatcgacgggacncaacagtgggatgaacaatctgagtcggttgggtcgttcgggcggagggaccaaacgtgaccgtctaggcagcccaaggcncgccctggtcactctcgtcccncctcctcctcgtctctactcgacgcggcgtgccgaggcgacagtagntnnncnncgnnncgnn

SEQ ID NO: 24838 - DNA, 602 bp, Homo sapiens
  misc_feature: GYAE6OF02I6R57.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatcggacccccaaactcctcactccagagaaataatcagccggccctcgacggggtccctgaccgtattctctggctcaagtctggccacctcacgccctcccgtagaccctatccgaggtcgggcctcccgggtaccgaggtatggaggtcctagtaccttagttaccgtgttcgactacgtccgaaccggggacaccgtaactagtgggaatcgaactattcgtaggacggttcgggtttggggtcggttaccgggacgggtaacgggaccctaaaccggtcggtaaccccggttcgtacgggtacccg

SEQ ID NO: 24839 - DNA, 703 bp, Homo sapiens
  misc_feature: GYAE6OF02HB3ZD.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtattatgtattctggtatcagcaactcccaaggaactcggacccccaaactcctcatccagagaataatcagcggaccctgacggggtcctagaccgtattcgtctggtcctacctaagtccgtcggacctaccctccgacgtcccctaccctacggaaccctacgttcccgaagggttcccggggaccttccccggggtaccgggaagggtacgttacgggtaccgggtccttacggtaacctttacgttttaaacccgtgggttcgtaacctaccgttaccggaaacccgggggtacctaaccgaacgtaggtggggaaactacggtaaacctacgttcggtagggtaacgggttcgggggtttgggttacgggttccggggaaccggggtaacggtaacccgtaaacgttccgggaacccggtttacccgtagggtaccccgg

SEQ ID NO: 24840 - DNA, 597 bp, Homo sapiens
  misc_feature: GYAE6OF02GOLLS.21.22.B11.1.454.CMB.1.raw
  modified_base (210)..(210): a, c, t, g, unknown or other
  misc_feature (210)..(210): n is a, c, g, or t
  modified_base (490)..(490): a, c, t, g, unknown or other
  misc_feature (490)..(490): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactcccaaggaatcggaccccccaaatccctcactccagaaggaataatcagccggccctgacggggtccctgaccattctctggcctaccaagtcctggcctaccctcacgccctcccacgaccatccgaggtcgggcctccgggtccgaggatggaggtcctagtaacttatttacctgtcgacagtccgaacggggacaccgaaagngtgggaatacgaactagtcgtaggacggtcggggttttggggtcggttacgggacgggtaacgggaaccctaaacgttccggaaccccggttaccgtagggtacccg

SEQ ID NO: 24841 - DNA, 561 bp, Homo sapiens
  misc_feature: GYAE6OF02G09TF.21.22.B11.1.454.CMB.1.raw
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaacatcggaagtaattatgtattctggtatcagcaactcccaggaatcggcccccaaatcctcatccagaggaataatcagccggccctcgacggggtccctgaccgtattcctctggctccgaagtctggccacctcacgccctcctgaccatcaggtcggctccggtcgaggntggaggctagacttattactgtncagtccgacgggactcaactgtcgggatagactagtcgtaggtacggtcggggtttcgggtggttccgggacgggaacgggtaaccctaaacgtcggaaccccggttcgtaaggtcccg

SEQ ID NO: 24842 - DNA, 553 bp, Homo sapiens
  misc_feature: GYAE6OF02F0AWQ.21.22.B11.1.454.CMB.1.raw
  modified_base (390)..(390): a, c, t, g, unknown or other
  misc_feature (390)..(390): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgtctggagcaactccaacatcggaagtaattatgtattctggtatcagcaactcccaggaatcggaccccccaaactcctcatccagaggaataatcagccggccctcgacggggtccctgaccgattctctggctccaagtctggcacctcagccctcccngacccatcaggtcggcctccggccgaggatggaggctgactattacgtgtgcagtccgacggggacncaacgngtgggatgaacagtcgtaggacggtcgggttagggtcgttacgggacgggtacgggaaccctaaacgtcggacccgttaccgagggtacc

SEQ ID NO: 24843 - DNA, 508 bp, Homo sapiens
  misc_feature: GYAE6OF02HJEGU.21.22.B11.1.454.CMB.1.raw
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (496)..(508): a, c, t, g, unknown or other
  misc_feature (496)..(508): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggccctcgaggggtccctgaccgattctctggctccaagtctggcacctcagcctccctgacccatcagtgggcctccgggtccgaggatggaggctgactattactgtgcatcgacgggacncaacngtgggatgacaatcgtgagcggttgggtgttcgggcgggaggaccaacgtcgaccgtctaggtcacgcccgaaggctcgcccctcggtccactcctcgttcccgcccttcctcctccgtctctctgacgcggctggcaggcgcagtgnnnnnnnnnnnnn

SEQ ID NO: 24844 - DNA, 304 bp, Homo sapiens
  misc_feature: GYAE6OF02HXAQC.21.22.B11.1.454.CMB.1.raw
  modified_base (299)..(304): a, c, t, g, unknown or other
  misc_feature (299)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctcgttcccgcctcctcctcgtctctactgagcgggctggcaaggcgcatagnnnnnn

SEQ ID NO: 24845 - DNA, 539 bp, Homo sapiens
  misc_feature: GYAE6OF02I29PD.21.22.B11.1.454.CMB.1.raw
  modified_base (211)..(211): a, c, t, g, unknown or other
  misc_feature (211)..(211): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (366)..(366): a, c, t, g, unknown or other
  misc_feature (366)..(366): n is a, c, g, or t
  modified_base (441)..(441): a, c, t, g, unknown or other
  misc_feature (441)..(441): n is a, c, g, or t
  modified_base (465)..(465): a, c, t, g, unknown or other
  misc_feature (465)..(465): n is a, c, g, or t
  modified_base (487)..(487): a, c, t, g, unknown or other
  misc_feature (487)..(487): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgtctggagcaactcaacatcggaataattangtattcnggtatcagcaactcccaggaactcggaccccaaatccncatccagagaatancagcgccctgacggggtccctagaccgtattctcgtgctccaagtcngccacctcacgcctcctagaccatcgaggtcggctccggtcgaggacttggaggtctagtacttattctggtacncctagtcgacgggacacgaactgnggtactagaactagtcgtaggnggtccggtggtcgtcgggacggacgtacaacgtcggaccgtcgtacggtacg

SEQ ID NO: 24846 - DNA, 379 bp, Homo sapiens
  misc_feature: GYAE6OF02GXHBN.21.22.B11.1.454.CMB.1.raw
  modified_base (345)..(379): a, c, t, g, unknown or other
  misc_feature (345)..(379): n is a, c, g, or t
tcagtcgtcgctcgcacgaccggtgctcgatttagacgacagctctagggggttcccgtgaccgattctctggcgtccaagtctggcaccgtcagcctcccgtcgaccatcagtgggcgtccggttcccgaggatgaggctgacctagttactcgtgcattcgacgggacgcaacatggggactgacaatctcgacgcggttgggtgttcggcggagggaccaaaacgtggacccgtcctagggtccacgcccaaggcttcggccccccgtggtcactcgtcgttccccgcccttcctcctcgtctcttaactggagcgggctgggacaaagggcgacactagcnnnnnnnnnnnnnnnnnnnnnnnnnnnnnnnnnnn

SEQ ID NO: 24847 - DNA, 613 bp, Homo sapiens
  misc_feature: GYAE6OF02HVE3E.21.22.B11.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcgggacccccggnagagggtcaccatctcttgttctggagcaactccaanatcggaagtaattatgtattctggtatcagcaactcccgaggaactcggacccccaaatcctacactccaaggaaggaactaatcaagccggccctacgacggggtcccctgaacccgtattctcgtggcctaccgaagttcctggacctacccgtcacgtccctcccgtgaaccctagtccgaggttcgggcctccgggtaccgaggtactggacggtctaggaacttagttactggtgacctagtaccggaaccggggacaccaaacgtgtgggaattacgaactaagttccgtggaacggtccgggtttgggtcgttccgggacggtaacggaccctaaacgtcggacccgttcgtaggtcccg

SEQ ID NO: 24848 - DNA, 512 bp, Homo sapiens
  misc_feature: GYAE6OF02ITAAJ.21.22.B11.1.454.CMB.1.raw
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (496)..(497): a, c, t, g, unknown or other
  misc_feature (496)..(497): n is a, c, g, or t
  modified_base (499)..(500): a, c, t, g, unknown or other
  misc_feature (499)..(500): n is a, c, g, or t
  modified_base (502)..(502): a, c, t, g, unknown or other
  misc_feature (502)..(502): n is a, c, g, or t
  modified_base (504)..(505): a, c, t, g, unknown or other
  misc_feature (504)..(505): n is a, c, g, or t
  modified_base (507)..(509): a, c, t, g, unknown or other
  misc_feature (507)..(509): n is a, c, g, or t
  modified_base (511)..(512): a, c, t, g, unknown or other
  misc_feature (511)..(512): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgacccgattctctggctccaagtctggccacctcagccctcctgaccatcagtggctccggtcgagatgaggctgactattactgtgcatcgacgggcncaacngtgggatgacatcngagcggttgggngttcgggcggagggaccaacgtcgaccgtcctaggtcagcccgaaggcctcgccccgttcggtccacgttctcgtcccaccctcctcctcgtcctctactcgacgcggctcggcgacggcgacagtgnngnngncnncnnncnn

SEQ ID NO: 24849 - DNA, 304 bp, Homo sapiens; identical to SEQ ID NO: 23976
  misc_feature: GYAE6OF02HJL78.21.22.B11.1.454.CMB.1.raw
  modified_base (300)..(304): a, c, t, g, unknown or other
  misc_feature (300)..(304): n is a, c, g, or t

SEQ ID NO: 24850 - DNA, 549 bp, Homo sapiens
  misc_feature: GYAE6OF02GGNAP.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactcaacatcggaataattatgtattctggtatcagcaactcccaggaatcggacccccaaactcctcatccagagaataatcagcggccctcgacggggtccctagaccgtattcctctaggctacaagtctggcacctcacgtccctcctgaccatcagtcgggctccgggtcgaggatggagctgaaccttattacgtgtcgctagtcgacgggacacaaacagtggaatacgactagtcaggtaggtcgggtttgggtcgttcgggacggaacgggaccaaacggtcgacccggtcgtaggtccg

SEQ ID NO: 24851 - DNA, 558 bp, Homo sapiens
  misc_feature: GYAE6OF02GKG45.21.22.B11.1.454.CMB.1.raw
  modified_base (209)..(209): a, c, t, g, unknown or other
  misc_feature (209)..(209): n is a, c, g, or t
  modified_base (464)..(464): a, c, t, g, unknown or other
  misc_feature (464)..(464): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaacatcggaagtaattatgtattctggtatcagcaactcccaggaatcggcccccaaatcctcatccagaggaataatcagcggccctgacggggtccctgaccattctctggctccaagtcctggccacctcacgccctcccgtagaccctatcgaggtcgggcctcccgggtcgaggatggagctgacttattactgcgcatccgacgggacacaacgngtacgggataggaactagtcgtaggaacggtcgggtttggggtgttccgggcgggacgggaaccctaaacgtcggacccgttccgtagggtacc

SEQ ID NO: 24852 - DNA, 307 bp, Homo sapiens
  misc_feature: GYAE6OF02FMWVS.21.22.B11.1.454.CMB.1.raw
  modified_base (300)..(307): a, c, t, g, unknown or other
  misc_feature (300)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctggtcactctgttccccaccctcctcctcgtctctactgagcgggctggcaagggcgcatagnnnnnnnn

SEQ ID NO: 24853 - DNA, 332 bp, Homo sapiens
  misc_feature: GYAE6OF02JEPAW.21.22.B11.1.454.CMB.1.raw
  modified_base (153)..(153): a, c, t, g, unknown or other
  misc_feature (153)..(153): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (314)..(315): a, c, t, g, unknown or other
  misc_feature (314)..(315): n is a, c, g, or t
  modified_base (317)..(317): a, c, t, g, unknown or other
  misc_feature (317)..(317): n is a, c, g, or t
  modified_base (319)..(332): a, c, t, g, unknown or other
  misc_feature (319)..(332): n is a, c, g, or t
tcagtcgtcgctcgcacgaccggtgctcgatttagacgacagctcagggtcccgtgaccgattctctggctccaagtctggcacctcagcctcctgaccatcagtggctccggtccgaggactgagctgactattactgtgcatcacgggacncaacatgggatgacaatctgagcggttggtgttcggcggagggaccaaactgaccgtcctaggtcagcccaaggctcgccccctggtccactcgtgttccccacctcctccttccgctacctactcgacgtcgggctgggaccaagggcactanacgncgnntnannnnnnnnnnnnnn

SEQ ID NO: 24854 - DNA, 557 bp, Homo sapiens
  misc_feature: GYAE6OF02GU3KC.21.22.B11.1.454.CMB.1.raw
  modified_base (211)..(211): a, c, t, g, unknown or other
  misc_feature (211)..(211): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (465)..(465): a, c, t, g, unknown or other
  misc_feature (465)..(465): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaataattatgtattctggtatcagcaactcccaggaactcggacccccaaactcctcatccagagaataatcagcggccctgacggggtccctgaccgtattctctggcctcaagtctggccacctcacgccctccctgacccatcaggtcgggcctccgggcgaggatggacggctgactattacngtnctagtcgacgggacacaacgngtggaatgaactattcgtaggacggtgggtttgggtggttccgggacggtaacgggacctaaacggtccggtacccggttccgtaggtaccg

SEQ ID NO: 24855 - DNA, 623 bp, Homo sapiens
  misc_feature: GYAE6OF02JM196.21.22.B11.1.454.CMB.1.raw
  modified_base (473)..(473): a, c, t, g, unknown or other
  misc_feature (473)..(473): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcaggtcctgggcccagtctgtgctgactcagccaccctcagcgtcgtcgggacccccgggcagagggtcaccatctcttgttctgggaggccaactccaacatacggaagtaattatgtattctggtatcagcaactcccaggtaatcggaccccaactcctcataccagaagaataatcgagccgccctcgacggggtccacgaccgtattctcgtcggactcgaacgtcgtcggacacctcgacgccctccgtacgaccactccgagtccgggtacctcccgggtacggaggtactggacggtctacgtacttagttacgngttcgactactcgtaaccgggccagtaaccgtggtacgggaactaggtaacccattacggtacggacgggttacggttcgggggtacggttacggggaccggaaccgggtaccgtaaacggttccggaaccggttaccgttacgggaccg

SEQ ID NO: 24856 - DNA, 896 bp, Homo sapiens
  misc_feature: GYAE6OF02JX492.21.22.B11.1.454.CMB.1.raw
  modified_base (149)..(149): a, c, t, g, unknown or other
  misc_feature (149)..(149): n is a, c, g, or t
  modified_base (213)..(213): a, c, t, g, unknown or other
  misc_feature (213)..(213): n is a, c, g, or t
  modified_base (576)..(576): a, c, t, g, unknown or other
  misc_feature (576)..(576): n is a, c, g, or t
  modified_base (671)..(671): a, c, t, g, unknown or other
  misc_feature (671)..(671): n is a, c, g, or t
tcagtcgtcgctcgcacgaccggtgctcgatttagacgacagctcaggggggaaggcgtcagcttcagctgtggtagagaagacaggactcaggacaatctccagcatgccggcttcctctcctcctcaccctcctcacctcactcgcncaggtcctgggcccagtcctgcgtctacgactcagccaccctcacgcgtctcgggacccccggnacgacgggtcaccgactcctcgttcgttctggacggtccgaaacttccaaacctacgtccggaaagttaacttacgttagtaactttcgtaggttacttcaagtaccgaaacgttcccccaagggaacttaccgggaccccccctaaaaaccgtttcccctacgtaaccttaccccgtaagggaaccggttaaaacttaaacgtacctaacgggtaccccgggtaaccccttccgtaaaccggggggtcccctttaccgggaaacccgttacctttccggttacttccggggaccttacccgtaaacggtccgtttcggaccctaccgttacccgaacggttccctaccccgtgtaaaccccnctttaacccggagtccggggttacctacccgggtcccggaaaggtcttacgggacgtcccgtcggttaaaccttagttactaacggggttcctanaaacccggtttccgaacccggggggtaacccagttaaaaaccgtccgggttaaacgggaccgggtttaacaaaccgttaaccggttcttacccgggggaaggtttaccgggggtttaaggggttttcccggttaaccgggggaggtaaaccccgggggaaccctttttaaaaacgggccccgttttaaaacccggggttaacccccgttttggtaaaccccgggg

SEQ ID NO: 24857 - DNA, 494 bp, Homo sapiens
  misc_feature: GYAE6OF02HR28X.21.22.B11.1.454.CMB.1.raw
  modified_base (268)..(268): a, c, t, g, unknown or other
  misc_feature (268)..(268): n is a, c, g, or t
  modified_base (319)..(319): a, c, t, g, unknown or other
  misc_feature (319)..(319): n is a, c, g, or t
  modified_base (437)..(437): a, c, t, g, unknown or other
  misc_feature (437)..(437): n is a, c, g, or t
  modified_base (480)..(482): a, c, t, g, unknown or other
  misc_feature (480)..(482): n is a, c, g, or t
  modified_base (484)..(485): a, c, t, g, unknown or other
  misc_feature (484)..(485): n is a, c, g, or t
  modified_base (487)..(488): a, c, t, g, unknown or other
  misc_feature (487)..(488): n is a, c, g, or t
  modified_base (490)..(494): a, c, t, g, unknown or other
  misc_feature (490)..(494): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaatcctcatccagaggaataatcagcggccctcaggggtccctgaccgattctctggctccaagtctggcacctnagcctcctgaccatcagtggctccggtccgaggatgaggctgactattacngtgcatcgacgggacgcaacatgggatgaacaatctgagtcgggttgggtgttcgggcgagggaccaacgtgaccgtcaggtcagcccaaggctcgcccctggtcactctcgttcccncctcctcctcgtctctactgacgcggctggcaggcgcagtcgnnncnncnncnnnnn

SEQ ID NO: 24858 - DNA, 694 bp, Homo sapiens
  misc_feature: GYAE6OF02H6ZGQ.21.22.B11.1.454.CMB.1.raw
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaagtaattatgtattctggtatcagcaactcccaaggaactcggacccccaaactccncatccagagaataancagccgcctacgacgggtccctgaccgtattcctcgtacggcctaccgtaaagtcctacggccacccttccacggtccccttcccgtacgaacccctaagttccgaacgggttcgggggcccttcccggggtaccggaagggtactgggtaacggtccgttaggtaacctttacgttaccgttggttacggaccaacgttcccgaaccgggggaacgtaccaaaccgtagtcggggaattacgggaactaagttccgtaagggtacggtccgggggttttaggggtaccgggtttacccgggaacgggggtaacgggtaaaccctaaaaccggttcccgggaacccggttcccggttaagggtaccccg

SEQ ID NO: 24859 - DNA, 730 bp, Homo sapiens
  misc_feature: GYAE6OF02GGVCO.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcgagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaataattatgtattctggtatcagctaactccaggaatcggacccccaaactcctacactaccaagaggaactaatcagcggccctacgacggggtccctagaccgtattcctacgtcggccttaccgaaagttccgtacggacctaacccgttcgaacgtcccctttccccgtacgtaacccctagtccgtaagggttcggggtcccgtttaccccggggtacccgtaaagggtacgttaccgggacgggaccttacggtaacctttaacgtttaaccgttcggttgtaccgtacgttcccgtaaccgggggaccgtaccgaaaaccgtaggttaccggggaatttacggaacctaaacgtttccgtaacgggtaacgggttaccggggttttagggggtcggtttccggggaacggggttaacggggtaacccctaaaggttccggtaaaccccggttccggttaacgggtacccg

SEQ ID NO: 24860 - DNA, 592 bp, Homo sapiens
  misc_feature: GYAE6OF02FN2W3.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctgacggggtccctgaccgtattctctggctccaagtcctggccacctcacgccctcctgacccatccaggtcgggcctcccgggtacgacggagtcgacggcttacgacttattactgtgcatccgaacgggtaccgctaaacgagtcgggtatacggactaacgtctagggacgggtcgggtttcggggtcggtttaccgggaccggggtaacgggaaccctaaacggtccggtacccggttaccggtacggtacccg

SEQ ID NO: 24861 - DNA, 597 bp, Homo sapiens
  misc_feature: GYAE6OF02I1CY4.21.22.B11.1.454.CMB.1.raw
  modified_base (212)..(212): a, c, t, g, unknown or other
  misc_feature (212)..(212): n is a, c, g, or t
  modified_base (448)..(448): a, c, t, g, unknown or other
  misc_feature (448)..(448): n is a, c, g, or t
  modified_base (495)..(495): a, c, t, g, unknown or other
  misc_feature (495)..(495): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnaggagggtcaccatctcttgttctggaggcaactccaacatcggaagtaattatgtattctggtatcagcaactcccaggaatcggacccccctaaatccctcatcccagaggaaataatcagccggccctcgacgggggtccctggacccgtattcctcgtggcctaccaaggttctggccaccctcacgcccttcccctgaccctatccaggtcgggccttcccggtccgaggntggagctgacctattactgtgctactccgacgggaccgacaaaccgngtggggatacggactaactcgtagggtaggtcggggtttaggggtggttaccgggacgggtacggggaaccctaacgtcggaccccggttcgtagggtaccc

SEQ ID NO: 24862 - DNA, 603 bp, Homo sapiens
  misc_feature: GYAE6OF02JU62M.21.22.B11.1.454.CMB.1.raw
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (376)..(376): a, c, t, g, unknown or other
  misc_feature (376)..(376): n is a, c, g, or t
  modified_base (494)..(494): a, c, t, g, unknown or other
  misc_feature (494)..(494): n is a, c, g, or t
  modified_base (528)..(528): a, c, t, g, unknown or other
  misc_feature (528)..(528): n is a, c, g, or t
  modified_base (590)..(590): a, c, t, g, unknown or other
  misc_feature (590)..(590): n is a, c, g, or t
  modified_base (592)..(595): a, c, t, g, unknown or other
  misc_feature (592)..(595): n is a, c, g, or t
  modified_base (597)..(603): a, c, t, g, unknown or other
  misc_feature (597)..(603): n is a, c, g, or t
tcagtcgtcgctcgcacgaccggtgctcgatttagacgacagctcagggtccgtgggcccgacggtcctgtgcgtgactcagccaccctcacgcgtctcgggaccccgggcgacggacgggtcgaccgactctcttgttcttcggaggcgaactccaacactcggaagtaattatgtattctaggtattcagtcaactcccaggaatcggccccaaactcctcactcacgaggaactaatcagcggtccctcgacggggtccctgacccgtattccncgtggccttccgaatcgtggcncctacngtcctcccgtcgacacttcacgtcggcctcccgggtcggacggtatgacgggctaggacctaagtttccgngttcggatagtacaccgggggatccaaacgattgggacgttaggactaaagcctgaggtcgggtagggttcggtcgggcgggacgggtacgaaactgggaaccgttccgtaacgggtnacgggacccaaggcccgtacgccccgtaccggtnaaccgtctcgtccctaccgccttcgacctctcctgcgtgcggctggacgagtcgcgatcggncnnnncnnnnnnn

SEQ ID NO: 24863 - DNA, 499 bp, Homo sapiens
  misc_feature: GYAE6OF02G8JI1.21.22.B11.1.454.CMB.1.raw
  modified_base (338)..(338): a, c, t, g, unknown or other
  misc_feature (338)..(338): n is a, c, g, or t
  modified_base (487)..(499): a, c, t, g, unknown or other
  misc_feature (487)..(499): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctaatccagaggaataatcagcggccctcaggggtccctgaccgattctctggctccaagtctggcacctcagccctccctgaccatcagtgggctccggtccgaggatgaggctgactatactgtgcatcacgggacncaacatggggatgaacaatctgagcggttgggtgttcgggcggagggaccaaacgtgaccgtcgtaggtcagccaaggcctcgcccctcggtcactctcgttcccgccctcctcctcgtcctctactgacgcggctggcagcgcatagnnnnnnnnnnnnn

SEQ ID NO: 24864 - DNA, 660 bp, Homo sapiens
  misc_feature: GYAE6OF02G7L8L.21.22.B11.1.454.CMB.1.raw
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
  modified_base (517)..(517): a, c, t, g, unknown or other
  misc_feature (517)..(517): n is a, c, g, or t
tcagtcgtcgctcgcacgaccggtgctcgatttagacgacagctcaggggggggaaggcgtcagcttcagctgtggtagagaagacaggactcaggacaatctccagcatggccggcttccctctcctcctcaccctcctcactcactgcgcagggtcctgggcccagtctgtgctgactcagcccaccctcacgcgtcgtcgggaccccccgggnaggacgggtcaccatctctgttcnggagcaactccaanagtcggaaagttaatatntattctgtatnancaactcccgaagaactcggacccccaaactcctacatccaagacgaaatatacagccgccncggacggggtcccaggacctnttcctcgtcggctaccgaagtccctggcctaccctcgaccgtccctccctgaccctatccgaggtccgggccttccgggacccgagggactaggaggctagtaacttagtccgtagttcgactacgtcgacggggtaaccacgtaaacgngttacgggaatacggtaaccgtaactcggttacggaacgggttcggggtttacggggttcggtttcccggggggaaggggtaacccggtaaaccggtaaaccgttaccccgggttaccggttacccggtttaacggaacccgg

SEQ ID NO: 24865 - DNA, 563 bp, Homo sapiens
  misc_feature: GYAE6OF02H0I6Q.21.22.B11.1.454.CMB.1.raw
  modified_base (211)..(211): a, c, t, g, unknown or other
  misc_feature (211)..(211): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
  modified_base (487)..(487): a, c, t, g, unknown or other
  misc_feature (487)..(487): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgttctggaggcaactccaacatcggaagtaattatgtattctggtatcagcaactcccaggaatcggacccccaaatcctcatccagaggaataatcagcggccctgacggggtccctgaccgtattctctggcctccaagtctggcacctcacgccctcctgaccctatcaggtcgggcctccgggtccgaggatggacggtctgacttattacgtgtgctagtcgacggggacncaacngtaggatgaacattcgnggacggtcgggtttgggtcggttcgggacgggtacgggaaccctaaacgtcggtaacccgttccgtacgggtaccg

SEQ ID NO: 24866 - DNA, 506 bp, Homo sapiens
  misc_feature: GYAE6OF02GGLMG.21.22.B11.1.454.CMB.1.raw
  modified_base (306)..(306): a, c, t, g, unknown or other
  misc_feature (306)..(306): n is a, c, g, or t
  modified_base (439)..(439): a, c, t, g, unknown or other
  misc_feature (439)..(439): n is a, c, g, or t
  modified_base (494)..(506): a, c, t, g, unknown or other
  misc_feature (494)..(506): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgaggggtccctgaccgattctctggctccaagtctggcacctcagcctccctgaccatcagtggctccggtccgaggntgaggctgactattactgtgcatcacgggacgcaacagtgggatgacaatctgagtcggttgggtgttcgggcgggagggaccaaacgtgaccgtccgtaggtcacgcccgaaggcctcgccccgtcggtccnctctcgtcccgccctcctcctcgtctctactgcgcggctcggcacggcgcagtgnnnnnnnnnnnnn

SEQ ID NO: 24867 - DNA, 689 bp, Homo sapiens
  misc_feature: GYAE6OF02IN0EI.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnagagggtcaccatcttcttgttctggaggcaactccaacatacggaagtaattatgtattctggtactcagacaactcccgaaggaacgtccggacccccaaactccctacactacccgaaggaggaaactaactcgacggtccggtcccgtacgacgggggtccctaggacccgtacttcctcgtcggtcctaccgtaacgtcgtcggacctacccgtcaccgtcccttcccgtacgaaccctacgtcgacgggttccggtcctacccggggtaccgaagggtacgtaggacggtccttacggtaaccttacgtttaccgtggtacacgtacgtccggaaccggggactacaacgtaggtaggaacttcgaaactacgttcgtacgggacgggttccgggtttgggtacggttaccggggaacggtaacgggtaaccgtaaaccggtcggtaaccccggttacgtacggtaaccgg

SEQ ID NO: 24868 - DNA, 526 bp, Homo sapiens
  misc_feature: GYAE6OF02G03SM.21.22.B11.1.454.CMB.1.raw
  modified_base (210)..(210): a, c, t, g, unknown or other
  misc_feature (210)..(210): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
  modified_base (494)..(494): a, c, t, g, unknown or other
  misc_feature (494)..(494): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggacccccaaatcctcatccagaggaataatcagcggccctgacggggtccctgaccgattctctggctccaagtctggcacctcagccctccctgaccatcaggtcgggctccgggtccgaggntggaggctgactattacngtncatcgacgggcacaacgngtggatgactatcgtgaggtcggttgggtgttcgggnggacgggaccaagtcggacccgtcgtaggacc

SEQ ID NO: 24869 - DNA, 308 bp, Homo sapiens
  misc_feature: GYAE6OF02GQKBE.21.22.B11.1.454.CMB.1.raw
  modified_base (292)..(292): a, c, t, g, unknown or other
  misc_feature (292)..(292): n is a, c, g, or t
  modified_base (297)..(308): a, c, t, g, unknown or other
  misc_feature (297)..(308): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgtcggcggagggaccaaactgaccgtctaggtcagcccaaggctgccccctggtcactctcgttccccgcctcctcctcgtctctactgacgcgggctggcaggcncatgnnnnnnnnnnnn

SEQ ID NO: 24870 - DNA, 605 bp, Homo sapiens
  misc_feature: GYAE6OF02FWMBR.21.22.B11.1.454.CMB.1.raw
  modified_base (176)..(176): a, c, t, g, unknown or other
  misc_feature (176)..(176): n is a, c, g, or t
  modified_base (378)..(379): a, c, t, g, unknown or other
  misc_feature (378)..(379): n is a, c, g, or t
  modified_base (381)..(381): a, c, t, g, unknown or other
  misc_feature (381)..(381): n is a, c, g, or t
  modified_base (386)..(387): a, c, t, g, unknown or other
  misc_feature (386)..(387): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
tcagtcgtcgctcgcacgaccggtgctcgatttagacgacagctcagggggtccctagaaccgattctcctcggctccaagtcctggcacctcaacgccctccctgaccgatcgacgtgggctccggtccgaggttatggacggctgactacttactggtgccatccacggggacncactagtgggactggactaaggtctggaggtcgggttagggtagttccggcgggacggtaccaaacgttggaaccggtttcctagggtccaacggccctaaggcgtacgccccctcggttcaacgttacgtcgttccccaccttcctcctcgttcgtctacgtcggacggcccgggactagggctaagggcgacgagtaggnngncacgnngnancganactaaatcagnacgtcgaggctagctactacgtagaggtacactgcgcgagatactatagtgcgngngacgacacncgagacgtacgacgacgacgacgactacgtattagttacgtcgtacgtacgtacgtacgtgtagtacgtacgttacgtactactactactactacgtcgtacgtacgtacgtacgtacgtacgtcgtctactcg

SEQ ID NO: 24871 - DNA, 525 bp, Homo sapiens
  misc_feature: GYAE6OF02HMOH1.21.22.B11.1.454.CMB.1.raw
  modified_base (208)..(208): a, c, t, g, unknown or other
  misc_feature (208)..(208): n is a, c, g, or t
  modified_base (328)..(328): a, c, t, g, unknown or other
  misc_feature (328)..(328): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaacatcggaagtaattatgtattctggtatcagcaactcccaggaatggcccccaaatcctcatccagagaataatcagcgccctnaggggtccctgaccgattctctggctcaagtctggcacctcacgcctcctcgaccatcaggtcggctcccgggtccgaggatggaggctgacttattacgngtncgatccgaacgggcacaacgagtcggaatcgaacagtctaggagtcgggttgggtcgttcggaggacgggaccaaacgtcggaccgtctaggc

SEQ ID NO: 24872 - DNA, 595 bp, Homo sapiens
  misc_feature: GYAE6OF02JPPST.21.22.B11.1.454.CMB.1.raw
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
  modified_base (355)..(355): a, c, t, g, unknown or other
  misc_feature (355)..(355): n is a, c, g, or t
  modified_base (573)..(573): a, c, t, g, unknown or other
  misc_feature (573)..(573): n is a, c, g, or t
  modified_base (579)..(579): a, c, t, g, unknown or other
  misc_feature (579)..(579): n is a, c, g, or t
  modified_base (583)..(583): a, c, t, g, unknown or other
  misc_feature (583)..(583): n is a, c, g, or t
  modified_base (592)..(592): a, c, t, g, unknown or other
  misc_feature (592)..(592): n is a, c, g, or t
  modified_base (594)..(595): a, c, t, g, unknown or other
  misc_feature (594)..(595): n is a, c, g, or t
tcagtcgtcgctcgcacgaccggtgctcgatttagacgacagctcagggtcctgggcccagtctgtgctgactcagccaccctcacgcgtctgggacccccgggccgacggacggggtcaccgatcctcttgttctggaggcaactccaacatcggaagtaattatgtattctggtatcagcaactcccaggaatggcccccaaatcctcactccagacggaataatcaagcgccctcaggggtccctgaccgattcnctggctccaagtctggcaccgtcagcctccctgaccntccaggtcggctccggtccgaggtactggaggctgactattactgtgcatcgacgggacncaacagtgggatggaactaatcgtagacggtcgggttagggtcgttcgggacgggtacggacgaacgtacggtaccgtaccgtacggtccgaggccccgaaggccgtccggccccgtcgggtacctaccgtccgtccgttccctacccgtccgtcccgtacgccgtaccgacctcggtacgccgggtcgtcggcgaaccggcgaccgtacgacggacngtacgngacncgcgcgcgncnn

SEQ ID NO: 24873 - DNA, 536 bp, Homo sapiens
  misc_feature: GYAE6OF02G182R.21.22.B11.1.454.CMB.1.raw
  modified_base (311)..(311): a, c, t, g, unknown or other
  misc_feature (311)..(311): n is a, c, g, or t
  modified_base (523)..(523): a, c, t, g, unknown or other
  misc_feature (523)..(523): n is a, c, g, or t
  modified_base (525)..(533): a, c, t, g, unknown or other
  misc_feature (525)..(533): n is a, c, g, or t
  modified_base (535)..(536): a, c, t, g, unknown or other
  misc_feature (535)..(536): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagccggccctcgaggggtccctgaccgattctctggctccaagtctggcacctcacgcctccctgacccatcaggtcggctccggtccgaggntgaggctgactattactgtgcatcgacgggactacaacgtagtgggatggaacaatcgtgagtcgggttgggtgtcgggcggacgggaccaacgtcgaccgtcgtaggtcagcccgaggccgtccgccccgtcggtccacgttccgtccgtcccgtccctccctccgtccgttcctctacgtcgacgtcggctcggacgacggcgcagtagntnnnnnnnnncnn

SEQ ID NO: 24874 - DNA, 304 bp, Homo sapiens; identical to SEQ ID NO: 24698
  misc_feature: GYAE6OF02GXYCS.21.22.B11.1.454.CMB.1.raw
  modified_base (300)..(304): a, c, t, g, unknown or other
  misc_feature (300)..(304): n is a, c, g, or t

SEQ ID NO: 24875 - DNA, 560 bp, Homo sapiens
  misc_feature: GYAE6OF02GVAAY.21.22.B11.1.454.CMB.1.raw
  modified_base (467)..(467): a, c, t, g, unknown or other
  misc_feature (467)..(467): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaactcggacccccaaatcctcatccagaggaataatcagccggccctgacggggtccctgaccgtattctctggcctcaagtctggccacctcacgccctccagacccatcaggtcgggcctccgggtcgaggatggacggtctagactattactgtgcatcgacgggacacaacgngtggatgaactatcgtaggacggtcgggtttggggtcggttaccgggacgggaacgggacccaaacggttcggaacccgttccgtaaggtccc

SEQ ID NO: 24876 - DNA, 602 bp, Homo sapiens
  misc_feature: GYAE6OF02HBLP9.21.22.B11.1.454.CMB.1.raw
  modified_base (210)..(210): a, c, t, g, unknown or other
  misc_feature (210)..(210): n is a, c, g, or t
  modified_base (400)..(400): a, c, t, g, unknown or other
  misc_feature (400)..(400): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaactcccaaggaactcggacccccaaactcctacactccagagaataatcagccgccctgacggggtccctgacctattcctctggcctacaagtcctcggccaccctcacgtcccttcccngaccctatccgagggttcgggccttcccgggtaccgaggactgggacgccttagaaccttattacgtggtcgactacgtccgaacgggaccacaactggtggaactcgaactagttcgtaggacgggttccggggtttgggtacggttccgggacgggtaacgggaaccctaaagttccgggaacccgttcgtacgggtacc

SEQ ID NO: 24877 - DNA, 568 bp, Homo sapiens
  misc_feature: GYAE6OF02HT395.21.22.B11.1.454.CMB.1.raw
  modified_base (212)..(212): a, c, t, g, unknown or other
  misc_feature (212)..(212): n is a, c, g, or t
  modified_base (426)..(426): a, c, t, g, unknown or other
  misc_feature (426)..(426): n is a, c, g, or t
  modified_base (448)..(448): a, c, t, g, unknown or other
  misc_feature (448)..(448): n is a, c, g, or t
  modified_base (466)..(466): a, c, t, g, unknown or other
  misc_feature (466)..(466): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccgggnagagggtcaccatctcttgttctggaggcaactccaaacatcggaattaattatgtattctggtatcagcaactcccaaggaatcggaccccctaaactcctcatccagaggaataatcagccgcctcgaggggtccctgaccgtattctctggctccaagtctggcacctcacgtccctccctagacccatcaggtcggcctccgggccgagntggagtctagacttatctgtcncatcgacgggacacaagngtgggatgaactattcgaggagggtccgggtttaggggtcggttccggggacgggtaacgggaaccctaaacggtcggtaacccgttccggtaggtacccgg

SEQ ID NO: 24878 - DNA, 311 bp, Homo sapiens
  misc_feature: GYAE6OF02F90UG.21.22.B11.1.454.CMB.1.raw
  modified_base (301)..(311): a, c, t, g, unknown or other
  misc_feature (301)..(311): n is a, c, g, or t
tcagtcgtcgctcgcacgaccggtgctcgatttagacgacagctcagggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactggaccgtcctaggtcagcccaaggctgccccctggtcactctgttccccacctcctcctcgtctctactgagcgggctggcaaggcgcatagnnnnnnnnnnn

SEQ ID NO: 24879 - DNA, 493 bp, Homo sapiens
  misc_feature: GYAE6OF02FXWYB.21.22.B11.1.454.CMB.1.raw
  modified_base (332)..(332): a, c, t, g, unknown or other
  misc_feature (332)..(332): n is a, c, g, or t
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
  modified_base (457)..(457): a, c, t, g, unknown or other
  misc_feature (457)..(457): n is a, c, g, or t
  modified_base (478)..(478): a, c, t, g, unknown or other
  misc_feature (478)..(478): n is a, c, g, or t
  modified_base (480)..(481): a, c, t, g, unknown or other
  misc_feature (480)..(481): n is a, c, g, or t
  modified_base (483)..(486): a, c, t, g, unknown or other
  misc_feature (483)..(486): n is a, c, g, or t
  modified_base (488)..(493): a, c, t, g, unknown or other
  misc_feature (488)..(493): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccagtctggcacctcagcctcctgaccatcagtggctccggtccgaggatgagctgactatactgtgcatcacgggacncaacatgggatgacaatcngagtcggttgggtgttcgggnggaggaccaaacgtcgaccgtcctaggtcacgccaaggctcgcccctggtccactctcgttcccgcctcctccgacgcgacgacngacgcggctgcgaggcgcagngnngnnnncnnnnnn

SEQ ID NO: 24880 - DNA, 560 bp, Homo sapiens
  misc_feature: GYAE6OF02GNI98.21.22.B11.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctgggacccccggnagagggtcaccatctcttgttctggaggcaactccaacatcggaagtaattatgtattctggtatcagcaactcccaggaactcggacccccaaactcctcatccagagaataatcagcggccctgacggggtccctggacccgattcctctggcctccaagtcgtggaccacctcacgccctccctgaccatcgacggtcgggcctcccgggtccgaggactggacggtcctggaacttagttactgtgcatccgacgggcacaacgagtggaatgactatcgtaggcggttcggttgggtgttccgggacggtacgggaccctaaagtcggacccggttcctaggtacccg

SEQ ID NO: 24881 - DNA, 680 bp, Homo sapiens
  misc_feature: GYAE6OF02F8ND8.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactcccaggaatcggacccccaatcctcatccagaggaataatcacgccgccctgacggggtccctagaccgtattcctctggcctaccgaagtcctggaccaccctacgacgtcccctccgtacgacccatccgaaggtcgggcccttcccgggtaccggaaggacgttggacgggtccttaggtaaccttacgtttaaccgtggtacgacctaacgttcccgaaccggggggtaccaaccgtaaaccgtaggttcggggaaacttacgggaaaccttaagttccgtacggggtaaggttccgggggttttagggttcgggtttaccggggaccggggaacggggtaacccctaaaaccggttcgggtaacccccgttaccgggtaacggtaccccgg

SEQ ID NO: 24882 - DNA, 569 bp, Homo sapiens
  misc_feature: GYAE6OF02GYJ06.21.22.B11.1.454.CMB.1.raw
  modified_base (435)..(435): a, c, t, g, unknown or other
  misc_feature (435)..(435): n is a, c, g, or t
  modified_base (485)..(485): a, c, t, g, unknown or other
  misc_feature (485)..(485): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccgggcagagggtcaccatctcttgttctggaggcaactccaaacatcggaagtaattatgtattctggtatcagcaactcccaggaatcggacccccaaactcctcactccagaaggaataatcaggccgccctcgacggggtccctgaccgtattcctctcggctccgaagtcctcggcaccctcacgccctccctgacccatcgaggtcgggctcccgggcgaggntggagtctagacttagttactgtcgactactccgaacgggacacaaacgngtgggaatgaacatcgtaggcggtgggtttggggtcgttcgggacggaacggacctaaacgtcggaacccggttcgaggtaccg

SEQ ID NO: 24883 - DNA, 585 bp, Homo sapiens
  misc_feature: GYAE6OF02GT8E0.21.22.B11.1.454.CMB.1.raw
  modified_base (451)..(451): a, c, t, g, unknown or other
  misc_feature (451)..(451): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcatccagagaataatcagcggccctgacggggtccctgaccgtattctcgtcggctccaagtcctggccacccgtcacgccctccctgacccatccaggtcgggcctccgggtcgaggatggaggcttaggacttattactgtcncgtactccggaacggggacacgaaccgtagtgggaatcggaactacgtcgtagggacggttcggggtttggggtcggttaccgggcgggtaacgggaccctaaacggtcggtaacccggttcgtacgggtaccg

SEQ ID NO: 24884 - DNA, 568 bp, Homo sapiens
  misc_feature: GYAE6OF02JH9HO.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaaactcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactccaggaatcggcccccaactcctcatccagagaataatcagcggccctcgacgggtccctagaccgattctctcggctaccaagtctggccacctcacgccctccctcgacccatcgaggtcgggcctcccgggtacgaggtatgacggctcgactattacgtgtacgcagtcgacgggacacaacgagtgggatgaactagtcgtaggaggttcgggttgggtcggttcgggacggtagggaaccctaaccggtaggacccgtaccggtaggtcccgtaaccgg

SEQ ID NO: 24885 - DNA, 670 bp, Homo sapiens
  misc_feature: GYAE6OF02JNRWL.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccgggnagagggtcaccatctcttgttctggaggcaactccaacatcggaagtaattatgtattctggtatcagcaactcccgaaggtaatcggacccccaaactcctcactccagagaataactcagccgcctgacggggtccctggacctattcctcgtggcctacaagttctcggacaccgtcaccgtccctccctgaaccctatccgaggtcgggccttacccgggtccgaagggacttacgggaacggtccttagggtaaacctttagttaaccgtcggttacggacccagttaaccccgacggggggtaacccaccgtaaaccgttaaggtcggggtaaactcgtaaaccgtacttcgtaacgggacgggttcgggtttacgggggttcgttaccgggggccggaacggggtaaccccttaaaggttccgggaaaccccggtttcccggtaagggaccccg

SEQ ID NO: 24886 - DNA, 600 bp, Homo sapiens
  misc_feature: GYAE6OF02JWQOM.21.22.B11.1.454.CMB.1.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
tcagtcgtcgctcgcacgaccggtgctcgatttagacgacagctcagggggggaagcgtcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccggnagagggtcaccatctcttgttctggagcaactccaacntcggaataattngtattctggtatnagcaactccagatcggccccaaatccnatccagagtaatatcgacgccggtaccctcgacggggtcccctaggacccgtattccgtacgtcggacccttacaacgttccgtggacccaccttcgacgtcccctccgtacgaccatccgaggtcggccgttcccggtacgaggtacgtgaacggtctaggacttaagtccgtgcgccgtatcccgacggggacctacgaaactggtaggtaactagaaccagttcgtaggtacgggttcgggtttaggttcggtcgggacggtacggacctaacggtcggtacccgtgtacggtaccg

SEQ ID NO: 24887 - DNA, 501 bp, Homo sapiens
  misc_feature: GYAE6OF02GKAXV.21.22.B11.1.454.CMB.1.raw
  modified_base (246)..(246): a, c, t, g, unknown or other
  misc_feature (246)..(246): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (488)..(490): a, c, t, g, unknown or other
  misc_feature (488)..(490): n is a, c, g, or t
  modified_base (492)..(501): a, c, t, g, unknown or other
  misc_feature (492)..(501): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaatcctcatccagaggaataatcagcggccctcaggggtccctgaccgattcnctggctccaagtctggcacctcagcctccctgaccatcagtggctccggtcgagatggaggctgactattactgtgcatcacgggacncaacntgggatgacaatctgagcggttgggtgttcgggcgggtagggaccaaacgtcgaccgtcgtaggtcacgcccgaaggcctcgcccctgtccactctcgttcccacctcctcctcgtcctctactgacgcggctcggcaggcgcagtagnnngnnnnnnnnnn

SEQ ID NO: 24888 - DNA, 303 bp, Homo sapiens; identical to SEQ ID NO: 24754
  misc_feature: GYAE6OF02FLKG0.21.22.B11.1.454.CMB.1.raw
  modified_base (300)..(303): a, c, t, g, unknown or other
  misc_feature (300)..(303): n is a, c, g, or t

SEQ ID NO: 24889 - DNA, 639 bp, Homo sapiens
  misc_feature: GYAE6OF02F67IQ.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggacccccaaactcctcactccagagaataatcagccgcctcgacggggtccctagaccgtattcctcgtggcctaccgaagtccgtggcctaccctcacgtcccctcccgtagacccagtccgaacgggttcgggcccttcccggggtaccgagggtacttcgggaacggtccttaggtaacctttagtttaccgtggttacgcctaacgtccggaaccgggggaccacgtaaacgtagtggggaactacggaactaagttccgtaggaacgggttcgggtttggggtccgttacgggacgggtaacgggaaccctaaacggtcggacccgttacgtaggtacccg

SEQ ID NO: 24890 - DNA, 690 bp, Homo sapiens
  misc_feature: GYAE6OF02H1WXM.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggnaggagggtcaccatctcttgttctggaggccaactccaacatcggaagttaattatgtattctggtatcagcaactccaaggactcggacccccaaactcctacactaccaaggaacggtaaataactccgaacggcccggtccctcggtaacgggggtcccctaggtaacccgtactttcctccgttcggtccttaccgaagttcctcgggacctacctcgaccgtccctcctacggacccattccgacgggttcgggccttcccgggtaccggaggtactcgggacggtctagtaccttaagttcgtgtcgactacggtaccgaaccggggaccacctaaacgtgggtacgggtaatacggaacctaacgttcgttagggaccgggttcggggtttaggggtccggtttaccggggacgggaaccgggtaacccgaaaccggtttccgggaaccctttacccgggtaggtacccgg

SEQ ID NO: 24891 - DNA, 593 bp, Homo sapiens
  misc_feature: GYAE6OF02JUGKZ.21.22.B11.1.454.CMB.1.raw
  modified_base (250)..(250): a, c, t, g, unknown or other
  misc_feature (250)..(250): n is a, c, g, or t
  modified_base (323)..(323): a, c, t, g, unknown or other
  misc_feature (323)..(323): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (481)..(481): a, c, t, g, unknown or other
  misc_feature (481)..(481): n is a, c, g, or t
tcagtcgtcgctcgcacgaccggtgctcgatttagacgacagctcaggggggggaaggcgtcagcttcagctgtggtagagaagacaggactcaggacaatctccagcatggccggcttccctctcctcctcaccctcctcactcactgcgcagggtcctgggcccagtcctgtgctgactcagcccaccctcagcgtctcgggacccccggcagagggtcaccatctcttgttctggagcaactccaantcggaataatatgtattctggtatcagcaactccagaactcgaccccaatcctcatccaagaggtaataactnagccgcctcgacgggtaccctgacctattcnctggctcgagtctggacnctacgcnccncctagacctatctaggtcggaccgtccggtaccgaggtatcggacgtcgtacgacttaacgttctacgcgtacacgtcgaacgggtaccacgtaaacgnggtaggtacgacgtacgtatcggtacggtacggttcgggtttgggacgggtttacgggccgggtaaaccggtaccgtaaccggttacggtacccggttaccggttacgaccg

SEQ ID NO: 24892 - DNA, 550 bp, Homo sapiens
  misc_feature: GYAE6OF02HWA0F.21.22.B11.1.454.CMB.1.raw
  modified_base (208)..(208): a, c, t, g, unknown or other
  misc_feature (208)..(208): n is a, c, g, or t
  modified_base (391)..(391): a, c, t, g, unknown or other
  misc_feature (391)..(391): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctgggacccccggnagagggtcaccatctcttgttctggagcaactccaacatcggaataattatgtattctggtatcagcaactcccaggaatcggacccccaaactcctcactccagaagaataatcagccggcctcgacggggtccctgaccgattctctggctccgaagtctggccaccctcacgtccctccngaccatcaggtcggctccggtccgaggctgacggtctagtacttattacgtgtgctagtcgacgggacncgaaacgngtggatgactagtcgtggaaggtcgggttgggtcgttcgggccgggtaaggaccaaacgttcggaacccgttcgtaggtccg

SEQ ID NO: 24893 - DNA, 681 bp, Homo sapiens
  misc_feature: GYAE6OF02F6IX8.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggtgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgttcgtggacgcaacctccgaacagtacggtaaagttaattagtgttattcgtaggtatacgagacctaacctacccgaaggaacgtccggaacccccaactcctacaactccgaaggaagaaatactacgacgccgtccgtacggtaccgggtccctacggaccgtacttccgtcgtacggtccctaaccgtaacgtcgtcgacccgtaccaccgtaccggtccctcccgtacgaacctaacgtcggtaacgggtccgggtcccggttacccgggaccgaggtacgttcggaacggtcgtacgtaacttacgttacgtcgtacgactacgtaccgaacgggtaccacgaacgtaggtaggactagactagtacggtaggcgggtttcgggttaggttcggtacgggacgggaacggtaacccgtaacgtacggtacccgtacggtaaccgg

SEQ ID NO: 24894 - DNA, 878 bp, Homo sapiens
  misc_feature: GYAE6OF02JV8V2.21.22.B11.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagacgacagctcagggggggaaggcgtcagcttcagctgtggtagagaagacaggactcaggacaatctccagcatggccggcttccctctccctcctcaccctcctcactcactgcgcagggtcctgggcccagtctgtgctgactcagccaccctcacgcgtcctcggggaccccccgggnacggacgggtccaccgattccgtcttgttcctgggaacggtccaaacctccaaacagtaccggtaaagttaacttatagttattcctggtactcagcctaaaccttcccaaggtaacttcgggaccccccctaaaaacgttcccctacaacgttaccccgaaggtaacgggtaaactaaagttccaaaggtcccggtacccctacggaaccgggggttcccctagggaacccgtaacgtttcctacgtcgggtacccttacccgtaaacggttcccgttcgggacccctaccgttaccgaaccgtcccccgtttacccgtaccggaaccctacgtttcccgaacgggtttccggggacccttcccgggggtttacccggaagggttacgtaacgggtacccgggttaccgtacgggtaaaccctttacggtttaaacccttcggggttagacccgtaaccgttaccgggtaaacccgggggtaccgtacccggtaaaaacccttagggtcgggggttaaacgtaccgtaaaccggtagttaaccggtggggtaaacgggtttcccgggggtttttaagggaccgggttttcccggggaacgggtaaccgggggtaaccaaaccggtttcccgggaaacccgtttccccggtagggtaacccg

SEQ ID NO: 24895 - DNA, 594 bp, Homo sapiens
  misc_feature: GYAE6OF02HGBPM.21.22.B11.1.454.CMB.1.raw
  modified_base (210)..(210): a, c, t, g, unknown or other
  misc_feature (210)..(210): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccggnagagggtcaccatctcttgttctggaggcaactccaacatcggaagtaattatgtattctggtatcagcaactcccaaggaactcggacccccaaaactcctacactccagaggaataatcacgccggccctgacggggtccctgacctnttcncgtgcctacaagtctggccacctcacgtccctccctagacctatcgaggtcgggccttccgggtaccgaaggtactggacggtcttacggaaccttatttaccgtgtacgacgacgttcggaaccggggacacaaacgtagtgggatacgaactaagtcgtagggaacggtcgggttggtacggtaccggaagggtaccgaacctaacgttacggacccgttagagtccg

SEQ ID NO: 24896 - DNA, 675 bp, Homo sapiens
  misc_feature: GYAE6OF02H1TNV.21.22.B11.1.454.CMB.1.raw
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (641)..(641): a, c, t, g, unknown or other
  misc_feature (641)..(641): n is a, c, g, or t
  modified_base (655)..(655): a, c, t, g, unknown or other
  misc_feature (655)..(655): n is a, c, g, or t
  modified_base (671)..(671): a, c, t, g, unknown or other
  misc_feature (671)..(671): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaaaatcggaagtaattatgtattctggtatcagcaactcccaggaatggcccccaaactcctcatccagaggaataatcagcggccctcgaggggtccctgaccgattctctggctccaagtctggcacctcagcctcctgaccatccaggtgggccttccggtccgaggatggagctgactattactgtgctatcgacgggacncaacngtgggatgaactaagtctaggagcgggtttggggtcggttcgggacgggtagggaaccctaaacgtcggtaacccggttccgtaacgggtaccacggacccgtaaacgggcccgtccggtacccccccgttcggggttaccctaaccgttccgttcccggtttccccccggccccgtttacccccgttcccgtttcccggttacccgtttaccctttaaccggtccgggtaaccgggtccggggtcccggttacgggacccgtaacggggcctacccggtaagttaaccgggngtcgcgtaccgcgngcgtcgctacgctacncgtc

SEQ ID NO: 24897 - DNA, 808 bp, Homo sapiens
  misc_feature: GYAE6OF02JQWR6.21.22.B11.1.454.CMB.1.raw
  modified_base (161)..(161): a, c, t, g, unknown or other
  misc_feature (161)..(161): n is a, c, g, or t
  modified_base (405)..(405): a, c, t, g, unknown or other
  misc_feature (405)..(405): n is a, c, g, or t
  modified_base (752)..(752): a, c, t, g, unknown or other
  misc_feature (752)..(752): n is a, c, g, or t
tcagtcgtcgctcgcacgaccggtgctcgatttagacgacagctcagggggggaaggcgtcagcttcagctgtggtagagaagacaggactcaggacaatactccagcatggccggcttccctctcctcctcaccctcctcactcactgcgcgtacgggtncggtccgtcgtcgtcgtcgtcgtcgtctacaccgtaccgacccgtccaccgtccgtcggtccgggtaccccgggacccggaccggacggtacggtacccgtacctacttccgttcgttcgttcggtacggacgacctaacctaacctaacgtacgtaacggtaacgttaagttagttacgttacgttacgttacgtacgtacgacgacctaaccgtaccgccgaacgtacgtcgggtaaccctnaacctaccgtacgtaacgtaaccgtaacgtaacggtaacgtaacgaccggttacccggttacccggtaccggggttacccggttccccggtaaccggttaccgttaccgttacgttacggttacccgtaaccggtaccgtaccggttaccggtaccgtacccgtacccgtaccgtacccgaacccgttacccgttaccgtaccgtaccgttaccggtaccggttaccgggtaccggtacggaccggtacggtacggtacgtacgtacgttacgtacgtacgttacgtacgtacgacgacgtacacgtacgtacggacgagtacgacgtacgtacgtacggtggtacnggtcggtacgggtacggtacggtaccggtaacggtacggtaccggtaccgtaacgg

SEQ ID NO: 24898 - DNA, 293 bp, Homo sapiens
  misc_feature: GYAE6OF02G0LJ8.21.22.B11.1.454.CMB.1.raw
  modified_base (286)..(293): a, c, t, g, unknown or other
  misc_feature (286)..(293): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggtggtgtcgaggaggacaaatgacgtctaggtcagccaaggctgcccctggtcactctgttcccacctcctcctcgtctctactgagcggctggacaaggcgcatgnnnnnnnn

SEQ ID NO: 24899 - DNA, 583 bp, Homo sapiens
  misc_feature: GYAE6OF02GMB1K.21.22.B11.1.454.CMB.1.raw
  modified_base (210)..(210): a, c, t, g, unknown or other
  misc_feature (210)..(210): n is a, c, g, or t
  modified_base (482)..(482): a, c, t, g, unknown or other
  misc_feature (482)..(482): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaaggaatcggacccccaaatcctcatccagagaataatcagccggccctcgacggggtccctggaccgtattctcgtggcctaccgaagtctggcctacctcacgtccctcctgaccatcgaggtcgggcctccgggtccgaggctggagtctgaacttattcgtgtgcagttccggaacgggtacaccgaaacgngttcggggaatcggaacctagttccgtagggacggtcgggtttggggtcgttcgggacgggaacgggtaccaaacgtcggtacccgttcggtaggtacccg

SEQ ID NO: 24900 - DNA, 626 bp, Homo sapiens
  misc_feature: GYAE6OF02GFKGL.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagtaattatgtattctggtatcagcaactcccaggaatcggacccccaaactcctcactccagaaggaataatcagccggccctcgacggggtccctagaccgtattcctctcggcctacgaagtcgtcggcctacccgtcacgtccctcccgtacgacccatccgaggttcgggcctcccgggtcgaggactggacggtcttagaacttagttactggtcgcacgtccgaaccgggtacacaaacgtaggtgggaatcggaactagttccgtagggtaacgggttccgggttttgggggtaccggtttccggggaccgggtaacgggaacccgtaaaccgttcgggaaccccggtttccgtaagggtacccg

SEQ ID NO: 24901 - DNA, 625 bp, Homo sapiens
  misc_feature: GYAE6OF02GBDME.21.22.B11.1.454.CMB.1.raw
  modified_base (212)..(212): a, c, t, g, unknown or other
  misc_feature (212)..(212): n is a, c, g, or t
  modified_base (520)..(520): a, c, t, g, unknown or other
  misc_feature (520)..(520): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccgggnagagggtccaccatctcttgttctggaggcaactccaacatcggaagtaattatgtattctggtatcagcaactcccaggaactcggacccccaaatcctcactccagaggaataatcagccggccctcgacggggtccctgaccgtattctctcggctaccgaagtcgtggaccaccctcgaccgtccctcccgtagaccctatccgaggttcgggccttcccggggtaccgagggactcgggaaggtcctaggtaaccttagtttaccgtgttacgcctagttcccggaacggggaccacaaacgngtacgggaatacggaactagtcgtaggtaacggtcggggtttggggtcggttacgggacgggtaacgggaaccctaaacggtcggaacccgttcggaaggtcccg

SEQ ID NO: 24902 - DNA, 670 bp, Homo sapiens
  misc_feature: GYAE6OF02IGGHU.21.22.B11.1.454.CMB.1.raw
  modified_base (191)..(191): a, c, t, g, unknown or other
  misc_feature (191)..(191): n is a, c, g, or t
  modified_base (527)..(527): a, c, t, g, unknown or other
  misc_feature (527)..(527): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctnagcgtcgtcggggaccccccgggcaggagggtccaccatcctcttgttctgggaggcaactccaacagtcggaaataattatggttattcgtggtatacgagactaacctcccaaggaagtccggacccccctaaactcctacactccgaaggagaaataactcgaagcccggcccttcggacggggtccctagaccgtacttccgtcgtcgtctaccgtaacgtctacggcctaccctcgaccgtcccttcccgtagaccctactcggaggttcgggtccgttcccgggtacgaggtacgtggaacgggtctacgtaacttacgttacgtggtcncgacgtcggacgggaccgtacaaacgtaggtgggaatacgaaccagtcgtaggggacggttcggggtttacggggtcgggttccggaacggggaaccggtaaccctaaaggtcccgggtaacccgttccggtagggtaccccg

SEQ ID NO: 24903 - DNA, 610 bp, Homo sapiens
  misc_feature: GYAE6OF02GPT3M.21.22.B11.1.454.CMB.1.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
tcagtcgtcgctcgcacgaccggtgctcgatttagacgacagctcaggggggggaagctcgagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgttctggagcaactccaacntcggaagtaattatgtattctaggtatcagccaactcccaaggaactcggaccccccaaatcctcactccaagacggaataatcagcggccctgacggggtccctgaccgtattctcgtcggctccgaagtctaggccacctcacgtccctaccctagaccatctacggtcggcctccgggtaccgaggtactggacggtcttacggtaaccttagttacgtggtcgactacgtccgaacggggacacaaacgtcgtgggaatcgaactagtcgtagggaacggttcgggtttagggtacggttaccgggacgggaaccggtaaccgtaaacgtcgggtacccgttaccgtaggtaacccg

SEQ ID NO: 24904 - DNA, 585 bp, Homo sapiens
  misc_feature: GYAE6OF02GPDVT.21.22.B11.1.454.CMB.1.raw
  modified_base (209)..(209): a, c, t, g, unknown or other
  misc_feature (209)..(209): n is a, c, g, or t
  modified_base (452)..(452): a, c, t, g, unknown or other
  misc_feature (452)..(452): n is a, c, g, or t
  modified_base (477)..(477): a, c, t, g, unknown or other
  misc_feature (477)..(477): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtattatgtattctggtatcagcaactcccaggaactcggacccccaaactcctcatccagaggaataatcagcggccctcgacggggtccctagaccgtattctctggcctccgaagtcctggccacctcacgtccctccctgacccatcaggtcgggccttcccgggccgagatggacggcctagacttattacgngtgctatccggaacgggcacaaacngtcgggattcggaactagtcgtaggacgggttcgggtttggggtcgtttaccggggacgggtaacgggaaccctaaacgtccgggtaacccgttccggtaggtacccg

SEQ ID NO: 24905 - DNA, 310 bp, Homo sapiens
  misc_feature: GYAE6OF02HJ2BQ.21.22.B11.1.454.CMB.1.raw
  modified_base (301)..(310): a, c, t, g, unknown or other
  misc_feature (301)..(310): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctcgttcccgccctcctcctcgtctctactgagcgggctggcaaggcgcagtagnnnnnnnnnn

SEQ ID NO: 24906 - DNA, 675 bp, Homo sapiens
  misc_feature: GYAE6OF02J0BJW.21.22.B11.1.454.CMB.1.raw
  modified_base (669)..(669): a, c, t, g, unknown or other
  misc_feature (669)..(669): n is a, c, g, or t
  modified_base (671)..(672): a, c, t, g, unknown or other
  misc_feature (671)..(672): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatcggccccaaactcctcatccagaggaataatcagcggccctcgacggggtccctgaccgattctcgtggctccaagtctggcacctcacgcctccctgaccatcagtcggctccggtccgagatgaggctgactattactgtgcacgtcacgggacgacaacgagtagggataggaacctaaagtccgtggaacggtcgggtttaggggtcgtttacggggcgggtacgggaaccgtaaacgtacggacccggtacccgtacgggtacgaaccggacccgaaacgggcccgttccggaccccccggttacggttacccgtaaccggttccgttacccgtttacccccgtaccccgttaccccgtaccggtacccgggtacccgtaccggaccggttaccggaccgggtacccgggtaccggtaccgggaccgtaaccgggaccgtcgtaaacggtccggcgtacgcgtacgtcacggtcacgcncnngcg

SEQ ID NO: 24907 - DNA, 309 bp, Homo sapiens
  misc_feature: GYAE6OF02I00UN.21.22.B11.1.454.CMB.1.raw
  modified_base (283)..(283): a, c, t, g, unknown or other
  misc_feature (283)..(283): n is a, c, g, or t
  modified_base (300)..(309): a, c, t, g, unknown or other
  misc_feature (300)..(309): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctcgttcccaccctcctcctcgtctctactgagcggntcggcaaggcgcatagnnnnnnnnnn

SEQ ID NO: 24908 - DNA, 671 bp, Homo sapiens
  misc_feature: GYAE6OF02I22Q2.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctggggaccccccgggnaggagggtcaccatctcttgttctggaggcaactccaacatcggaagtaattatgtattctggtatcagcaactcccgaggaactcggacccccaaatccacatccagaagaatatcagccggcctcgacggggtccctagaccgtattcctcgtcggtctaccgaagtccgtcggaccctaccgacctacgtcccctacccgttacgaccctattcccggagggttcgggacccttccccggggtaccggaagggtacgtacgggacggtcgttacgtaaccgtttaagttaccgtggtacgaccgtacgttccgggaaccgggaacctacgaaacgtggtacgggaatacgaacctagttcgtagggacgggttcggggtttacggggtggttacccggggaacggtacggggaaaccctaaacggttccggaaccccggttacgtagggtaacccg

SEQ ID NO: 24909 - DNA, 521 bp, Homo sapiens
  misc_feature: GYAE6OF02GSR9Y.21.22.B11.1.454.CMB.1.raw
  modified_base (249)..(249): a, c, t, g, unknown or other
  misc_feature (249)..(249): n is a, c, g, or t
  modified_base (471)..(471): a, c, t, g, unknown or other
  misc_feature (471)..(471): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (506)..(507): a, c, t, g, unknown or other
  misc_feature (506)..(507): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (516)..(521): a, c, t, g, unknown or other
  misc_feature (516)..(521): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcatccagaggaataatcagcggccctgacggggtccctgaccgattcnctggctccaagtctggcacctcagcctcctgaccatcagtggctccggccgaggatgagctgactatactgtgcatcgacgggacgacaaaagtgggatgaacaatctgaggtcggttgggtgtcggcgggaaggaccaacgtcgaccggtcgtaggtcacgcccgaaggcctcgcccctcggtcaccgtcgtcgtcccgccctcctcctcgtcctcctacncgacgcggctcggacaggtccncacgtagntcncnncgngtcncnnnnnn

SEQ ID NO: 24910 - DNA, 491 bp, Homo sapiens
  misc_feature: GYAE6OF02IEFXD.21.22.B11.1.454.CMB.1.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (475)..(475): a, c, t, g, unknown or other
  misc_feature (475)..(475): n is a, c, g, or t
  modified_base (479)..(491): a, c, t, g, unknown or other
  misc_feature (479)..(491): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggccccaaatcctcatccagaggaataatcagcggccctcaggggtccctgaccgattctctggctccaagtctggcacctcagcctccctgacccatcagtgggctccggtccgaggatgaggctgactattactgtgcatcacgggacncaacntgggatgaacaatctgagcggttgggtgttcgggcggagggaccaaacgtcgaccgtctaggtcagccaaggctcgccccgtcgtcactctcgtcccacctcctcctcgtctctactgacgcggctgcagcgcngtgnnnnnnnnnnnnn

SEQ ID NO: 24911 - DNA, 604 bp, Homo sapiens
  misc_feature: GYAE6OF02G0FVS.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggcagagggtcaccatctcttgttctggagcaactccaacatcggaagtattatgtattctggtatcagcaactcccaggaatcggacccccaaatcctacatccagagaatatcagccggccctgacggggtccctgaccgtattctcgtcggcctaccgaagtcctggcctacctcacgtccctccctagaccctatccgaggttcgggccttccgggccgaggtactgggacggtctgaaccttagttacctgtgactagttccgaacgggacctacaacgtgtcgggaatcggaactagttcggtaggcgggtacgggtttggggtacgttcggggacgggtaacggggtaaccctaaaggttccgggaacccggtttaccgtagggtacccg

SEQ ID NO: 24912 - DNA, 523 bp, Homo sapiens
  misc_feature: GYAE6OF02G9FFP.21.22.B11.1.454.CMB.1.raw
  modified_base (247)..(247): a, c, t, g, unknown or other
  misc_feature (247)..(247): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
  modified_base (513)..(514): a, c, t, g, unknown or other
  misc_feature (513)..(514): n is a, c, g, or t
  modified_base (517)..(523): a, c, t, g, unknown or other
  misc_feature (517)..(523): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggccctcaggggtccctgaccgattcnctggctccaagtctggcacctcagcctcctgacccatcagtgggctccggtcaggatggaggctgactattactgtgcatcacgggacncaacatgggatgacaatcngagcggttgggtgttcgggcggtagggacctaaacgtggaccgtccgtaggtcgagcccgaaggcctcgccccctcggtccactctcgttccccacctccctccgcgccgacgacgtcgacgccgggctcggcgaaggccgacgacgtacgangancnncgnnnnnnn

SEQ ID NO: 24913 - DNA, 637 bp, Homo sapiens
  misc_feature: GYAE6OF02JLN1P.21.22.B11.1.454.CMB.1.raw
  modified_base (212)..(212): a, c, t, g, unknown or other
  misc_feature (212)..(212): n is a, c, g, or t
  modified_base (346)..(346): a, c, t, g, unknown or other
  misc_feature (346)..(346): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccgggnaggagggtcaccatctcttgttctggaggcaactccaacatcggaagtaattatgtattctggtatcagcaactccgaagatcgaccccaaactcctcatccagagaataatcagcgccctcgacggggtcccngacctattcctctggcctacaagtctggccacctcagccctcctacgactcgtcgaggtcgggtcctacccgggtccggaaggtactcgggacggtccgttagtaaccttatttaccgtcgggttacaccgttaacgtcccggaaacgggggtaccaccgtaaaccgtaggtaggacttacgaaccgtaattccggttaggaacggggtttcgggttggggttacgggttaccgggaccgggaacggtaaccccgtaagttaccgtaccccgggttacgtacggtacccgg

SEQ ID NO: 24914 - DNA, 663 bp, Homo sapiens
  misc_feature: GYAE6OF02H9FEU.21.22.B11.1.454.CMB.1.raw
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (440)..(440): a, c, t, g, unknown or other
  misc_feature (440)..(440): n is a, c, g, or t
tcagtcgtcgctcgcacgaccggtgctcgatttagacgacagctcagggggggggaagctcagcttcagctgtggtagagaagacaggactcaggacaatctccagcatggccggctttccctctcctctcaccctcctcactcactgcgcagggtcctgggcccagtctgtgctgactcagccaccctcagcgtctcgggacccccgggcagaggtcaccatctcttgttctggagcaactccaacatcggaagtaattatgtattcngtatcagcaactccagatcggccccaaatcncatccagagatancagcgcctcgacggggtccctagaccgattcctcgtcggactaccgaagtcctgggacctacccgtcacggtcccctaccgtcgaacctacgtcgaacgttcggggcctcccgggtacgtaacgggnttcggaacgggtctacggtaaccttttacgttaacgtgttacgacctaacggttccgaaccgggggtacacctaacgtagtcggggtaactcggtaacctaaggttcctaagggacgggtttaccgggggttgggttaccgggtttacccgggacggggttaaacgggaaccccttaaaccggttccgggtaaccccgtttaccggggtacccggttaaccgg

SEQ ID NO: 24915 - DNA, 527 bp, Homo sapiens
  misc_feature: GYAE6OF02FYDQS.21.22.B11.1.454.CMB.1.raw
  modified_base (515)..(527): a, c, t, g, unknown or other
  misc_feature (515)..(527): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtcccctgaccgattctctggctccaagtctggcacctcagcctccctgaccatcagtggctccggtccgaggatgaggctgactatactgtgcatcgacgggacgcaacagtgggatgacaatctgagcgggttgggtgttcgggcgggacgggaccaaacgtggaccgtccgtaggtcacgacccgaaggcctcgcccccgttcggtcctacgtccgtcgttccccaccctccctccctcgtcctctactcgacgccggcgcggacgacggcgcgagtcgnnnnnnnnnnnnn

SEQ ID NO: 24916 - DNA, 637 bp, Homo sapiens
  misc_feature: GYAE6OF02HI8M7.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcactccaagaggaaataatcagccggccctcgacggggtccctggaccgtattcctctcggaccttaccgaaagtccgtacgggccacccgttcacggtcccctccccgtacgaccctagttccgaagggttcgggccgttcccgggtccggaagggtactcgggaggtccgttaggtaaccttagtttaaccgtggttcgaccgtactccggaaccggggaccgacaaaccgtagttagggactagaaccagttcgtaggacggttcgggttgggtcggttcgggacgggacggaaccctaaagtccggtaaccgtcgtaacggtaccg

SEQ ID NO: 24917 - DNA, 526 bp, Homo sapiens
  misc_feature: GYAE6OF02H6IBW.21.22.B11.1.454.CMB.1.raw
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
  modified_base (462)..(462): a, c, t, g, unknown or other
  misc_feature (462)..(462): n is a, c, g, or t
  modified_base (512)..(513): a, c, t, g, unknown or other
  misc_feature (512)..(513): n is a, c, g, or t
  modified_base (515)..(516): a, c, t, g, unknown or other
  misc_feature (515)..(516): n is a, c, g, or t
  modified_base (518)..(518): a, c, t, g, unknown or other
  misc_feature (518)..(518): n is a, c, g, or t
  modified_base (521)..(526): a, c, t, g, unknown or other
  misc_feature (521)..(526): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcgacggggtccctgaccgattctctggctccaagtctggcacctcacgccctccctgaccatcaggtgggctcccgggtccgaggatggaggctgacttattactgtgcatcgacgggacncaacagtgggatgaacaatcngagtcggttgggtgttcgggcggagggaaccaacgtcggacccgtccgtaggtcacgacccgaaggctcgcccctcggtcactctcgtcccnccctccgtcgacgcgacgacgtgacgcggctggacgacggcgcgagtagnncnngncgnnnnnn

SEQ ID NO: 24918 - DNA, 577 bp, Homo sapiens
  misc_feature: GYAE6OF02FQYWK.21.22.B11.1.454.CMB.1.raw
  modified_base (210)..(210): a, c, t, g, unknown or other
  misc_feature (210)..(210): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggacccccaaactcctcatccagaggaataatcagccggccctcgacggggtccctgaccgtattcctctcggctccaagtcctggccacctcacgtcctccctagacccatcgaggtcgggccttcccgggtccgaggtatcgggaggctagaccttattacgtgtcgcagtcgaccgggacncaaacgntggggatagaactatcgtggtaacggtcggggtttgggtcggttccgggagggtacgggaccaaaccggtcggacccgttaccgtaggtaccg

SEQ ID NO: 24919 - DNA, 567 bp, Homo sapiens
  misc_feature: GYAE6OF02H5WML.21.22.B11.1.454.CMB.1.raw
  modified_base (210)..(210): a, c, t, g, unknown or other
  misc_feature (210)..(210): n is a, c, g, or t
  modified_base (406)..(406): a, c, t, g, unknown or other
  misc_feature (406)..(406): n is a, c, g, or t
  modified_base (450)..(450): a, c, t, g, unknown or other
  misc_feature (450)..(450): n is a, c, g, or t
  modified_base (469)..(469): a, c, t, g, unknown or other
  misc_feature (469)..(469): n is a, c, g, or t
  modified_base (533)..(533): a, c, t, g, unknown or other
  misc_feature (533)..(533): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggccaactccaacatcggaagtaattatgtattctggtatcagcaactcccagaatcggacccccaaactcctcatccagagaataatcagccggcctcgacgggtccctcggaccgattccgtctacggcctaccaagttctacggcctacccgtcacgtcccttcccncgaccatccaggtcggccgtcccgggtacgaggtatcggaggtntacgaacttattacgtgtncctatccgacgggtacacaacgagtgggaatcgacagtctaggacggtcgggttgggtgtcggnggtacggacaaccgtggacccgtcgtaggtaccg

SEQ ID NO: 24920 - DNA, 544 bp, Homo sapiens
  misc_feature: GYAE6OF02HQNX0.21.22.B11.1.454.CMB.1.raw
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaaacatcggaaagtaattatgtattctggtatcagcaactcccaggatcgacccccaaatcctnatccagacgaatatcagcgccngacgggtcctgacgattcngtcgctacagtctgcactcactcctcctgacatcagtcgggctcccgggtcgagntggacgtcngtactatctggcncactcgacgggacaccaagtgcgggaatcgaactaacgtgtggaagggttcggtttgggttggtccgggtacgggaacgtacccgaaactcgggtaacccgttccgtaaggtaccgg

SEQ ID NO: 24921 - DNA, 681 bp, Homo sapiens
  misc_feature: GYAE6OF02I7MV6.21.22.B11.1.454.CMB.1.raw
  modified_base (359)..(359): a, c, t, g, unknown or other
  misc_feature (359)..(359): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactacgcagggtcctgggcccagtctgtgctgactcagccaccctcagccgtctcggggacccccggcaggagggtcaccatctcttgttctggaggcaactccaacatcggaataattatgtattctggtatcagcaactcccaggaatcggcccccaaatcctcatccagagaataatcagccggccctgacggggtcccagaccgtatttccncgtggccttaccaagtctacggctaccctnacgcccttcccgngacccatcgacgtggggcccttccgggtccgaagggactggaacgggtctaggtaaccttatttaacctggtcgacctagttacccggaaccgggggacaccgtaaaccgtaggttaggggaaccttagggaacctaaaggttccgtaagggtacggggttcccgggggttttagggggttcggttaccccgggggaacgggtaacgggggttaaacccctaaaacgggttcggaaacccccccggtttcggtttaaacgggggtcccctaaaccgggg

SEQ ID NO: 24922 - DNA, 624 bp, Homo sapiens
  misc_feature: GYAE6OF02IQOPA.21.22.B11.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (394)..(394): a, c, t, g, unknown or other
  misc_feature (394)..(394): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggnaggagggtcaccatctcttgttctggagcaactccaanatcggaagtaattatgtattctggtatcagcaactcccgaggaactcggacccccaaactccctcactccagaggaataatcacgccggccctcgacggggtccctgaccgtattctctggctaccgaagtcctggccacctcncgtccctcccgtgaaccctatcgaggtcgggccttcccgggtacgagggactgggacggtctagaacctttagttacgtcggtcgactacgtaccggaccgggaccgacaaacgtgtacgggaacttacgaacgtacgtcggtcggagggtccgggtttggggttcggttccgggaccgggtacgggtaaccctaacggttccggacccggttaccggtacgggtacccg

SEQ ID NO: 24923 - DNA, 648 bp, Homo sapiens
  misc_feature: GYAE6OF02FLJYF.21.22.B11.1.454.CMB.1.raw
  modified_base (486)..(486): a, c, t, g, unknown or other
  misc_feature (486)..(486): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgtctggaggcaactccaacatcggaataattatgtattctggtatcagcaacctcccaggaatcggacccccaaactcctcactccagaggaataatcagccgccctgacggggtccctagaccgtattccgtcgtcggcctaccgaagttcctcggccacccgtcgacgtccctacccgtgaaccctactccgaggttccgggccgttcccgggtaccgagggtactgggaacggtccttagaaccttatttaccgnggttagacctacgttaccgaacggggtaaccaccgaaacgtggtacgggatcgggaaacctacgttccgagggtaacgggtcgggtttacgggttcggttaccgggacggggtaaccggtaaccctaaaccggtcggaaccccggtttaccgtaggtacccg

SEQ ID NO: 24924 - DNA, 698 bp, Homo sapiens
  misc_feature: GYAE6OF02IQGZY.21.22.B11.1.454.CMB.1.raw
  modified_base (211)..(211): a, c, t, g, unknown or other
  misc_feature (211)..(211): n is a, c, g, or t
  modified_base (309)..(309): a, c, t, g, unknown or other
  misc_feature (309)..(309): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccggnagacgggtccaccatctcttgttctggagcaactccaacatcggaataattatgtattctgtatcagcaactcccaaggaactcggaccccaactccncactccaagagtaaataactcgagccgccctgacggggtccctagaccgtattctcgtcgctaccaagtctcggcctacctcacgtccctcccgtacgaaccctagtccgagggttccgggtaccctcccggggtaccggaagggtaacttgggaacgggtccttacggtaaccttaacgtttacgtcgggttacgctaacggttacccggaaccggggaacctacgaaaccgtaggttcggggaaacttccgggaactacgttacggtacggggacgggtttacccgggggttttgggggttacggttcccgggggaaccggggttaacgggaaaccccgttaaccggttccggggtaaaccccgtttcccgggttaaggtaccccgg

SEQ ID NO: 24925 - DNA, 550 bp, Homo sapiens
  misc_feature: GYAE6OF02IL67J.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgtctggagcaactccaacatcggaagtaattatgtattctggtatcagcaactcccaggatcggcccccaaatcctcatccagagaataatcagcgcctcgaggggtctctgaccgtattctctcggctccaagtctggccacctcacgtccctccctgaccatcgagtcgggctccggtcgaggatggaggctgactatactgtcgacagtcgacgggacacaacgagtgggatagactaatcgtaggacggtcgggtttagggttcggttaccgggacgggtaacgggaccctaaaggtcggacccgttacgtaacggg

SEQ ID NO: 24926 - DNA, 308 bp, Homo sapiens
  misc_feature: GYAE6OF02ICT6V.21.22.B11.1.454.CMB.1.raw
  modified_base (300)..(308): a, c, t, g, unknown or other
  misc_feature (300)..(308): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggaggaccaaactgaccgtcctaggtcagcccaaggctcgccccctggtcactctcgttccccgcccttcctccctcgtcctctcgtgcggctggcaaggcgcatagnnnnnnnnn

SEQ ID NO: 24927 - DNA, 609 bp, Homo sapiens
  misc_feature: GYAE6OF02HK9HE.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggcaggagggtcaccatctcttgttctggaggcaactccaacatcggaataattatgtattctggtatcagcaactccaggactcggaccccaactcctcactccagagaataatcagccgccctcgacggggtccctagaccgtattcctcgtggcctaccgaacgtcgtcggccaccctcacgtccctccgtcgaccatcgaggttccgggccttcccgggtaccgaggtagtcggacggtcctacggtaacttagtttacgtgtcgacctacgtccggaacgggaccacaagagtggaatcgaactacgtcgtaggacggttcgggttcggggttcgttaccggggacgggtaccgggaaccctaaacggttccggaacccgttcggtaggtacccg

SEQ ID NO: 24928 - DNA, 628 bp, Homo sapiens
  misc_feature: GYAE6OF02JWDEP.21.22.B11.1.454.CMB.1.raw
  modified_base (210)..(210): a, c, t, g, unknown or other
  misc_feature (210)..(210): n is a, c, g, or t
  modified_base (303)..(303): a, c, t, g, unknown or other
  misc_feature (303)..(303): n is a, c, g, or t
  modified_base (621)..(621): a, c, t, g, unknown or other
  misc_feature (621)..(621): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggagcaactccaacatcggaagtaattatgtattctggtatcagcaactccagaatcggaccccaatccncatccagagaatatcagccggccctcgacggggtccctaggacccgtattccgtcgtacggccttaccgaagttccgttcggaccctaaccctcgaccgtcccttaccccgtagaccccattccgagggttcgggaccctttcccggggacgtaacgggattcgggaacggtctaggtaacttaacgttacgtggttacgcctacgttaccggaaccggggactaccgaaagtaggtacgggtatacgaacgtatcggtaggaacggttcgggtttgggtcgttcgggacggacggtaccaaagtcggaaccgttcgnggtaccg

SEQ ID NO: 24929 - DNA, 686 bp, Homo sapiens
  misc_feature: GYAE6OF02HKJRF.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagtaattatgtattctggtatcagcaactcccaggaatcggacccccaaatcctacactccgagtaagtaataatcagccgccctgacggggtccctagaccgtattcctcgtggcctaccgtaagtctacggcctacccgtcacggtcccttccccgtaggaaccctagtccgtaacgggttcggggtacccttaccccggggtccggaagggcttagggacggtaccgttacggtaaccttaaagtttccctagggttacgaccgtaacgttccgggaaccgggggtaccaccgtaaaacgtacgggtaggggaacttacgaaacttaacgtccgttagggacggggttccgggtttagggggtccggttacggggccgggtaaacggaccctaaacgggtcccggtacccggttaccggtaggtacccg

SEQ ID NO: 24930 - DNA, 303 bp, Homo sapiens
  misc_feature: GYAE6OF02F5L0D.21.22.B11.1.454.CMB.1.raw
  modified_base (292)..(292): a, c, t, g, unknown or other
  misc_feature (292)..(292): n is a, c, g, or t
  modified_base (298)..(303): a, c, t, g, unknown or other
  misc_feature (298)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctcggtcactctgttccccgcctcctcctcgtctctactgagcgggctggcaggcncatagnnnnnn

SEQ ID NO: 24931 - DNA, 676 bp, Homo sapiens
  misc_feature: GYAE6OF02JCKXG.21.22.B11.1.454.CMB.1.raw
  modified_base (211)..(211): a, c, t, g, unknown or other
  misc_feature (211)..(211): n is a, c, g, or t
  modified_base (263)..(263): a, c, t, g, unknown or other
  misc_feature (263)..(263): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtccaccatctcttgttctggagcaactccaacatcggaagtaattntgtattctggtatcagcaactcccaaggaatcggacccccaaactcctcactccagaggaataatcagccggcctcgacggggtccctagaccgtattcctacgtcggacctaccgaagttccgtcggcctaccctcgacgtccccttccctaggaacccctagttaccgtaacggggttccggggtaccccgttacccggggtaccgggaggttacgtgggtaacgggtcttaacggtactttacgttacgtgtacgacgtacgtaccggaaccgggtaccaacgaacgtgggtacggtagtacgaacgtacgttcggtaaggtcgggttacggggtttgggttacgggtaccggggagggtaaccggaaacccgttaacggtccgggtacccggttacggtaggtaccccg

SEQ ID NO: 24932 - DNA, 710 bp, Homo sapiens
  misc_feature: GYAE6OF02GDXBN.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggaccccccgggcaggagggtcaccatctcttgttctggaggcaactccaacatacggaagtaattatgttattcgtggtatcagcaacctcccaggaactcggacccccaactcctcatccagagaataatcagccgcctcgacggggtccctgacctattctcgtcggctaccaagtcctcggccaccctcaccgtccctcccgtacgaaccctacgtacgtacgggtcgggtcccgttcccggggtaccggacggtacgtcgggaacggtccgttaggtaaccttaacgtttaccgtcggttacgacctacgttacccgggaaccggggtaaccgaaccgtaaaccgtacggttacggggaacttaacgggaaccttacgttccgtagggtacggggttacccggggttttagggggtccgggtttacccgggggaacggggttaaccggggaacccgttaaaccgggtccggtaaccccgggttacccggtacgggtaacccgg

SEQ ID NO: 24933 - DNA, 303 bp, Homo sapiens
  misc_feature: GYAE6OF02GT70O.21.22.B11.1.454.CMB.1.raw
  modified_base (293)..(293): a, c, t, g, unknown or other
  misc_feature (293)..(293): n is a, c, g, or t
  modified_base (299)..(303): a, c, t, g, unknown or other
  misc_feature (299)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggtcagcccaaggctcgccccctggtcactctcgttcccgccctcctcctcgtctctactgagcggctggcaaggcncatagnnnnn

SEQ ID NO: 24934 - DNA, 548 bp, Homo sapiens
  misc_feature: GYAE6OF02FGVFB.21.22.B11.1.454.CMB.1.raw
  modified_base (210)..(210): a, c, t, g, unknown or other
  misc_feature (210)..(210): n is a, c, g, or t
  modified_base (458)..(458): a, c, t, g, unknown or other
  misc_feature (458)..(458): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgtctggaggcaactccaacatcggaagtaattatgtatctggtatcagcaactcccaggaatcggcccccaaactcctcatccagaggaataatcagccggcctcgacggggtccctgaccgattctctggctccaagtctggcacctcagccctccctgaccatcaggtcggcctccgggtccgaggatggaggctagaattattactgtgcatcgacgggacacaacngtgggatagactatcaggtacggcgggttgggtcggttacgggacgggtaacgggaaccctaaacgtggaacccgttccgtaggtacccg

SEQ ID NO: 24935 - DNA, 603 bp, Homo sapiens
  misc_feature: GYAE6OF02IRPY8.21.22.B11.1.454.CMB.1.raw
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnaggaggtcacatctcttgtcnggagcaactccaacatacggaagttaattatgtattcgtggtatcagcaactcccaggaatcggaccccaaactcctanactccagaaggaataancagccgcctcgacggggtccctgaccgtacttctacgtggcctaccgtaagtctcggccaccgttcacgtccctccctagacccatccgaggtcggtcctaccgggcgagagtcggacgctagacttattacgngtncgatcggaaccggctacaaacgtgagggtatagaacagtcgtcggtaagggtcgggtttgggtacgggttaccgggaccgggggtaaacggtacccctaaaacggttccgggtaccccggttacggtacggttacccg

SEQ ID NO: 24936 - DNA, 683 bp, Homo sapiens
  misc_feature: GYAE6OF02GW44C.21.22.B11.1.454.CMB.1.raw
  modified_base (210)..(210): a, c, t, g, unknown or other
  misc_feature (210)..(210): n is a, c, g, or t
  modified_base (488)..(488): a, c, t, g, unknown or other
  misc_feature (488)..(488): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaaacatcggaagtaattatgtattctggtatcagcaactcccaggaactcggacccccaaactcctcatccagagaataatcagccggccctgacggggttccctgaccgtattcctcgtcggcctaccgaagtccgtcggaccaccctcacgtcccctccctacggacccaagtccgagggttcgggcccttcccggggaccgtaagggactgggaacggtctacggtaacttagtttaccnggtcgtacgtacgtaccggaaccggggaccgtaccaaacgtaggtcgggaattacggaaccgtaagtttccggacgggtaacggggtttaccgggggttttcggggtttacgggttacccggggaacggggtaaccggggttaaacccaaaaccggtttacggggaaccccccgtttaccggtacgggttacccg

SEQ ID NO: 24937 - DNA, 568 bp, Homo sapiens
  misc_feature: GYAE6OF02HDB26.21.22.B11.1.454.CMB.1.raw
  modified_base (210)..(210): a, c, t, g, unknown or other
  misc_feature (210)..(210): n is a, c, g, or t
  modified_base (345)..(345): a, c, t, g, unknown or other
  misc_feature (345)..(345): n is a, c, g, or t
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
  modified_base (469)..(469): a, c, t, g, unknown or other
  misc_feature (469)..(469): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccggnagagggtcaccatctcttgttctggaggcaactccaacatcggaagtaattatgtattctggtatcagcaactcccaggaatcggaccccaaactcctacatccagaggaataatcagccgcctcgagggtcccngacctattctctggcctacgaagtctcggcacctcacgtccctccctgacccatcgaggtcgggcctccgggtccgagtnggacggctgacttattacngtcgcacgtcgacgggacacaacgngtaggatagaactagtcgtaggtacggtcgggtttagggtcggttaccggggacggtaacgggaacccgtaaacgtcggacccgttaccgtaggtaccg

SEQ ID NO: 24938 - DNA, 303 bp, Homo sapiens
  misc_feature: GYAE6OF02GOHRB.21.22.B11.1.454.CMB.1.raw
  modified_base (297)..(303): a, c, t, g, unknown or other
  misc_feature (297)..(303): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgtcggcggagggaccaaactgaccgtcctaggtcagcccaaggctcgccccctggtcactctcgttcccgcctcctcctcgtctctactgagcggctggcaaggcgcatagnnnnnnn

SEQ ID NO: 24939 - DNA, 629 bp, Homo sapiens
  misc_feature: GYAE6OF02G487X.21.22.B11.1.454.CMB.1.raw
  modified_base (209)..(209): a, c, t, g, unknown or other
  misc_feature (209)..(209): n is a, c, g, or t
  modified_base (346)..(346): a, c, t, g, unknown or other
  misc_feature (346)..(346): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcgggacccccggnagagggtcaccatctcttgttctggagcaactccaacatacggaagtaattatgtattctgtatcagcaactcccaggaactcggacccccaaatcctcatccaagagaataatcagccggcctcgacggggtcccngaccgtattctcgtcggcctccgaagtcgtcggacctaccctcacgtccctccctgaccatcgaggtcggctccgggtccgaggacttggacggtcctagaacttacgtttactggtacgacctagtcccggaacggggacctacaaaccgtggttagggaactcggaaacctaacgttcggtaggtaacggggttccggggttttggggtaccggtttacggggcgggtaaacggggaacccctaaaggtcccggtaacccgttaccggtacgggtacccgg

SEQ ID NO: 24940 - DNA, 310 bp, Homo sapiens
  misc_feature: GYAE6OF02IQ7ZV.21.22.B11.1.454.CMB.1.raw
  modified_base (297)..(297): a, c, t, g, unknown or other
  misc_feature (297)..(297): n is a, c, g, or t
  modified_base (303)..(310): a, c, t, g, unknown or other
  misc_feature (303)..(310): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctcggtcactctcgttccccaccctcctcctcgtctctactgagcgggctggcaaggcncatagnnnnnnnn

SEQ ID NO: 24941 - DNA, 524 bp, Homo sapiens
  misc_feature: GYAE6OF02JE66I.21.22.B11.1.454.CMB.1.raw
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (511)..(512): a, c, t, g, unknown or other
  misc_feature (511)..(512): n is a, c, g, or t
  modified_base (514)..(524): a, c, t, g, unknown or other
  misc_feature (514)..(524): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagccggcctcgaggggtcccctgaccgattcctctggctccaagtctggcacctcagcctcctgaccatcaggtcggcctccgggtcgaggatgaggctgactattactgtgcatcgacgggacncaacngtgggatgaacaatctggagtcgggttgggtcgttcgggcggacgggaccaaacgtcgaccgtccgtaggtcacgcccgaggcctcgccccgtcgtccactcctcgttcccgccctcctcctcgtctcctacgtcgacgcggcgtcgcgacggcgcgacgtgnngnnnnnnnnnnn

SEQ ID NO: 24942 - DNA, 720 bp, Homo sapiens
  misc_feature: GYAE6OF02IZ00H.21.22.B11.1.454.CMB.1.raw
  modified_base (209)..(209): a, c, t, g, unknown or other
  misc_feature (209)..(209): n is a, c, g, or t
  modified_base (260)..(260): a, c, t, g, unknown or other
  misc_feature (260)..(260): n is a, c, g, or t
  modified_base (559)..(559): a, c, t, g, unknown or other
  misc_feature (559)..(559): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcaggtcctgggcccagtctgtgctgactcagccaccctcagcgtcgtcgggacccccggnagagggtcaccatctcttgttctggaggcaactccaacatcgaataattangtattctggtatcagcaactcccaggaactcggacccccaaactcctcaactccaggaagaactaatcaggccgccctcgacggggtccctagaccgtattcctcgtggccttacgaacgttcctcggacccaccttcccgaacgtccccgttacccgttacgaaccctaacgttccgaagggtttccgggcccgttccccgggttacccggaagggtacttcggggaacgtccttacgttaacctttaacgtttaccctaggttacggacctaagttacccggaaccgggggtaaccnccgtaaaacgtcgggtaacggggtaacttcggaaaccttaacgttcgttaagggacggggtttaccggtttgggggtaccgggtttacggggtaccggggaaccggggtaaaccctaaaccgggtacggtaaccccgggtttacccggtaagggtaccccg

SEQ ID NO: 24943 - DNA, 628 bp, Homo sapiens
  misc_feature: GYAE6OF02GGC1V.21.22.B11.1.454.CMB.1.raw
  modified_base (326)..(326): a, c, t, g, unknown or other
  misc_feature (326)..(326): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggcagagggtcaccatctcttgttctggaggcaactccaacatcggaagtaattatgtattctggtatcagcaactcccaggaatcggacccccaactcctcatccagaggaataancagcgccctcgacggggtccctgaccgtattcctcgtggcctaccaaaggttcctacggccctaaccctccacgcccttccccgtgaaccctatccgaggtccggggccttccccgggtaccgagggtatgggacggtctaggtaccttaagtttactggtcgactacgtcgaccgggacacaaactggtagggatcggaacagttcgtacggacgggttcggggtttcggggtcggttaccggggacgggtaacgggaacccgtaaaccggtcggtaaccccggttaccggttagggtacc

SEQ ID NO: 24944 - DNA, 558 bp, Homo sapiens
  misc_feature: GYAE6OF02FO4G7.21.22.B11.1.454.CMB.1.raw
  modified_base (210)..(210): a, c, t, g, unknown or other
  misc_feature (210)..(210): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggcccccaaactcctcactccagagaataatcagccggccctcgacggggttccctgaccgtattcctctggcctaccgaagttctggccacctccagccctccctgacccatcaggtcggcctccggtcgagntgagctgacttatacngtgctagtcgacgggacncaaacgngtgggatacgactagtcgtaggacggtcgggtttgggtcgttcggggacggacggaccctaaacggtcggtacccgtccgtagggtcccg

SEQ ID NO: 24945 - DNA, 535 bp, Homo sapiens
  misc_feature: GYAE6OF02IWV67.21.22.B11.1.454.CMB.1.raw
  modified_base (207)..(207): a, c, t, g, unknown or other
  misc_feature (207)..(207): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
tcagtcgtcgctcgcacgaccggtgctcgatttagacgacagctcagggggggaagctcagcttcagctgtggtagagaatacaggactcaggacaatctccagcatggccggcttccctctcctcctcaccctcctcactcactgcgcagggtcctgggcccagtctgtgctgactcagccaccctcagcgtctgggacccccggnaggagggtcaccatctcttgttctggaggcaactccaacatcggaagtaattatgtattctggtatcagcaactccaggaatcggaccccaaatcctcatccagagaataatcagcgcctgacgggtccctgaccgtattctcgtggctcaagtctggcacctcacgtccctcctgacactcgaggtcggcctccggtcgaaggntgagctagactattcngtgctatcgacggacgacaagagtggatagaactagtcgtaggaggtcggttgggtacggttcgggacggtacgggaacctaaacgtggtacccgttcgtaaggccg

SEQ ID NO: 24946 - DNA, 553 bp, Homo sapiens
  misc_feature: GYAE6OF02IQL3U.21.22.B11.1.454.CMB.1.raw
  modified_base (211)..(211): a, c, t, g, unknown or other
  misc_feature (211)..(211): n is a, c, g, or t
  modified_base (386)..(386): a, c, t, g, unknown or other
  misc_feature (386)..(386): n is a, c, g, or t
  modified_base (410)..(410): a, c, t, g, unknown or other
  misc_feature (410)..(410): n is a, c, g, or t
  modified_base (453)..(453): a, c, t, g, unknown or other
  misc_feature (453)..(453): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctctgttctggaggcaactccaacatcggaagtaattatgtattctggtatcagcaactcccaggatggccccaaactcctcatccagaggaataatcagcgccctcgacggggtccctgaccgtattcctctcgctccaagtctggcacctcagcctcccngacccatcagtgggctccggtcgnggatggaggctggacttagttactgtgacatccgaggggaccnaacctagcgggatgaactatcgtggaaggtcgggttggggttacggttccgggagggacgggtaaccctaacgtacggtaacccgttccggtaggtaccg

SEQ ID NO: 24947 - DNA, 528 bp, Homo sapiens
  misc_feature: GYAE6OF02HZLOA.21.22.B11.1.454.CMB.1.raw
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (449)..(449): a, c, t, g, unknown or other
  misc_feature (449)..(449): n is a, c, g, or t
  modified_base (514)..(515): a, c, t, g, unknown or other
  misc_feature (514)..(515): n is a, c, g, or t
  modified_base (519)..(519): a, c, t, g, unknown or other
  misc_feature (519)..(519): n is a, c, g, or t
  modified_base (523)..(528): a, c, t, g, unknown or other
  misc_feature (523)..(528): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggccccaaactcctcatccagaggaataatcagcggccctcgaggggtccctgaccgattctctggctccaagtctggcacctcagcctccctgaccatcagtgggcctccggtcgaggatgaggctgactattactgtgcatcgacgggacgcaacgatgggatgaanaatcngagtcggttgggtgtcgggcggagggaccgaaacgtgaccgtcgtaggtcagcccaaggcctcgcccctcggtcacttcctcgttcccncccttccctcctccgtcctccgtactcgacgtccgggcgtcggcgacggccgtacagttacgcannacgnctcnnnnnn

SEQ ID NO: 24948 - DNA, 573 bp, Homo sapiens
  misc_feature: GYAE6OF02I4592.21.22.B11.1.454.CMB.1.raw
  modified_base (209)..(209): a, c, t, g, unknown or other
  misc_feature (209)..(209): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (415)..(415): a, c, t, g, unknown or other
  misc_feature (415)..(415): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaaggaatcggcccccaaatcctacatccagagaataatcagcgccctgacgggtcccngaccgattcnctggctcaagtcnggccacctcacgcctcctgaccngtccaggtcggctccgggtccgaggntggacggtctgacttattactggtgcagtccgacgggacgacaacgtagtgggatacgactaagttccgtaggaacggtccgggtttggggtaccgttaccggggacggtacggggtaaccctaaaggttccggaacccggttacgtacgggtacccg

SEQ ID NO: 24949 - DNA, 574 bp, Homo sapiens
  misc_feature: GYAE6OF02F7MUT.21.22.B11.1.454.CMB.1.raw
  modified_base (322)..(322): a, c, t, g, unknown or other
  misc_feature (322)..(322): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (549)..(549): a, c, t, g, unknown or other
  misc_feature (549)..(549): n is a, c, g, or t
  modified_base (552)..(552): a, c, t, g, unknown or other
  misc_feature (552)..(552): n is a, c, g, or t
  modified_base (558)..(558): a, c, t, g, unknown or other
  misc_feature (558)..(558): n is a, c, g, or t
  modified_base (571)..(572): a, c, t, g, unknown or other
  misc_feature (571)..(572): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcatccagagaataatcagcggccctcgacgggtccctgaccgattctctggctccaagtctggccacctcagccctcctgacccatcagtgggcctccggtccgaggatggaggctgactnttactgtgcatcgacgggcncgaangtggatgacatcngagtcggttgggtgtcggacggaggaccaacgtcgaccgtccgtacggtcacgtacccgaaggtccgtccgtcccccgttcggtcccgtaccgttcctccgttaccccctaccccgttcccgttcccgtcccgttccctccgttaccgttcgacggtccggtcgtcggacgacggtcgacgtagtacgnacncgactncgtcagtcgacgnngc

SEQ ID NO: 24950 - DNA, 303 bp, Homo sapiens
  misc_feature: GYAE6OF02H0MT2.21.22.B11.1.454.CMB.1.raw
  modified_base (301)..(303): a, c, t, g, unknown or other
  misc_feature (301)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctcggtcactctcgttcccgcctcctcctcgtctctactgagcgggctggcaaggcgcatagnnn

SEQ ID NO: 24951 - DNA, 730 bp, Homo sapiens
  misc_feature: GYAE6OF02GQ4FG.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagtaattatgtattctggtatcagcaactcccaggaatcggacccccaaactcctcatccaagagaataatcagccgccctgacggggtccctagaccgtattcctcgtcggcctaccgaagtctcggacctacccgtcacgtcccctccctacgaccctatccgtaagggtcgggtcccttcccggggtaccgaagggtacgttcgggaacgggtcctttacggaacctttacgtttaaccgtgggttcgacccgtaagttaccccggaaacggggggtaaccctaccgtaaaaccgtagggtttacggggaaacttccggaaaaccttaacggttccgttaacgggtaacggggtttccgggggttttacggggggttacggtttaccccgggggaccgggggtaacggggtaaacccccttaaaacgggttcccgggaacccccgggttttacccggtaagggttacccccgg

SEQ ID NO: 24952 - DNA, 887 bp, Homo sapiens
  misc_feature: GYAE6OF02JVF0C.21.22.B11.1.454.CMB.1.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
tcagtcgtcgctcgcacgaccggtgctcgatttagacgacagctcagggggggaagcgtcatcttcagctgtggtagagaagacaggactcaggacaatctccagcatggccggcttcctctcctctcaccctctcactcactgcgcaggtcctgggcccagtctgtgctgactcagcccacctcacgcgtcgtcgggaccccccgggnacggagggtcacccgatcctctttgtccnggtacggcaacctccaactacgtcgaagtaaactttagtcgttaatttcgacggttaatctaacggtcctaaaaccgttccccgtaaagggaaacgttccccggggaaacccccccttaaaacgtacccccgtttacgaaaccctttaccccgaaggtaaaccggggaaaactttaaacgttaaccccgacggacccgggtaacccctcggtaaccggggggttaccccttacggaacccggtttaatttcccgtaccgttcccggactttacccggaaacgttcccggtagggacccctttacccgaccgtaacccggtacccctccccgttaccggtacccctaacgttaccgtacgggttaacccgggtccgttacccggggtttaaccccgggacgggttaaccggtaccgggtaagggtacccgttaacggtaccgtttaaccgtttaacgttccgggttaccgtagtaaccgttcggaacccgggtccggaaccgttaaaccggagtaacgggacttacggtaaccgacgttacggtaggtaacggttcgggggttaacggtttccggggttaccgggtacgggtaaccgggggtaccgtaaaccgggttaccgtacccggttaccggtaacgggttaacccg

SEQ ID NO: 24953 - DNA, 503 bp, Homo sapiens
  misc_feature: GYAE6OF02FPBWE.21.22.B11.1.454.CMB.1.raw
  modified_base (343)..(343): a, c, t, g, unknown or other
  misc_feature (343)..(343): n is a, c, g, or t
  modified_base (383)..(383): a, c, t, g, unknown or other
  misc_feature (383)..(383): n is a, c, g, or t
  modified_base (486)..(486): a, c, t, g, unknown or other
  misc_feature (486)..(486): n is a, c, g, or t
  modified_base (491)..(503): a, c, t, g, unknown or other
  misc_feature (491)..(503): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagccctccctgacccatcagtgggcctccggtccgaggatggaggctgactattactgtgcatcgacgggacncaacagtgggatgacaatctgagcggttgggtgttcgggnggaggaccaacgtgaccgtcgtaggtcacgcccgaggcctcgccccctggtccacgtctcgtcccgcctcctcctcgtctctcgtgacgcggctggcaggcanagtgnnnnnnnnnnnnn

SEQ ID NO: 24954 - DNA, 666 bp, Homo sapiens
  misc_feature: GYAE6OF02HPUTV.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgttctggagcaactccaacatacggaagtaattatgttattctggtatcagcaactcccgaaggactccggaccccctaaactcctcactccaggagaaatatcacggccgccctcgacggggtccctaggaccgtattccgtcgtggcctaccgaagttccgtcggaccacccgtcacggtcccctacccgtacgaccctaagtccgagggttcggggccttcccgggtaccggaaggtacgtcggaacggtcctagtaacttaacgttactggtcgacctagtaccggacggggacgaccaaacgtggttaggaacttacgaactacgttcggtaggacgggttacgggggtttgggtacgggtttccggggaacgggtaaccgggtaaccctaaacggtttccgggaaccccgtttaccggtaacgggtacccg

SEQ ID NO: 24955 - DNA, 603 bp, Homo sapiens
  misc_feature: GYAE6OF02G5EBB.21.22.B11.1.454.CMB.1.raw
  modified_base (211)..(211): a, c, t, g, unknown or other
  misc_feature (211)..(211): n is a, c, g, or t
  modified_base (308)..(308): a, c, t, g, unknown or other
  misc_feature (308)..(308): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgttctggaggcaactccaacatcggaagtaattatgtattctggtatcagcaactcccaggatcggacccccaatcctnactccagaggaataatcagccggccctcgacggggtccctggaccgtattcctctggcctaccaagtctggccacctcacgtccctccctgacccatcgaggtcgggctccgggtaccgaggactggacggtctgaacttnttacgngtgcctagtccgaacgggacnctaaacgngtacggaatcgaactagtccgtaggacggttcggggttttggggtacggtttcccggggaacgggtaacggggtaaccctaaacggttccggtaaccccggttacggtacgggtacccg

SEQ ID NO: 24956 - DNA, 325 bp, Homo sapiens
  misc_feature: GYAE6OF02HDQQI.21.22.B11.1.454.CMB.1.raw
  modified_base (296)..(296): a, c, t, g, unknown or other
  misc_feature (296)..(296): n is a, c, g, or t
  modified_base (302)..(303): a, c, t, g, unknown or other
  misc_feature (302)..(303): n is a, c, g, or t
  modified_base (305)..(325): a, c, t, g, unknown or other
  misc_feature (305)..(325): n is a, c, g, or t
tcagtcgtcgctcgcacgaccggtgctcgatttagacgacagctcaggggtccctagaccgacttctctggctccaagtctggcacctcagcctccctgaccatcagtgggctccggtccgaggtatgaggctgactattactgtgcatcacgggacgcaacatgggatgacaagtctgagcggttggtgttcggcggagggaccaaactgaccgtctaggtcagcccaaggctgccccctggtcactctgttcccacctcctacctcgtctctactgagcgggctggcaacggcncatagnngnnnnnnnnnnnnnnnnnnnnn

SEQ ID NO: 24957 - DNA, 307 bp, Homo sapiens
  misc_feature: GYAE6OF02HHNAD.21.22.B11.1.454.CMB.1.raw
  modified_base (300)..(307): a, c, t, g, unknown or other
  misc_feature (300)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctcgttcccaccctcctcctcgtctctactgagcgggctggcaaggcgcatagnnnnnnnn

SEQ ID NO: 24958 - DNA, 561 bp, Homo sapiens
  misc_feature: GYAE6OF02G1Q1W.21.22.B11.1.454.CMB.1.raw
  modified_base (210)..(210): a, c, t, g, unknown or other
  misc_feature (210)..(210): n is a, c, g, or t
  modified_base (468)..(468): a, c, t, g, unknown or other
  misc_feature (468)..(468): n is a, c, g, or t
  modified_base (498)..(498): a, c, t, g, unknown or other
  misc_feature (498)..(498): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggacccccaaatcctcatccagaggaataactcagccggccctcgacgggggtccctggaccgtattcctcgtggctaccaagtctcggcacctcacgtccctcctgaccatcaggtcgggcctccgggtcgaggactggaggctagacttattactgtgcagtccgacgggacncaaacgtagtcgggaatgactatcgtaggnggtcgggtttgggtcggttcgggacgggacggtacctaaacgtcggtaccgtcgtaggtaccg

SEQ ID NO: 24959 - DNA, 655 bp, Homo sapiens
  misc_feature: GYAE6OF02FMMCF.21.22.B11.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (301)..(301): a, c, t, g, unknown or other
  misc_feature (301)..(301): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagaggtcaccatctctgtctggagcaactccaacntcggaatattatgtattctggtatcagcaactcccaggaactcggacccccaatccnatccagaggaataatcagccggccctcgacggggtccctaggaccgtattctccgtggcctaccgtaagtcctggcctaccgtcgacgtccctacccgtagaccctagtccgaagggttccgggtacttccccggggtaccgaggtacgttcggacgggtccttacggtaaccttagtttaccgtcggttagcctaagttaccgaaccggggtacaccgaaacgtggtacgggtaactagggtaacctagttccgtagggtaacggttcggggttttaggggcgtttaccggggacgggtaacggtaaccccgtaaaggttccgggtaaccccggtttaccggtaggtacccgg

SEQ ID NO: 24960 - DNA, 658 bp, Homo sapiens
  misc_feature: GYAE6OF02IMM3Z.21.22.B11.1.454.CMB.1.raw
  modified_base (177)..(177): a, c, t, g, unknown or other
  misc_feature (177)..(177): n is a, c, g, or t
  modified_base (380)..(380): a, c, t, g, unknown or other
  misc_feature (380)..(380): n is a, c, g, or t
  modified_base (389)..(390): a, c, t, g, unknown or other
  misc_feature (389)..(390): n is a, c, g, or t
  modified_base (415)..(415): a, c, t, g, unknown or other
  misc_feature (415)..(415): n is a, c, g, or t
  modified_base (438)..(438): a, c, t, g, unknown or other
  misc_feature (438)..(438): n is a, c, g, or t
tcagtcgtcgctcgcacgaccggtgctcgatttagacgacagctcagggggtcccctaacgaccgacttctcgtggactcccaagtctggcacctcacgcctcccctgaccgatcgacgtggggctccggtccgacggtatggaggctgactaattactgtgccatccacgggtacncaacagtggatgacgaatctgagcggttgggtagttacggcggaggggacccaaacgtggaccgtaccgtagtccagcccaaggctcgccccgttcggtcctacctctcgttcccaccttcctccgttcgtcctctacgtcggacgcgggactagggcctaagggccgtcgaagttacgggatgagcaggtcacttcaggtcnactacatcnncactacacgcgagctagacgcactnacgacacacgtacacgtacacgngacgccgcgttacacgtacgcgtacgtacgacgacgtacgtacgtacgtacgtacgtacgaccgtaccgtaccggtaccgtacgtaacgttacgttacggtacggtacggtacgtacgtacggtaacggttaacggtttaacgttaaccgttacggtaccgttaccgttacgttacgttaccggtaccggtaccggtaccggtaccggtaccggtaccgg

SEQ ID NO: 24961 - DNA, 654 bp, Homo sapiens
  misc_feature: GYAE6OF02I3LYG.21.22.B11.1.454.CMB.1.raw
  modified_base (209)..(209): a, c, t, g, unknown or other
  misc_feature (209)..(209): n is a, c, g, or t
  modified_base (475)..(475): a, c, t, g, unknown or other
  misc_feature (475)..(475): n is a, c, g, or t
  modified_base (511)..(511): a, c, t, g, unknown or other
  misc_feature (511)..(511): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctctcaccctcctcactcactgcgcagggtcctgggcccagtctgtgctgactcagccaccctcagcgtctcgggacccccggnaggaggtcaccatctcttgttctggacggcaacctccaacatacggaagtaattatgttattctggtatcagccaactcccaggaactcggacccccaaactcctcactccagagaataatcagcgccctcgacgggtccctagaccgtattcctcgtcggctaccgaagtcctggccctacctcgaccgcccttcccagacccattcgaggtcggtccgtcccgggtccggaagacgtggacggtctacgtaccttatttaccgnggtacgtcagtcccggacggggtaccactaaaccgnggtacgggtaactacgggaactaacttcggtaacgggtacgggtccggggtttttagggggtaccgggtttacgggggaccgggtaaccgggtaacccttaaaccgggttccggtaacccccgggtttacgtacgggtacccg

SEQ ID NO: 24962 - DNA, 631 bp, Homo sapiens
  misc_feature: GYAE6OF02IH5L1.21.22.B11.1.454.CMB.1.raw
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (609)..(609): a, c, t, g, unknown or other
  misc_feature (609)..(609): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (627)..(627): a, c, t, g, unknown or other
  misc_feature (627)..(627): n is a, c, g, or t
  modified_base (629)..(630): a, c, t, g, unknown or other
  misc_feature (629)..(630): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatcggacccccaaactcctcatccagaggaataatcagcggccctcgacggggtccctgaccgattcctcgtgcctccaagtctcggcacctcacgccctccctagaccatcgagtcgggtcctcccgggtccgaggactggacggtctagacttactttacgngtcgctagtccgaacggggacacaaacgngtacgggatacgaactaatcgtaggacggtcgggttagggttcggttcgggcgggtaacgggaaccgtaacggtcggtaccgtacgtacggtcgacggacccgaacggccgtaccgtccccgtcggtccacgttcccgtccgttccccgcccgttccgtccctccgttcctccgttacgccgtacggtccgggtcgaccgggtaccgtacgggccgtaccgtagtcggtacgngcgtgcgtgccncncgcncnnc

SEQ ID NO: 24963 - DNA, 706 bp, Homo sapiens
  misc_feature: GYAE6OF02I7PU6.21.22.B11.1.454.CMB.1.raw
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtctcggggacccccgggcagagggtcaccatctcttgttcgtggaggcaacctccaacagtacggaaagttaattatgttattctaggtatcagcaacctccgaaggaactccggacccccaaactcctacactccaagaagaataatcagccggccctcgacgggtccctacgaccgtattcgtcgtcgcctacgaacgttccgtacggacccacccgtccacgtcccttcccgcgtaacccatccggtaaggtccgggtcccgtcccgggtaccggaagggtactacgggacggtccttacggtaacctttaacgtttaccgtcggtacggacctaacgtacccggaaccggggaccaaccgtaaacgaggtacggggaataacgaactacgttcgtagggtacgggttacggggtttgggggttcggttacccgggggacggggtaaacccggtaaacccgttaaaccggtccggtaaccccgggtttaccgtaccgggtaacccgg

SEQ ID NO: 24964 - DNA, 307 bp, Homo sapiens
  misc_feature: GYAE6OF02G4D9D.21.22.B11.1.454.CMB.1.raw
  modified_base (300)..(307): a, c, t, g, unknown or other
  misc_feature (300)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggtcacgccaaggctgccccctggtcactctcgttcccaccctcctccgagccgacgactgagcgggctggcaaggcacatagnnnnnnnn

SEQ ID NO: 24965 - DNA, 813 bp, Homo sapiens
  misc_feature: GYAE6OF02IM1XM.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaatatgtattctggtatcagcaactcccgaggaatcggacccccaaactcctacatccaagacggaaataactcgagccggaccctcgacgggggtaccctcggaaccgtatttccgtcgtcggacccttaccgaaagttccgttacggacctaacccgttccaacgtaccccgttccccgtacgaacccctaacgtccgaacgggttccgggggtaccgttccccggggttacccggaaggggtaacttacgggaacgggtaccgttacgggaaaccttttaccgtttaacccgttacgggttaccgaacccgttacgttaaccccgggaacccgggggttaacccgggtaacccaaaaccgttaaaggggttaaccggggtaagttaaccggaacctaaaccgtttccggttacgggtaaccggggttaccgggggttttcgggggttaaccgggtttacccgggggaacccgggggttaaaccgggtaacccccgtaaaaaacggttttccccggggaaaccccggttttacccggttaaggggttaccccgg

SEQ ID NO: 24966 - DNA, 760 bp, Homo sapiens
  misc_feature: GYAE6OF02GRVW5.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcggggaccccccgggnaggagggtcaccatcctcttgtctggaggcaactccaacataccggaagtaattatgtattcgtggtatcagcaactcccaggaactcggacccccaaactcctacgactccaagaaggaaactaaactcgaacggccggtaccctcgaccgggggtccctggaaccctagttcctcgtacggtcctacctaacggtccttagggccctaaccttcgactccccgttccctacggaccttacgtaccgtacgggtcgggtcccgttacccgggtaccggaagggttacgtagggaaccggtccgttaaggtaaccctttaaacgtttacccttcgggttacgaccgtaacgtttacccggaaccggggtaaccaacgtaaacccgtaggttaccgggtaaattacggaactacgttacgggttacggtacgggttaccgggggtttttacggggaccggggttttacggggaacccggggttaacgggtaacccgttaaaaacccggtccgggttaacccggtttacccggtaagggttaaccccgg

SEQ ID NO: 24967 - DNA, 305 bp, Homo sapiens
  misc_feature: GYAE6OF02GKZVM.21.22.B11.1.454.CMB.1.raw
  modified_base (299)..(305): a, c, t, g, unknown or other
  misc_feature (299)..(305): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctgttcccgccctcctcctcgtctctactgagcggctggcaaggcgcatagnnnnnnn

SEQ ID NO: 24968 - DNA, 308 bp, Homo sapiens
  misc_feature: GYAE6OF02JY3BL.21.22.B11.1.454.CMB.1.raw
  modified_base (291)..(291): a, c, t, g, unknown or other
  misc_feature (291)..(291): n is a, c, g, or t
  modified_base (297)..(308): a, c, t, g, unknown or other
  misc_feature (297)..(308): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgtcggcggaggaccaaactgaccgtctaggtcagcccaaggctcgcccctcggtcactctcgttccccgcctcctcctcgtctctactgacgcggctggcaggcncatagnnnnnnnnnnnn

SEQ ID NO: 24969 - DNA, 569 bp, Homo sapiens
  misc_feature: GYAE6OF02IVN6U.21.22.B11.1.454.CMB.1.raw
  modified_base (208)..(208): a, c, t, g, unknown or other
  misc_feature (208)..(208): n is a, c, g, or t
  modified_base (302)..(302): a, c, t, g, unknown or other
  misc_feature (302)..(302): n is a, c, g, or t
  modified_base (316)..(316): a, c, t, g, unknown or other
  misc_feature (316)..(316): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaattatgtattctggtatcagcaactcccaggatcggccccaaatccncatccagagaatancagccggcctcgacgggtccctgaccgtatcgtctggctcaagtctggccacctcacgcctccctgaccatcgagtcggctccgggtcaggatggacgtctgaccttattcgagtcgtacacttcgaacgggaccaccaagacgtgggaactagaaccctagtcgtaggcggtacgggtttggggtacgtttacgggaccgggtaacgggtaaccctaaacggtcggaaaccccggttcggtaggtaacccgg

SEQ ID NO: 24970 - DNA, 571 bp, Homo sapiens
  misc_feature: GYAE6OF02FULTD.21.22.B11.1.454.CMB.1.raw
  modified_base (483)..(483): a, c, t, g, unknown or other
  misc_feature (483)..(483): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccgggcaggacgggtcaccatctcttgttctggaggcaactccaacatcggaagtaattatgtattctggtatcagcaactcccaggaatcggacccccaaactcctcactccagagaataatcagccggccctcgacggggtcccagaccgtattcctcgtggcctccaagtctggccacctcacgccctccctgacccatccaggtcgggccttcccgggtccgaggatggacggctagaccttattcgtgtcgcagtccgacggggcacaacngtggatgaaccatcgtggacggtcgggtttgggtcggttcgggacgggtacgggaacctaaacggtcggtacccgtaccgtaggaccg

SEQ ID NO: 24971 - DNA, 616 bp, Homo sapiens
  misc_feature: GYAE6OF02I8SOX.21.22.B11.1.454.CMB.1.raw
  modified_base (211)..(211): a, c, t, g, unknown or other
  misc_feature (211)..(211): n is a, c, g, or t
  modified_base (341)..(341): a, c, t, g, unknown or other
  misc_feature (341)..(341): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnaggaggtcaccatctcttgttctggagcaactccaacatacgaagtaattatgttattctggtatcagacaactcccaggaactcggaccccaaactcctcactccagagaataatcacgcgtttttccncgtacggtcctcgaccgtattctcgtacgtctaccgaacgtcgtcgtccaccgtccacgtccctccgtacgaccgtactacgtacggtcggtccgttcccggtaccggacggtacgtacggacggtcgtacgtacgttacgttacgtcgtcgctacgtacggaccgggacgaccgtaacgtacggtggagtacgactactcgtacggtcggtacgggttgggtcggttcgggacggacggtaaccgtaacgtcggtaccgtaccgtacggtaccg

SEQ ID NO: 24972 - DNA, 707 bp, Homo sapiens
  misc_feature: GYAE6OF02J1TYN.21.22.B11.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaacatcggaagtattatgtattctggtatcagcaactccaggaatcggacccccaatcctcactccagagaataatcagccgcctcgacggggtccctagacccgtattccgtcgtcggccttaccgaacggttcctacgggaccctaaccctcgacgtccccttccccgtgaaccctacttaccggaacggttcggggtcccttaccccggggttcccggaaagggtacttcgggtaaccgggtccctttacggtaaacccgtttatttacccggtggttaccggaccttaacgttcccggaaccggggtaaccaccgtaaaacgtggtcgggtaaatacggtaacccaagttcccgtagggaaccgggtttcggggtttagggttaccgggtttccggggaaccgggttaacgggaacccctaaacggttccgggaaccccgggtttacgtaccgggtaacccg

SEQ ID NO: 24973 - DNA, 656 bp, Homo sapiens
  misc_feature: GYAE6OF02HEACM.21.22.B11.1.454.CMB.1.raw
  modified_base (214)..(214): a, c, t, g, unknown or other
  misc_feature (214)..(214): n is a, c, g, or t
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
  modified_base (317)..(317): a, c, t, g, unknown or other
  misc_feature (317)..(317): n is a, c, g, or t
  modified_base (379)..(379): a, c, t, g, unknown or other
  misc_feature (379)..(379): n is a, c, g, or t
  modified_base (552)..(552): a, c, t, g, unknown or other
  misc_feature (552)..(552): n is a, c, g, or t
tcagtcgtcgctcgcacgaccggtgctcgatttagacgacagctcaggggggggaagcgtcagcttcagctgtggtagagaagacaggactcaggacaatctccagcatggccggcttccctctcctcctcaccctcctcactcactgcgcagggtcctcgggcccagtctgtgctgactcacgccaccctcagcgtctcggggaccccccggnaggagggtcaccatctcttgttcnggagcaaactccaaacntacggaagtaattatgtattcgtaggtatcagcaactcccaggaactcggaccccaactccncatccagagaataatcagccgcctcgacgggtcctcgacgtatctcgtagcctacacgttcncggtaccacccgtcacgtccccttacccgtcgtaacctacgtccgtaaggtcggggttcctaccccggggtaccggaaggacgtacgggtggacccgtataaccgtttaacttacgttcggactcgttaaaccgcgggaaccgggacctaacgaaaccgtaggtgggtaaacngggtaaaccacgttcgtaggtacggtcggggtttacgggttcgggttacggaccgggaacgggttaacccaaaggttccggtaaccctcggttacggtaacccg

SEQ ID NO: 24974 - DNA, 754 bp, Homo sapiens
  misc_feature: GYAE6OF02F3Y67.21.22.B11.1.454.CMB.1.raw
tcagtcgtcgctcgcacgaccggtgctcgatttagacgacagctcaggggggggggaagcgtcagcttcagcgtgtcggtagagtaagacaggactcaggacaatctccagcaatggccggcttccctctccgtcctcaccctcctcactcgtactgcgcaggtcctgggacccagtctgtgctagactcagccacctcagcggtctcgggacccccgggcaggacggggtccaccgatccttcttgttcgtgggacggcaaccgttccaacattcggaaagttaattatgtattctggtatcgagacaactcccaggaagtcgggaccccaaagtcctcgacgttccaagaacggaaataatcgaggccggaccctacggacggggtcccttagaaccggtactttccgtacgttacgggaccttaccgaaacgttccgttacgggaccctacccgtacgacgtccccttaccccgtacgaaacccgtagtttaccgaacggtttcgggaccgttaccccggggttacgaacgggtacttacgggaacggtaccgttacggaacctttaacttacgtcggtcgtaactacgttacccgaacgggggaactaccgtaaaccgtaaggttaggaacgtacgaaccgtagttaccggtaggtaacgggtcggggtttaggggttcggtttccggggaagggaaccggttaaccgaaaccggttccggggaaccccgttaccggtaagggtaccccg

SEQ ID NO: 24975 - DNA, 302 bp, Homo sapiens
  misc_feature: GYAE6OF02GC41A.21.22.B11.1.454.CMB.1.raw
  modified_base (293)..(293): a, c, t, g, unknown or other
  misc_feature (293)..(293): n is a, c, g, or t
  modified_base (299)..(302): a, c, t, g, unknown or other
  misc_feature (299)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccgccctcctcctcgtctctactgagcgggctggcaaggcncatagnnnn

SEQ ID NO: 24976 - DNA, 747 bp, Homo sapiens
  misc_feature: GYAE6OF02FV6GM.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggacgcaacctccaacagtacggaagtaattatgttattcgtaggtatcgagcaacctcccgaaggaactccggacccccaaactccctacactccgagaaggaataactcacgccgcctcgacggggtccctaggaccgtattcctcgtcggtacctaccgaagttccttcgggacctaccgtccgaccgtccccttacccgtacgaaccctaagtccgacgggttccggggtccctttaccccggggtcccggaagggtacgttcgggaaccgggcttacggaactttaacgtttaccgtgggtacgtaccgtacgttaccggaaaccggggtaccgaacctaaaccgtaagggttacgggaacttacgtaaaccgttaacgtccggttagggtaacgggttcccggggttttagggggttacgggtttacccggggaacggggtaaccggggtaaaccccgtaaaaccggttccgggttaaaccccggttcccggtaacgggttaaccccg

SEQ ID NO: 24977 - DNA, 306 bp, Homo sapiens
  misc_feature: GYAE6OF02IGSA6.21.22.B11.1.454.CMB.1.raw
  modified_base (294)..(294): a, c, t, g, unknown or other
  misc_feature (294)..(294): n is a, c, g, or t
  modified_base (300)..(306): a, c, t, g, unknown or other
  misc_feature (300)..(306): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctcgttcccgccctcctcctcgtctctactgagcgggctggcaaggcncatagnnnnnnn

SEQ ID NO: 24978 - DNA, 558 bp, Homo sapiens
  misc_feature: GYAE6OF02JE4DE.21.22.B11.1.454.CMB.1.raw
  modified_base (358)..(358): a, c, t, g, unknown or other
  misc_feature (358)..(358): n is a, c, g, or t
  modified_base (381)..(381): a, c, t, g, unknown or other
  misc_feature (381)..(381): n is a, c, g, or t
  modified_base (441)..(441): a, c, t, g, unknown or other
  misc_feature (441)..(441): n is a, c, g, or t
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcaggagggtcaccatctcttgttctggaggcaactccaacatcggaataattatgtattctggtatcagcaactccaggaatcggaccccaactcctacactccagagaataactcgagccggcctcgacggggtccctaggaccgtnttcctcgtgcctaccaacgttcncggcctacccgtcacgccctccgtgaccctagtccgaggtcgggcctcccgggtcgaggntcgagctagacttatcgtgnctatccgacggacncaacgtacgnggactgactatgacggaggtcggttgggtcggtccgggaggacggtacctaaggtccgacccgtcgtacgtcg

SEQ ID NO: 24979 - DNA, 637 bp, Homo sapiens
  misc_feature: GYAE6OF02FXE39.21.22.B11.1.454.CMB.1.raw
  modified_base (462)..(462): a, c, t, g, unknown or other
  misc_feature (462)..(462): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccccgggcagagggtcaccatctcttgttctggagcaactccaacatacggaataattatgtattcgtgtatcagcaactccgagatcggaccccaactcctcatccagagaataatcagcggccctcgacggggtccctagacctattcctcgtcggcctaccgaagttctcggcctacctcacgccctcctgaccctatcgaggtcgggcctccgggtaccgaggactggacggtctacgtacttaacgtttcgngtcgaccgtaagtaccggaacccgggggtacaaccgaaacgtacggtacggggtaacttacgggaaacctagttccgtagggtacggggttcggggttttacggggtggtttaccggggacgggtaaccgggaaccctaaccggtacggaccccggtttaccgtagggtaacccg

SEQ ID NO: 24980 - DNA, 717 bp, Homo sapiens
  misc_feature: GYAE6OF02I1MHH.21.22.B11.1.454.CMB.1.raw
  modified_base (210)..(210): a, c, t, g, unknown or other
  misc_feature (210)..(210): n is a, c, g, or t
  modified_base (253)..(253): a, c, t, g, unknown or other
  misc_feature (253)..(253): n is a, c, g, or t
  modified_base (339)..(339): a, c, t, g, unknown or other
  misc_feature (339)..(339): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatcctcgttgttctggaggcaaccgtccaacntcggaagtaattatgtattctggtatcagcaactcccagggaactcggacccccaaatcccgtacactccaagacggtaaactaancgtaggccggaccctgaacggggtccctggacccgtattcgtcgtggctaccgaagtccttggcctaacccgtcgacgcccttacccgtagtacccaagtccaagggttcgggccttacccggggaccgaagggactcgggtaacggccttacggaccttacgtttaacgtcgggtaccgcgtaaacgttccggaaccggggtaccacgtaaacgtaggtacggggtaacttacgggtaaccctaaggttccgtagggaaccgggttacggggggttttacggggttaccggttacccggggaaccgggggtaaccggggtaaccctaaaaccgggttccgggaaccccggtttacccggttaggggttaacccccgg

SEQ ID NO: 24981 - DNA, 615 bp, Homo sapiens
  misc_feature: GYAE6OF02F234S.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatagccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcatccaagaggaataagtcacgccggccctcgacggggtccctgaccgtattcctctggctccaagtctggccacctcacgcccttccctagaccctatcgaaggttcgggccttcccggggtaccgagggtatcgggaacggtccttaggaaccttagttaccgtggtcgcctaagtcccggaaccgggggaccacaaacgtaggtggggaacttacggaactaagtcgtaggaggttccggggtttgggtcggttcgggacgggacgggaccctaaacgttcggaacccgttcgtagggtcccg

SEQ ID NO: 24982 - DNA, 621 bp, Homo sapiens
  misc_feature: GYAE6OF02JISCV.21.22.B11.1.454.CMB.1.raw
  modified_base (397)..(397): a, c, t, g, unknown or other
  misc_feature (397)..(397): n is a, c, g, or t
  modified_base (511)..(511): a, c, t, g, unknown or other
  misc_feature (511)..(511): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggcaggagggtcaccattctcttgttctgggagcaactccaacatacggaaagttaattatgtattcgtggtatcagacaacctcccgaaggaactccggaccccctaaactccctacatacccgaaggaacggtaaataactcacggggtccgaccctacggacggggtccctagaccgtattccncgtgcctcaagttctacggcctaccctcacgtccctcccgtagaacctagtccgagggtcgggtccctcccgggtaccggaaggtcgtcggacggtctacgtaccttattacgngtacgactacgtaccggacgggacaaccaagtaggtcggatacgactagtcgaggtacggtgggttggtcggtcggacgggagtaccaagttcgacccggttgaggtccc

SEQ ID NO: 24983 - DNA, 621 bp, Homo sapiens
  misc_feature: GYAE6OF02IXSOE.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacagtcggaagtaattatgtattctggtatcagcaactcccgaggaatcggaccccctaaactcctcactaccagagaataatcaggccggtcctcgacggggtccctgaccgtattctcgtggcctaccgagtctcggcctaccctcgacgtccctccctgacctagtcgtaggtcggccgtcccgggtacgaggtactcggacggtcctacgtaacttattaccgtggtacgactacgttaccggacgggaccgacgaaacgtagtacgggaatagaacctagttcgtaggtaacgggtcgggtttgggttacggttccgggaacgggtacgggtaaccctaaaggtccggtaacccggttaccgtaggtacccg

SEQ ID NO: 24984 - DNA, 656 bp, Homo sapiens
  misc_feature: GYAE6OF02G1TUZ.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaactcccaggaatcggacccccaaactcctcactccagagaataatcacgccgccctcgacggggtccctagaccgtattctcgtcggctaccaagtctcggcctacctcacgccctcctcgaccctagtccaggtcggtcctccgggtaccggaggtactgggacggtctacggtaaccttagtttaccgtggtacgaccgtaacgttaccggaaccggggtaccgaacccgtaaagacggttacggggaacttacgaaccgtaacgttccgttacggggaacgggttccggggtttacggggttccggtttacccggggcgggtaaacggggtaaccctaaaacggtccggtacccggttaccgtaacggtacccgg

SEQ ID NO: 24985 - DNA, 827 bp, Homo sapiens
  misc_feature: GYAE6OF02JYVBF.21.22.B11.1.454.CMB.1.raw
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccacctcagcgtctcgggacccccggnaggagggtccaccatctcttgttcnggacgcaactccaacntcggaagtaattatgtattctggtatcagcaactcccaaggaactcggacccccaaactcctacactaccaaggaacggaaacttaactcgaacggcccggtacccttaccgaaccggggggttcccctacggaacccgtactttccgtaccgtttacgggacccttacccgtaaaggtttccgttaccgggaccctaacccccgttcaaaccggttccccctttaccccgtaccggaaacccctaacgttccccggtaagggttccgggggtaccccttaccccgggggttacccggaagggttaccgtacggggaacggttacccttgggtaaacctttaacgtttaaccgttcggtacgacccgtaattaccccgggaaacgggggtaccgtaccaaaacgtacgggttacgggaaacgtacgtaaaccgtaacgtttcccggtaaggggtaaccggggttcgggggtttttacggggtcgggttttaaccccggggggacgggtaaaaccgggggtaacccctaaaacgggtttccgggtaaccccgggtttaccggtaacggggtaccccgg

SEQ ID NO: 24986 - DNA, 886 bp, Homo sapiens
  misc_feature: GYAE6OF02I6WYP.21.22.B11.1.454.CMB.1.raw
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggaccccaaactcctcatccagaggaataatcagcggccctcgacggggtccctggacccgtattccgtctcggcctccaacgttctaggccacctcgacgtccctccctacgacctatccgagtcggggtccctaccggggtccgaggtacgtggaacgggtctaggaacctttaatttaaccgtgttacgacctaagttccgaaccggggaccgaccaaacgtacggttcggggaaattcggaaacgaaagtttccggtaagggtaacggggtttcccgggggttttagggggttcgggttttaccgggggaccggggtaaacgggggtaaccccgtaaaaccggttaccgggtaaaccccggtttcccgggtaacgggttacccggtaaccgggtaccccggtaaacggggtcccgtacccgggtacccccccggttaccgggttaccccgttacccggttacccgtttaccccgggttttaccccccctaacccccggttttcccccgttacccccggttttaccccggtttaccccgtttaccccgtttaaacccggttacccggggtaaccggggttcccgggggttaccggtaccgggggtaacccggtaaacccgggggtacccggtaacccgtaacgggtttaccggacgtcgtccggacgtaccggcgtcggtacctggtccgacgtgacg

SEQ ID NO: 24987 - DNA, 732 bp, Homo sapiens
  misc_feature: GYAE6OF02G31K6.21.22.B11.1.454.CMB.1.raw
  modified_base (210)..(210): a, c, t, g, unknown or other
  misc_feature (210)..(210): n is a, c, g, or t
  modified_base (382)..(382): a, c, t, g, unknown or other
  misc_feature (382)..(382): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggacgcaactccaacagtcggaagttaattatgtaattcgtaggtatcagcaactcccgaggaactcggaccccccaaagtcctacactaccaaggtaacggaaataactcgacgccggccctacggacggggtccctaggaacccgtnttcctcgttcggacctaccgtaagtcgtacggacctacccttcgaacgtccctccctaggaccctagtccgtaacgggttccggggacccttccccggggtaccggtaacgggtacgttacgggaacgggttcccgttaaggaacctttaacgtttaaccgttcgggtacgtaccgtaacgtaccggtaacccggggactaacccgtaacgtaaggttacgggtaataccgaaaccgttacgttacggtagggtaccgggttacggggtttggggtacggttaccggggacgggaaccgggtaaccctaaacggttcccgggtaacccggttaccgttagggtaccccgg

SEQ ID NO: 24988 - DNA, 544 bp, Homo sapiens
  misc_feature: GYAE6OF02HLO4U.21.22.B11.1.454.CMB.1.raw
  modified_base (213)..(213): a, c, t, g, unknown or other
  misc_feature (213)..(213): n is a, c, g, or t
  modified_base (249)..(249): a, c, t, g, unknown or other
  misc_feature (249)..(249): n is a, c, g, or t
  modified_base (276)..(276): a, c, t, g, unknown or other
  misc_feature (276)..(276): n is a, c, g, or t
  modified_base (439)..(439): a, c, t, g, unknown or other
  misc_feature (439)..(439): n is a, c, g, or t
  modified_base (492)..(492): a, c, t, g, unknown or other
  misc_feature (492)..(492): n is a, c, g, or t
  modified_base (519)..(519): a, c, t, g, unknown or other
  misc_feature (519)..(519): n is a, c, g, or t
  modified_base (541)..(541): a, c, t, g, unknown or other
  misc_feature (541)..(541): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcgacgggtcctgggcccaaggtctgtgctgactcagccaccctcagcgtctcgggacccccggnagaggtcaccatctcttgtctggagcaactccaacntacggaataattatgtattctggtatnagcaactccaggatcggaccccaactcctcatccgagacgaataatcaggcgcctcgacggggtccctagaccgtagttcctcgtggccttaccgaagttccgtgccgtaccctcgacgtccctccctcgaaccctatccgaggtcggcttcccggcgaaggntggacggcttcgacttagttaccgtgctctaacgtcggaacgggtcactaaancgtggactgacatcgtagcgtggtggngtcggagcgactagcgcgtcgngtc

SEQ ID NO: 24989 - DNA, 738 bp, Homo sapiens
  misc_feature: GYAE6OF02GBKZ5.21.22.B11.1.454.CMB.1.raw
  modified_base (715)..(715): a, c, t, g, unknown or other
  misc_feature (715)..(715): n is a, c, g, or t
  modified_base (723)..(723): a, c, t, g, unknown or other
  misc_feature (723)..(723): n is a, c, g, or t
  modified_base (727)..(727): a, c, t, g, unknown or other
  misc_feature (727)..(727): n is a, c, g, or t
  modified_base (731)..(731): a, c, t, g, unknown or other
  misc_feature (731)..(731): n is a, c, g, or t
  modified_base (736)..(736): a, c, t, g, unknown or other
  misc_feature (736)..(736): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaatcctcatccagagaataatcagccggccctgacggggtcccctacgaccgtacttcctcgtcgcctaccgtaagtccgtcggacctacctcgacgtccccttccgtacgacctacgtcggacggtcgggtcccgttacccgggtaccggaaggtacgtcgggtaccggtcgtacggtaacctttaacgtttaccgtgggtacgacgttacgtaccgggaaccggggactaaccgaacgtacggggtggtaactacggaacttaacgtcgtaagggtacggttcgggggttttaggggtcggttcgggaaccgggtaacgggtaaacccgtaaacggtacccggtaccgttaccggtacggtaccgtaaccgacccggtaacggtccccgtcccggtaccccgttcgtacctaccgttccgttccccgttcccccgtacccgttcccgttcccgttccgttccgttacgtcgtcggacgggtccgtacggtccggacgaacgcggtaacgacggtgcncagcgagntcgngacngtcancg

SEQ ID NO: 24990 - DNA, 768 bp, Homo sapiens
  misc_feature: GYAE6OF02H69KI.21.22.B11.1.454.CMB.1.raw
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
tcagtcgtcgctcgcacgaccggtgctcgatttagacgacagctcaggggggggaaggcgtcagcttcagctgtggtagagaagacaggactcaggacaatctccagcatggccggcttccctctcctctcaccctcctcactcactcgcgcagggtcctgggcccagtctgtgctgactcacgcccacctccagccgtcgtcggggaccccgggcagagggtcacccagttctcgtttgttcngggaggccaatcccaanatcgggaaacgttatttacgtnttacgttcgtaggtacttnagtcaaactcccgaaggtaactccggtacccccaaaaccttcctacgtactaccgaagtaacggtaaataactacgaacggccggtaccctaccggaaccggggttccctacggtaaccgtacctttcgtccgttacggtccctaaccgtacgttacgttacgggccccttaacccgtcgaacgcccctttcccgacgacctactccgtaacgggtcgggttccgtccgggtaccggtggtaacgtcggaacgggtccttagtaacccgttagttactcggttacgcgtaacggttccgaacgggaccgaacgtaaacgtggttaacgggactttaaccggataacggtcgttaggaaccgggttttcgggttaacggggtcggggttttacccggagggggttaaccgggtaaccccgttaaaggttacccggggtaaccccgtttaccggtacgggtttaccgg

SEQ ID NO: 24991 - DNA, 689 bp, Homo sapiens
  misc_feature: GYAE6OF02JH1Y2.21.22.B11.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (497)..(497): a, c, t, g, unknown or other
  misc_feature (497)..(497): n is a, c, g, or t
tcagtcgtcgctcgcacgaccggtgctcgatttagacgacagctcaggggggggggaagctcagcttcagctgtggtagagaagacaggactcaggacaatctccggcatggccggcttccctctcctcctcaccctcctcactcactgcgcgagggtcctgggcccagtctgtgctgactcagcccacctnagccgtcgtcgggacccccgggnacggagggtccaccatccttcttcggttcgngggacggccaacctccaaacagtacggaagtaattatgtattctaggtatcagcaacgtccaggactccggaccccaaactcctacactccgaagaacggtaactaactcgacgcccggacctacggaccgggtccctacgaccgtacttccgtctcggcctaccgagtccgtacggccaacctccgaccgtccctcccgtacgaacctacgtccgaagggttccgggcccttcccgggtacggaagggtntcgggacgtcgtactacgtttaaccgttcgtgtacgacgtacgtaccggaacgggtacctacgaaaccgtgggtaccgggattaacgataacgtcgtaacggacggttccgggggtttggacgggttccgggaaccggggtagaacccggtaacgtccggtaccccggttaaccgttaggaccccgaaccgg

SEQ ID NO: 24992 - DNA, 324 bp, Homo sapiens
  misc_feature: GYAE6OF02I5T19.21.22.B11.1.454.CMB.1.raw
  modified_base (294)..(294): a, c, t, g, unknown or other
  misc_feature (294)..(294): n is a, c, g, or t
  modified_base (300)..(302): a, c, t, g, unknown or other
  misc_feature (300)..(302): n is a, c, g, or t
  modified_base (304)..(324): a, c, t, g, unknown or other
  misc_feature (304)..(324): n is a, c, g, or t
tcagtcgtcgctcgcacgaccggtgctcgatttagacgacagctcgaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggtcagcccaaggctgccccctggtcactctgtccccaccctcctcctcgtctctactgagcgggctggcaaggtcncatagnnngnnnnnnnnnnnnnnnnnnnnn

SEQ ID NO: 24993 - DNA, 308 bp, Homo sapiens
  misc_feature: GYAE6OF02GCXTJ.21.22.B11.1.454.CMB.1.raw
  modified_base (298)..(298): a, c, t, g, unknown or other
  misc_feature (298)..(298): n is a, c, g, or t
  modified_base (304)..(308): a, c, t, g, unknown or other
  misc_feature (304)..(308): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctcggtcactctcgttccccgccctcctcctccgtctctactgagcgggctggcaaggcncatagnnnnn

SEQ ID NO: 24994 - DNA, 579 bp, Homo sapiens
  misc_feature: GYAE6OF02IP7QL.21.22.B11.1.454.CMB.1.raw
  modified_base (212)..(212): a, c, t, g, unknown or other
  misc_feature (212)..(212): n is a, c, g, or t
  modified_base (400)..(400): a, c, t, g, unknown or other
  misc_feature (400)..(400): n is a, c, g, or t
  modified_base (480)..(480): a, c, t, g, unknown or other
  misc_feature (480)..(480): n is a, c, g, or t
  modified_base (501)..(501): a, c, t, g, unknown or other
  misc_feature (501)..(501): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccgggnagagggtcaccatctcttgttctggaggcaactccaacatcggaagttaattatgtattctggtatcagcaactcccaaggaactcggacccccaaatcctcactccagagaataatcagccggccctcgacggggtccctggaccgattcctcgtggcctcaagtctggccacctcacgccctcccngaccctatcgaggtcggcctccgggtcgaggatcggaggctgacttattacgtgtcgcacgtcgacgggacacgaaacgngtagggatcgaactagttcgnggtacgggtcgggtttggggtcgttcggggaccggtaagggaaccctaacgttcggacccgttccgttacggtacccg

SEQ ID NO: 24995 - DNA, 539 bp, Homo sapiens
  misc_feature: GYAE6OF02FJ7AL.21.22.B11.1.454.CMB.1.raw
  modified_base (346)..(346): a, c, t, g, unknown or other
  misc_feature (346)..(346): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcgaggggtcccngaccgattcctctggctcaagtctggcacctcagccctccctgaccatcagtcgggctcccggtcgagatcggaggctgactattctgtgcatcgacgggactcaaacagtcgggatcgaactaatcgtagaggtcgggttgggtcgttccgggacgggacggacctaaacgtcggtacccgtcgtaggtccg

SEQ ID NO: 24996 - DNA, 786 bp, Homo sapiens
  misc_feature: GYAE6OF02H5FGA.21.22.B11.1.454.CMB.1.raw
  modified_base (122)..(122): a, c, t, g, unknown or other
  misc_feature (122)..(122): n is a, c, g, or t
  modified_base (248)..(248): a, c, t, g, unknown or other
  misc_feature (248)..(248): n is a, c, g, or t
tcagtcgtcgctcgcacgaccggtgctcgatttagacgacagctcaggggggggaagctcagcttcagctgtggtagagaagacaggactcaggacaatctccagcatggccggcttccctntcctcctcaccctcctcactcactgcgcagggtcctgggcccagtctgtgctgactcagccacctcagcgtctcgggaccccggcaggacgggtcaccatctcttagttctggaggcaactccaanatcggaagtaattatgtattctggtatcagcaactccaaggaactcggacccctaaaactcctacactccagaaggtaaataactcaacggccggtcctacgacggggtacccctagggaacctagttcctacggtcggtcctaacccgtaaggttcctacgggccctaacccgttcgtaaaccgggtccccctttaaccccgtaccgtaaaccccgtaacgttacccggtaaggggttccgggtaccccggtttaccccggggttacccgggaagggtaccgtacgggtaaaccggggtaccctacgggttaaacctttaaggtttaccgtacgggttacgtaacccgttaacgttcccgggaaaccgggacccggtaaccttaaaacggtaggtacgggaacgttaacgaaccaacgtttcggtacggggcggtttcgggggtttaggggttaccgggtttaccgggaaccggggtaacgggtaaccccgtaaacgttaacccggggaccccgtttaccgggtacggttaacccgg

SEQ ID NO: 24997 - DNA, 611 bp, Homo sapiens
  misc_feature: GYAE6OF02IUA60.21.22.B11.1.454.CMB.1.raw
  modified_base (478)..(478): a, c, t, g, unknown or other
  misc_feature (478)..(478): n is a, c, g, or t
tcagtcgtcgctcgcacgaccggtgctcgatttagacgacagctcagggggggggaagctcagcttcagctgtggtagagaagacaggactcaggacaaatctccagcatggccggcttccctctcctcctcaccctcctcactcactgcgcagggtcctgggcccagtctgtgctgactcagccaccctcagcgtcgtcgggaccccccgggcagagggtcaccatctcttgttctggaggcaactccaacatcggaagtaattatgtattctggtatcagcaactcccaggaatcggacccccaaactcctcactccaagagaaataatcagccggccctgacgggtccctagaccgtattcctctcggctccgaagtctcggaccacctccgacgcccttccctagacctagtcgaggtcgggtcctccgggtaccgaggtatgggaacggtctaggacttacttaccgtggtcncctaagttcccggaacggggaccacgaaacgtaggtagggaactagaacctaatccgtaggtacggttcgggtttagggtcggttacgggacgggtacggaacctaaaccgtcggaacccgttcgtaggaccg

SEQ ID NO: 24998 - DNA, 674 bp, Homo sapiens
  misc_feature: GYAE6OF02HD2CQ.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaagtattatgtattctggtatcagcaactccaggaatccggacccccaaactcctacactaccgaagaggaaataactacacggccggcccgtcggacggggtcccctaggaaccgtacttccgtcgttcggccttaccgtaacgtccgtcggacctacccgttcaccgtcccttcccgtacgaaccctagtcccggtagggttccgggcccgttcccgggaccggaggtactacgggaaggtccttacgtactttaacgtttacgtcggtacgacgtaacgtccggaacggggaccactaaacgtaggtcggtaactagaaacctagttcgttaggaacgggttcgggtttaggggtcgttacggggaccgggaacgggtaaccctaaacggtcggtacccgttacggtaggtaacccgg

SEQ ID NO: 24999 - DNA, 524 bp, Homo sapiens
  misc_feature: GYAE6OF02I0OI4.21.22.B11.1.454.CMB.1.raw
  modified_base (247)..(247): a, c, t, g, unknown or other
  misc_feature (247)..(247): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaatcctcatccagaggaataatcagcggccctcgaggggtccctgaccgattcnctggctccaagtctggcacctcagcctccctgaccatcgagtcgggctccggtccgaggatggaggctggactattactgtgcatcgacgggcacaacatgggatgactatctgagtcggttggtgttcgggacggaggaaccaacgtcgaccgtccgtaggtcacgacccgaaggcctcgccccgtcggtcacgtcgtccgtccctccgtcctcctcgttctctactggcgcgggctggtcgagcgatacgcgatcnacgngncnccagcgntncg

SEQ ID NO: 25000 - DNA, 303 bp, Homo sapiens
  misc_feature: GYAE6OF02GOQ5U.21.22.B11.1.454.CMB.1.raw
  modified_base (295)..(303): a, c, t, g, unknown or other
  misc_feature (295)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggaggaccaaactgaccgtctaggtcagcccaaggctcgcccctggtcactctcgtcccgcctcctcctcgtctctactgagcgggctggcaaggcgcatagnnnnnnnnn

SEQ ID NO: 25001 - DNA, 581 bp, Homo sapiens
  misc_feature: GYAE6OF02HPT31.21.22.B11.1.454.CMB.1.raw
  modified_base (212)..(212): a, c, t, g, unknown or other
  misc_feature (212)..(212): n is a, c, g, or t
  modified_base (475)..(475): a, c, t, g, unknown or other
  misc_feature (475)..(475): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggaccccccggnaggagggtcaccatctcttgtctggaggtcaactccaacatcggaagtattatgtattctggtatcagcaactcccaggactcggacccccaaactcctacactccaagaaggaataatcagcggccctgacggggtcctgaccgtattctctcggcaccgaagtcctggcaccctcacgtcccctcctacgaccagtcacggtcgggctcccgggtcgaggtactggagtcctagtacttatactgtgcagtcgacgggacncaacgtgtggaatgactattcgtaggacggttcggggttgggtacggttcgggacggggtaacggtacccgtaaacggtccggtaacccggttcgtacgggtaccg

SEQ ID NO: 25002 - DNA, 679 bp, Homo sapiens
  misc_feature: GYAE6OF02GTKP2.21.22.B11.1.454.CMB.1.raw
  modified_base (211)..(211): a, c, t, g, unknown or other
  misc_feature (211)..(211): n is a, c, g, or t
  modified_base (307)..(307): a, c, t, g, unknown or other
  misc_feature (307)..(307): n is a, c, g, or t
  modified_base (552)..(552): a, c, t, g, unknown or other
  misc_feature (552)..(552): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaacctccaacatcggaagtattatgtattctggtatcagcaactccagatcggccccaaactccctnatccagagaataatcgagccgcctcgacggggtccctagaccgtattccgtacgtggcctacctaaaggtccttcgggaccacccttccgaacgtcccttaccccgtggaaccctataccgtacgggttcgggtaccccggttacccgggtaccgtaagggacgtggaacgggtcgttacgtaaccttaagtttacgtaggtacggaccgttactaccggggaaccggtaccacggttaaaccgngggttaacggtaacgtacgtaaccgtagtccggtagggtacgggttcggggttcgggttacgggttaccgggacgggtaaccggtaacccgtaacggttccggtaacccggttacggtaacggaccg

SEQ ID NO: 25003 - DNA, 918 bp, Homo sapiens
  misc_feature: GYAE6OF02IK5P1.21.22.B11.1.454.CMB.1.raw
tcagtcgtcgctcgcacgaccggtgctcgatttagacgacagctcaggggggggggaaggctcagcttcagctgtggtagagaagacaggactcaggacaatctccagcatggccggcttccctctcctcctccaccctcctcactcactgcgcagggtcctgggcccagtctgtgctgactcagccacctcagcgtctcggggaccccccgggcaggacgggtcaccatctcttgttctgggagccaactccaacatacggaaataattatagtattctggtactcgagactaacctacccaaggaacttaccggaccccccctaaaacgttccccactaactacccaggtaaaacgggtaaattaaaactccgtaacggcccgggtaccctacgaacggtaccgggttcccctagaaccccgtactttccgttacgtcgggtaccttacccgaacgttccgttagggtacccctaaccgttccgtaacccggtccccctttacccgtacggaaaccccttaagtcccgtaaggggtttccggggggccccctttaccccggggggtaccccggtaaaggggtacttacgggggtaaccgggtcccttttaaaggtaacccgtttttaaacttaacccgggttttggtaaccgggtacttaaaccgggtccccggaaaaccggggggtaaccccggttaaaccaaaaaccgggtttacgggtaacggggggtaactttaacccggaaacccgtaagttttacccgggggttaaggttaaaccggggggtttccggggggtttttaaacggggggtttccggggttttcccggggggaaacccggggggtaaacgggttaaacccccgtaaaaacgggttcccgggtaaacccggggttaccccgtttaaaccggggg

SEQ ID NO: 25004 - DNA, 619 bp, Homo sapiens
  misc_feature: GYAE6OF02IJ3YL.21.22.B11.1.454.CMB.1.raw
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (310)..(310): a, c, t, g, unknown or other
  misc_feature (310)..(310): n is a, c, g, or t
  modified_base (387)..(387): a, c, t, g, unknown or other
  misc_feature (387)..(387): n is a, c, g, or t
  modified_base (465)..(465): a, c, t, g, unknown or other
  misc_feature (465)..(465): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcgggacccccggnagaggtcaccatctcttgttcnggagcaactccaacagtacgaagtaattatagtattctggtatcagacaactcccaaggatcggacccccaaactccncactccagaagaataatcagcggcctcgacggggtccctgaccgattcctctggacctaccaagtctggcctacctnacgtcctaccctgaccattcgagtcgggcttacccgggcgaggacgtaggacgtctagtacttagttacctgggtacncgaatcccggaacggaccgacgtaaaccgagggttacggacgtacgaacgtatccggtaggtacggttacggggttgggggttacctcgggggaacggtaccgggtaaacctaaaccggtccgggtaacccgttacccggtagggtaaccccgg

SEQ ID NO: 25005 - DNA, 535 bp, Homo sapiens
  misc_feature: GYAE6OF02JKMZU.21.22.B11.1.454.CMB.1.raw
  modified_base (225)..(225): a, c, t, g, unknown or other
  misc_feature (225)..(225): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
  modified_base (529)..(531): a, c, t, g, unknown or other
  misc_feature (529)..(531): n is a, c, g, or t
  modified_base (533)..(535): a, c, t, g, unknown or other
  misc_feature (533)..(535): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaatcctcatccagaggaataatcagcgccctnagggggtacctgaccgtattctactggcttccaagtctggcacctcagcctccctgaccatcagtggctcggtccgaggatgaggctgactattactgtncatcacgggacnccaanatgggatgacaatctagagcggttgggtgttcgggacgagggaccaaacgtgaccgtcctaggtcgagcccgtaaggcctagacccccgttggtccacgtcctgttccccgcccttcctaccgtccgtcttcctaactcggacgcgggactcgggactacgggcgccagttacggctgcncngcncnnncnnn

SEQ ID NO: 25006 - DNA, 529 bp, Homo sapiens
  misc_feature: GYAE6OF02FWJSM.21.22.B11.1.454.CMB.1.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (390)..(390): a, c, t, g, unknown or other
  misc_feature (390)..(390): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (490)..(490): a, c, t, g, unknown or other
  misc_feature (490)..(490): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgtctggaggcaactccaacntcggaagtaattatgtattctggtatcagcaactcccaggaatcggacccccaaatcctcatccagagaataatcagccggccctgacggggtctctgaccgtattctctcggctccaagtctggccacctcagccctccngaccatcgagtcgggctcccgggtcgaggatggagtctgacttatactgtgcatccgacgggacncaacngtggatgacaagtctaggagtcgggttggngttacggcgggaggacccaagtcggtaccgtcgtaacgg

SEQ ID NO: 25007 - DNA, 666 bp, Homo sapiens
  misc_feature: GYAE6OF02GT7DV.21.22.B11.1.454.CMB.1.raw
  modified_base (310)..(310): a, c, t, g, unknown or other
  misc_feature (310)..(310): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccacctcagcgtctcggggacccccggaggagggtccaccatctcttgttctggagcaactccaacatacggaagttaattatgtattctagtatcagccaactccgagaactcggaccccaatccncactaccagagaatatcgagccgcctcgacgggtccagacctattctctcggctactacgtcgtgccctaccgtcaacgtccctcccgtacgacctacgttccgtacggggttccggtacccgttcccggggtaaccgaacggtagttacggggacgttccgttacggttaaacctttacgtttaccggttcggtacgtaacccgtacgttacccgggaacggggtaacccgtaacgaaaccgttggggtacgttaacgacgaacttacggtcttacgggcgggttacgggtttggggtcggttaccggggaccggtaacggaaccttaacggtcggtaccgttacgtagtacccg

SEQ ID NO: 25008 - DNA, 737 bp, Homo sapiens
  misc_feature: GYAE6OF02HNQ7S.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnagagggtcaccatccttcttgttctggacggcaactccaacagtacggaagtaattatgtattctggtatcagcaaccgtccaaggaactccggaccccaaactcctacactaccaaggaaggtaaactaactcgaacggcccggtacccgtacggaccggggttccctacgtaccgtactttccgtcgtacggtctaccgtaacggtccgtcggaccctaccctacgccgtccctacccgtacgaacccctagttcccgtagggttccgggccggtttaccccgggtacggaaggggtacttacggggaacggttccctaaggttaacccttaagtttaccgtggtacgaccgtaacgggtccgaaccgggggtaactaaccgaaacggttccggtaagggtacttaacgaacctaaggtttccgtagggttaacggtccgggggttttgggtaccgggtttaccgggacggggaacgggtaaccctaaccggggttccgtaacccgttccggtaaggtacccg

SEQ ID NO: 25009 - DNA, 609 bp, Homo sapiens
  misc_feature: GYAE6OF02H43T7.21.22.B11.1.454.CMB.1.raw
  modified_base (377)..(377): a, c, t, g, unknown or other
  misc_feature (377)..(377): n is a, c, g, or t
  modified_base (504)..(504): a, c, t, g, unknown or other
  misc_feature (504)..(504): n is a, c, g, or t
  modified_base (575)..(575): a, c, t, g, unknown or other
  misc_feature (575)..(575): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacagtcggaagttaattatgttattctggttatcagctaactacccaggaactcggaccccctaaactcctacacgtccagaaggaataaactcagcccgccctcggacggggtccctagacccgtattccncgtcggccttaccgaagttccgtggtaccacctcgaccgtccctacccgtacgaccctaatccgagggttccgggtccctcccgggtaccggtaaggacttgggacgtccgtgaaccttagttaccnggtcacacgtaccgacggggacacaagagtggaactgaactatcgtggacggttcgggttgggtagcgggnggaacggaccaacgtcggacgttccgtaggtccg

SEQ ID NO: 25010 - DNA, 793 bp, Homo sapiens
  misc_feature: GYAE6OF02HWGN5.21.22.B11.1.454.CMB.1.raw
  modified_base (275)..(275): a, c, t, g, unknown or other
  misc_feature (275)..(275): n is a, c, g, or t
  modified_base (507)..(507): a, c, t, g, unknown or other
  misc_feature (507)..(507): n is a, c, g, or t
  modified_base (781)..(781): a, c, t, g, unknown or other
  misc_feature (781)..(781): n is a, c, g, or t
  modified_base (790)..(791): a, c, t, g, unknown or other
  misc_feature (790)..(791): n is a, c, g, or t
tcagtcgtcgctcgcacgaccggtgctcgatttagacgacagctcagggtcctgggcccgacgtcctgtgctggactcagccacctccacgccgtctcgggaccccgggcgacggacggggtcaccgactcgtcttcgttctggtaggcaacgtccaaccatcggaagtaacttatgtattctggtatcagcaactccaggaatcggaccccaatcctccactccagaggaactaatccaaggcgacccgtaagggggttccctagaacccggtnttaccgttcgtcgggactacccgtaaggttcctacgggacctacctaccgtaagaccccttcccgtaccgaacccgtatcccgtaacgttcggggaacccttccggtaccccggggaaggtacggttcggacggtccggtacggtacctttaacggttaaccgttttaggccggacttaacgaccgtacggggaaccggcaaacccgtagggacgggtaacgtgaaccgtanaccgtggtaaccggttggttcggggttagggtttccggggaagggttacgggggaaccgtaacgggtacggtacggtaccggtacggacggtacgtaaccggacggtaccgccggtacccgtcgggtacccgtactaccggttacgtccccgttaccgtacccttccgggtaacccgtccgtaccgtaccggtaccgaccggtccgggtaccgggcgtaacccgggtaggcccgggaccgttacgacggtccgtaacggcaacggccagcggcncggatcgcnncg

SEQ ID NO: 25011 - DNA, 688 bp, Homo sapiens
  misc_feature: GYAE6OF02GS3JW.21.22.B11.1.454.CMB.1.raw
  modified_base (213)..(213): a, c, t, g, unknown or other
  misc_feature (213)..(213): n is a, c, g, or t
  modified_base (505)..(505): a, c, t, g, unknown or other
  misc_feature (505)..(505): n is a, c, g, or t
  modified_base (624)..(624): a, c, t, g, unknown or other
  misc_feature (624)..(624): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccgggnagagggtccaccatctcttgttctggaggcaactccaacatcggaagtaattatgtattcgtggtatcagcaactcccaaggaatcggacccccaaactcctacactccagagaataatcagccggccctgaccgggtccctgaccgtattccgtctcggctaccgtaacgtcgtacggcctaacccgtcgaacgtcccctccctacgaccctagtccgtaacggtcgggtccctcccggggtacggaggtactggggtacgtcgttacggtaaccttactttacgtcggtnaccgttacgaccggtaaccggggaacctaaccgtaaacgtagggtacgggtaaataccgaaccgttaatccggttagggtacgggttcgggggttttacggggtcgggttaacccgggnggggtaaacccggaaacccgttaaacggtcccgggtaacccggttacggtaaacgggtccccgg

SEQ ID NO: 25012 - DNA, 592 bp, Homo sapiens
  misc_feature: GYAE6OF02IMJXA.21.22.B11.1.454.CMB.1.raw
  modified_base (352)..(352): a, c, t, g, unknown or other
  misc_feature (352)..(352): n is a, c, g, or t
  modified_base (472)..(472): a, c, t, g, unknown or other
  misc_feature (472)..(472): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggcaggagggtcaccatctcttgttctggaggcaactccaacatcggaagtaattatgtattctgtatcagcaactccagatcgaccccaaactctcactccagagaataatcgagccgcctcgacgggtccctagaccgtnttacctcgtcggtacctccaagttctggaccacccttcgacgtccctccctcgaaccctatcgaacggtcgggcctacccgggtcgacggtagtacggaggtctagaactttatcgcgtnacgtatacggaccggtacgacaacgtagtaggattagaactatcgtaggtaaggtcgggttgggtcggttacggacgggtaacggaaccgtaagtaccggtaccgttaccgtaggtaccg

SEQ ID NO: 25013 - DNA, 619 bp, Homo sapiens
  misc_feature: GYAE6OF02GFTVO.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaacatcggaatatatgtattctggtatcagcaacctccaggaatcggcccccaaatcctcactccaagaggaataatcagccggccctcgacggggtccctagaccgtattcctcgtcggccttaccgaagttctacggccacccttcgaacgtccctccctgtacccattcgacgtcgggcctccgggtcgaggactggaagtcttacggacttacgttctgtagcctagttccggaaccgggggactaccgtaaaccgtagtcggggaattacgaaccgtaattccgtaggacgggttcggtttcggggttacggttcgggacgggtacgggtaaccctaaacggttcggtaacccggttaccgtaggtacccg

SEQ ID NO: 25014 - DNA, 666 bp, Homo sapiens
  misc_feature: GYAE6OF02HVQFC.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnaggacgggtcaccatctcttgttctggagcaactccaacatcggaagttaattatgtattctggtatcagcaactcccaaggtaactcggaccccctaaactcctcactccagaaggaactaactcacgccggccctacgacggggtccctgaccgtattcctcgtcggcctaccgaagttctcggccacctcaccgtcccttcccagaaccctagtaccgagggttcgggccctttcccggggacgaagggtatcgggacggtcctacggtaacttagtttacctgggtacaccgtacgtcccggaacggggtaccacgaaacgcggttagggaattcggaactagtttcggagggtaacgggtttccggggtttggggtacggttaccggggacggggtaaccgggtaacccaaaccggtttccggaaccccggtttccggaagggtaccccg

SEQ ID NO: 25015 - DNA, 598 bp, Homo sapiens
  misc_feature: GYAE6OF02JJ1BL.21.22.B11.1.454.CMB.1.raw
  modified_base (354)..(354): a, c, t, g, unknown or other
  misc_feature (354)..(354): n is a, c, g, or t
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (591)..(592): a, c, t, g, unknown or other
  misc_feature (591)..(592): n is a, c, g, or t
  modified_base (594)..(594): a, c, t, g, unknown or other
  misc_feature (594)..(594): n is a, c, g, or t
  modified_base (596)..(598): a, c, t, g, unknown or other
  misc_feature (596)..(598): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggccacctcagccctaaccctgacccatcaggtcgggcctcccgggtccgaggacgtggggcctggacttattactgtgcatcgacgggacncaacgagtggggatgaacaagtcgtggaggtcgggtttggggtcggttcgggcgggacgggaaccaaacgtcggacccgttcgtacggtcacggacccgaacggtcccgtaccccgtccccgttcggtccgtaccgtccgttcccgttccccgtcccgtcccgttccgtccgttcctacctacgtcggacggtccggtcgtacggacgacggaccgactacgtagcgncgcnagcgnngncnnn

SEQ ID NO: 25016 - DNA, 585 bp, Homo sapiens
  misc_feature: GYAE6OF02FOXFD.21.22.B11.1.454.CMB.1.raw
  modified_base (565)..(565): a, c, t, g, unknown or other
  misc_feature (565)..(565): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(574): a, c, t, g, unknown or other
  misc_feature (573)..(574): n is a, c, g, or t
  modified_base (577)..(577): a, c, t, g, unknown or other
  misc_feature (577)..(577): n is a, c, g, or t
  modified_base (581)..(584): a, c, t, g, unknown or other
  misc_feature (581)..(584): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgacggggtccctgaccgattctctggctccaagtctggccacctcacgccctccctgacccatcagtcgggctccggtccgaggatggaggctgactattactgtgcatcgacgggacacgaaaagtggggatgaacaatcgtaggagtcggggtttgggtcggttcgggcgggaacgggaaccaacgtcggtacccgtccgtaggtcgacgacccgaacgggcctaccggcccccgtcggtccaccgttcgttccgttccccaccccttccctcccgttccgtccttcctacgtcggacgtccgggtcgtcggaccgaacgggccgtacagtacgngacngncnncgntcgnnnnc

SEQ ID NO: 25017 - DNA, 531 bp, Homo sapiens
  misc_feature: GYAE6OF02FZACA.21.22.B11.1.454.CMB.1.raw
  modified_base (210)..(210): a, c, t, g, unknown or other
  misc_feature (210)..(210): n is a, c, g, or t
  modified_base (306)..(306): a, c, t, g, unknown or other
  misc_feature (306)..(306): n is a, c, g, or t
  modified_base (353)..(353): a, c, t, g, unknown or other
  misc_feature (353)..(353): n is a, c, g, or t
  modified_base (382)..(382): a, c, t, g, unknown or other
  misc_feature (382)..(382): n is a, c, g, or t
  modified_base (406)..(406): a, c, t, g, unknown or other
  misc_feature (406)..(406): n is a, c, g, or t
  modified_base (427)..(427): a, c, t, g, unknown or other
  misc_feature (427)..(427): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcaactccaacatcggaagtaattatgtattctggtatcagcaactcccaggaatcggacccccaaatccncatccagagaataatcagcgcctcgacggggtccctgaccgtattcnctggctcaagtctggcactcagccctccngacatcgaggtggctccggcgagntggacggctgactattactgncacgtcgaacgggcacaacgagtggatacgaacagtccagggcgtacgggtttgggtcgttcgggacgggacggtaacccaaagttcgaccggttcgagtaccg

SEQ ID NO: 25018 - DNA, 761 bp, Homo sapiens
  misc_feature: GYAE6OF02F8HJU.21.22.B11.1.454.CMB.1.raw
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccatcctcagcgtctcgggacccccgggnaggaggtccaccatctcttgttctggngcaactccaacatacggaagtaattatgtattctgtatcagacaactcccgaggactcggacccccaaactcctacactccagagaataatcagccggaccctcgacgggtccctagaccgtattcgtcgtggcctaccgtaagtcgtcggcctaccctcgaccgtccccttcccgtacggaaccctagtaccgtacgggttccgggtacccgttccccggggttacccggaagggtacgttacggggaacgggttccgttaacggtaacctttaacgttttaccgttacggttaccgtaccgtaacgttacccggggaaacccgggggaaccgtaaccgtaaaacgttagggtacggggtaattaaccgggaaccttaaacggttccggttaacgggtaacgggggtttccggggtttagggggttaccgggtttacccgggggtaaccgggggaaaccgggttaaaccccggtaaaaccgggtttcccgggtaacccccgggttttaccggtaacccgggg

SEQ ID NO: 25019 - DNA, 724 bp, Homo sapiens
  misc_feature: GYAE6OF02HMUWO.21.22.B11.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcacgcgtcgtcggggaccccccgggcaggagggtcaccatctcttgttcgtggaggacaactccaacatcggaagtaattatgtattctggtatcgagacaacctccgaaggaactccggaccccctaaactcctcactaccgaaggaagtaataancgacgccggcctacgacggggtccctaggaccgtattccgtcgtcggcctaccgtaagtccgtacggccctacccgtccgacccgtcccttccccgtacggaacccctagtaccgtacgggtcggggtacccgttcccgggtacggaacgggtagtacgggtacggtaccttaggttaacctttaacgttaccggttggtacaccgtacgttacccgggaaccggggacctaaccgtaaaccggtaggtacgggtaattacgaaccgtatccggttagggtacgggttacggggtttggggtaccgggttaccggggacgggaacggggtaaccctaaacggttcccggtaacccggttaccggttaggtacccgg

SEQ ID NO: 25020 - DNA, 311 bp, Homo sapiens
  misc_feature: GYAE6OF02FUIYM.21.22.B11.1.454.CMB.1.raw
  modified_base (300)..(311): a, c, t, g, unknown or other
  misc_feature (300)..(311): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccgccctcctcctcgtctctactgagcgggctggcaaggcgcaatagnnnnnnnnnnnn

SEQ ID NO: 25021 - DNA, 690 bp, Homo sapiens
  misc_feature: GYAE6OF02JU8LY.21.22.B11.1.454.CMB.1.raw
  modified_base (214)..(214): a, c, t, g, unknown or other
  misc_feature (214)..(214): n is a, c, g, or t
  modified_base (613)..(613): a, c, t, g, unknown or other
  misc_feature (613)..(613): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctcgggcccagtctgtgctgactcacgccaccctcagcgtcgtcgggacccccgggnaggacgggtcaccatccttcttgttcgtggacggcaactccaacatacggaagtaattatagtattctggtatcagtcaactcccgaggaactccggaccccctaaactcctacactaccaaggagaataactacgacgccggtccctaggtaccgggtccctacgaccgtcttacgtccgtcggtacctactaacggtcgttaccggacctacccgtacgaccgtcccttacccgtcgaaccctacttccgggaggttaccgggtccgtttacccggggaccggtaaggtacgtcggacggtcttaccgtaactttaacgttccggtgtacggtaccacggtccggaacggggaccacgtaacgagggtacggtaacgataaccgtacgtgtacgggngggttcggttacggggtcggttacggggtacggaacggtaccgtaaaccgtcgggtacccgttaccggtaggtccgg

SEQ ID NO: 25022 - DNA, 585 bp, Homo sapiens
  misc_feature: GYAE6OF02HLJVA.21.22.B11.1.454.CMB.1.raw
  modified_base (211)..(211): a, c, t, g, unknown or other
  misc_feature (211)..(211): n is a, c, g, or t
  modified_base (396)..(396): a, c, t, g, unknown or other
  misc_feature (396)..(396): n is a, c, g, or t
  modified_base (476)..(476): a, c, t, g, unknown or other
  misc_feature (476)..(476): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactcccaggaactcggacccccaaactcctcactccagaggaataatcagccggccctcgacggggtccctgaccgtattctctggctccgaagtctggccacctcacgcctccncgaccatcaggtcgggcctccgggtcgaggatggacggctcgtacttattacgtgtcgctatccgacgggacacgaacgngtaggaatcgaactacgtcgtacggtacgggtcgggtttgggtacggttccgggacggggaacgggtaacccgtaaacgttcgggtaaccccggttcgtacggtacccg

SEQ ID NO: 25023 - DNA, 647 bp, Homo sapiens
  misc_feature: GYAE6OF02HNQCQ.21.22.B11.1.454.CMB.1.raw
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccgggnagagggtcaccatctcttgttctggagcaactccaanatcggaagtaattatgtattctggtatcagcaactccaggactcgaccccaactcctacatccagaggaataactcacgccggccctcgacggggtccctgaccgtattcctcgtcggcctaccgaagtcgtcggccaccctaccacgtccctcccgtacgaccctagttccgaggttccggggccttccccggggtaccggaagggtacgtcggacggtcctacgtaactttaacgttacgtggtacgacctacggttccgaaccggggacgaaccgaaacgtagggttacgggaattacgaactagttcgtaggacgggttcggggtttggggtcggttacggggacgggtaacggtaacccaaacggttccggaacccggttccgtaggtacccg

SEQ ID NO: 25024 - DNA, 715 bp, Homo sapiens
  misc_feature: GYAE6OF02JT006.21.22.B11.1.454.CMB.1.raw
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (605)..(605): a, c, t, g, unknown or other
  misc_feature (605)..(605): n is a, c, g, or t
tcagtcgtcgctcgcacgaccggtgctcgatttagacgacagctcaggggggggaaggcgtcagcttcagctgtggtagagaagacaggactcaggacaatctccagcatggccggcttccctctcctcctcaccctcctcacctcactgcgcacgggtcctgggcccagtctgtcgctgactcagccaccctnagcgtctcgggacccccggnaggacgggtcaccatctcttggttctagggagctaactccaaacacgtacggaaacgttaattatagttatttctggttaactcagcctaactcccgaaggaactccggaccccctaaaactcctacaacgtccaaggaacggtaataactcaacggccgacccgtacgacggggtcccacggaccgtattccgtctggacctacgaacgtctacggacctacgcctaagtccctacctgaccctatcgacgttcgggcttacccgggtacgacggtactggggaacgtcgtacgtaaccttaacgtttccgtggtacgtacgtaccgttacccgggaaccggggtaacctaaccgaaaattcgggtaacgggaactttcgaaaccgttanccggtttaagggccgggtttaggggttttcggggtaacggtttaccgggggaaccgggtacccgggttaaacaaacccgggttcggtaccccgtttgggaaacccggtcg

SEQ ID NO: 25025 - DNA, 685 bp, Homo sapiens
  misc_feature: GYAE6OF02GCA0L.21.22.B11.1.454.CMB.1.raw
  modified_base (210)..(210): a, c, t, g, unknown or other
  misc_feature (210)..(210): n is a, c, g, or t
  modified_base (334)..(334): a, c, t, g, unknown or other
  misc_feature (334)..(334): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagaggtcaccatctcttgtctggaggcaactccaacatacggaagtaattatgtattctggtatcagacaacctcccgaaggaactccggacccccaaactcccacactccaagaagaaataancagccggtccctcgacgggtcctgaccgtattctcgtggctaccgaagtcgtacggcctacctcacgtccctccctacgaccactcgaggtcgggccgtccgggtaccggaggagtcggacggctaggtaacttacgttactggtacgacgtacgtaccggaacgggaaccgtacgaaaccgtaaggtacggggtaatacggaaccttaacgttaccggtagggtaacggggttaccgggggttttcgggggttaccggggtttacccgggggacggggtaaaccggggtaacccgttaaaaaccgggttcccgggtaaccccgggttacccggtaaccgggttaacccgg

SEQ ID NO: 25026 - DNA, 606 bp, Homo sapiens
  misc_feature: GYAE6OF02GFJ8P.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactcccaggaactcggacccccaaactcctcactccagagaataatcagccgcctcgacggggtccctagaccgattcctcgtcggcctaccaagtctcggccacctcacgccctccctacgaccatccgaggtcgggccgttcccgggtccggaggtacgtggacggtcctgaccttattacgtgtcgctagtccgaacgggtacactaaacgtggtacggatacgaactacgtcgtaggacgggttcgggtttcggggtacggttccggggacgggtaacgggaacccgtaaagtccggtaacccggtaccgtagggtacccg

SEQ ID NO: 25027 - DNA, 706 bp, Homo sapiens
  misc_feature: GYAE6OF02G1JTB.21.22.B11.1.454.CMB.1.raw
  modified_base (214)..(214): a, c, t, g, unknown or other
  misc_feature (214)..(214): n is a, c, g, or t
  modified_base (433)..(433): a, c, t, g, unknown or other
  misc_feature (433)..(433): n is a, c, g, or t
tcagtcgtcgctcgcacgaccggtgctcgatttagacgacagctcaggggggggggaagctcagcttcagctgtggtagagaagacaggactcaggaccaatctccagcatggccggcttccctctcctcctcaccctcctcactcactgcgcagggtcctgggcccagtctgtgctgactcagccaccctcagcgtctcgggaccccccgggnagagggtcaccatctcttgttctggaggcaactccaacatcggaagtaattatgtattctggtatcagcaactcccaggaactccggacccccaaactccctcactcgaaggaagtaataactcgacgcccgtccctacggtcggggtccctggacctacttctcgtcgtctacctaagtctcggacctacctcaccgtccctacccgtacgtaacccnttacggtacggtcgggtcccgttacccggggaccgagggtactcgggaacggtccttagaacctttaacttgtcggtacgaccacgttaccgggaacccgggacctacaaaccggtaggtacggggtaaactcggtaaacctaggttccggtagggtcggggtaccgggggtttttcggggacgggtttcccgggggaaaccgggttaacccggggaaacccttaaaccgggtttcggggtaaccccccgtttacggtaaccggtaacccggg

SEQ ID NO: 25028 - DNA, 390 bp, Homo sapiens
  misc_feature: GYAE6OF02HLPSY.21.22.B11.1.454.CMB.1.raw
  modified_base (195)..(195): a, c, t, g, unknown or other
  misc_feature (195)..(195): n is a, c, g, or t
  modified_base (308)..(308): a, c, t, g, unknown or other
  misc_feature (308)..(308): n is a, c, g, or t
  modified_base (310)..(311): a, c, t, g, unknown or other
  misc_feature (310)..(311): n is a, c, g, or t
  modified_base (313)..(316): a, c, t, g, unknown or other
  misc_feature (313)..(316): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (326)..(390): a, c, t, g, unknown or other
  misc_feature (326)..(390): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaaacatgggatgacaatctgagcggtggtgtcggacggnggaccaaagtgacctcaggtcagcccaaggctgccccctggtccacgtctcgttcccacccttcctcctcgtctcctactgacgcgggctcggaccaaggcgacacgttaggnanncnnnngngngngngnnnnnnnnnnnnnnnnnnnnnnnnnnnnnnnnnnnnnnnnnnnnnnnnnnnnnnnnnnnnnnnnn

SEQ ID NO: 25029 - DNA, 706 bp, Homo sapiens
  misc_feature: GYAE6OF02JZB3D.21.22.B11.1.454.CMB.1.raw
  modified_base (155)..(155): a, c, t, g, unknown or other
  misc_feature (155)..(155): n is a, c, g, or t
  modified_base (220)..(220): a, c, t, g, unknown or other
  misc_feature (220)..(220): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgacagctcaggggggaaggcgtcgagcttcagctgtggtagagaagacaggactcaggacaatctccagcatggccggcttccctctccctctaccgaccctcctcactctacctgcnccgagggtcctcgggcccagtctgtgctgactcagccaccgtcagcgtctcgggaccccccgggnacggagggtcacccagtcctcttggttccnggtaggccaaacgttccaactatacggaacgttaaattagtatattactcggtagttacctagactaacctacccgtaggaactggaccccctaaaccgtccaactctaccgagaaacggtaaactaactaccgacgtacccggaccctcgggtaacccggtccgtacgggtaccctaagtcccgttacgtccgtccgtaactaccgttacgtcgggaccctaccgtcaccgtccctacccgttcaccctacgttccaggttcgggaccctttcccgggtacccgtaggaaccgttgggacgttaccgtacgtaccttaagttaccgtaggtcgaacgttcacggtacgaccgtcaaacgtcgtagacgagtccaagtgtaccggagttcccggaagggttcgtttccgggacgggtacgtaccggaaagtccaaccggttaccgtaggttacccg

SEQ ID NO: 25030 - DNA, 577 bp, Homo sapiens
  misc_feature: GYAE6OF02GXW25.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcaggacgggtcaccatctcttgttctggagcaactccaacatcggaagtaattatgtattctggtatcagcaactcccaggaatcggaccccaaactcctcactccagaggaataatcagcggccctcgacggggtccctcggaccgtattcctctcggctaccgaagtctggccacctcacgccctccgtacgacccatcgaggtcggctcccgggtccgaggagtcggaggcctagtactattactgtcgctacgtcgacgggacgacaagtacgtggtaactcgaactatccgtaggaggttcgggttagggtcgttcggggcggaacgggtacgtaacgtacggtaccgttcggtagtacccgg

SEQ ID NO: 25031 - DNA, 559 bp, Homo sapiens
  misc_feature: GYAE6OF02INFQW.21.22.B11.1.454.CMB.1.raw
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (552)..(554): a, c, t, g, unknown or other
  misc_feature (552)..(554): n is a, c, g, or t
  modified_base (556)..(558): a, c, t, g, unknown or other
  misc_feature (556)..(558): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactccaggaatgccccaaatcctcatccagagaataatcagcgcctcagggtccctgaccgattctctggctccaagtctggcacctcagcctcctgaccatcagtcgggctccggtccgaggatgaggctgactattacngtgcatcgacgggacncaaacagtagggatgaactaatcgtgacgtcgggtttagggtcgttacgggcgggaagggaaccaaacgtcggaacccgtcgtaaggtcaacgcccgaaaggcctaccggtccccgtcggtccacttccgtcgttccccacccttcctccctccgtcctcctacgtcgacggtccgggtctcgggacaacgggtcgacgacgtaaggctacgntcgngcncnnncnnnc

SEQ ID NO: 25032 - DNA, 639 bp, Homo sapiens
  misc_feature: GYAE6OF02J3ITE.21.22.B11.1.454.CMB.1.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (290)..(290): a, c, t, g, unknown or other
  misc_feature (290)..(290): n is a, c, g, or t
  modified_base (403)..(403): a, c, t, g, unknown or other
  misc_feature (403)..(403): n is a, c, g, or t
  modified_base (611)..(611): a, c, t, g, unknown or other
  misc_feature (611)..(611): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(634): a, c, t, g, unknown or other
  misc_feature (633)..(634): n is a, c, g, or t
  modified_base (638)..(639): a, c, t, g, unknown or other
  misc_feature (638)..(639): n is a, c, g, or t
tcagtcgtcgctcgcacgaccggtgctcgatttagacgacagctcagggtcctgggcccagtctgtgctgactcagccaccctcagcgtctcgggaccccgggcagagggtcaccatctcttgttctggaggcaactccaacatcggaagtaattatgttattcgtggtatcacgcaactccgaggactccggaccccaactcctcactcgaagagaatacncgacgccgccncggtcgggtcctcgaccgtcttctcgtcgtcctaccgagtccgtcgacctccgtacnccgtaccctccgttacgactacgtcgtacgggtcggtaccggtccgggtacgaggtagtcggacgtcgtactaacgttactcgtagactcgacgtcggacggacacagtaggngtacagactacgagtggtacggtccgggtagggttacggcgggacggtaaccgtacctaacggaccgtccggtacgtaccggaccgtccgaccgtaccgtccgtcccgtccgttacccgtccgttacctcccgttaccctaccccgtcccgtcgttccctacggtccgtacggaccggtcgggcgtacggtccggacgtaccgacgtncgagcncncncncncncncncnncgcnn

SEQ ID NO: 25033 - DNA, 562 bp, Homo sapiens
  misc_feature: GYAE6OF02HEUMB.21.22.B11.1.454.CMB.1.raw
  modified_base (332)..(332): a, c, t, g, unknown or other
  misc_feature (332)..(332): n is a, c, g, or t
  modified_base (349)..(349): a, c, t, g, unknown or other
  misc_feature (349)..(349): n is a, c, g, or t
  modified_base (556)..(562): a, c, t, g, unknown or other
  misc_feature (556)..(562): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagccggccctcgacggggtccctgaccgattctctggctccaagtctggccacctcacgcctccctgaccatcagtcgggctccgggtccgaggatggagctgactatactgtncatcgacgggcacaacngtgggatgacatcgtgagtcggtttgggcgttcgggcggagggaccaacgtcgaccgtcgtaggtcacgacccgaggcctccgccccgtcggtccaccgttcctccgttccccaccccttccctcccgttccgttccttccgttaccgtcggtaccggccgggtcgtcgggacgaacgggccgactacgtcggcacgcgactgactnnnnnnn

SEQ ID NO: 25034 - DNA, 731 bp, Homo sapiens
  misc_feature: GYAE6OF02IZ4S5.21.22.B11.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctccttcactcactgcgcagggtcctgggcccagtctgtgctgactcagccaccctcagcgtctcgggacccccggnagagggtcaccatctcttgtctggagcaactcaacntcggaagtaattatgtattcgtggtatcagccaactcccaggaactcggacccccaaaactcctcactcccaagacggaataatcagccggtccctagaccggggtccctagacccgtattccgtacgtcggaccttccgaacgttcgtcgggcctacccgttccgaacggtccccttcccccgttaggaaacccctagttacccgtaacggggttccggggacccttccccggggttaccgggaacgggtaacttcggggaaacgggttcctttacggtaaccgtttaacttttacccgtgggttaccgaccgtaaccttaccggaaccgggggtaaccgacgtaaaccgttaaggttcggggaaccttagggaaacccttagtaccgtggtaacgggttcggggtttacgggttcggttacggggaccggtacggggaaccctaacgttccgggaaccccggtttaccgtaagggtacccg

SEQ ID NO: 25035 - DNA, 883 bp, Homo sapiens
  misc_feature: GYAE6OF02HTWR1.21.22.B11.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagacgacagctcaggggggggggaagctcagctttcagctgtggtagagaagacaggactcaggacaatctccagcatggccggcgttccctctccctcctctaccctcctcactcactagcgcagggtcctgggcccagtctgtgctgactcgagccaccctcagtcgtctcggggaccccggnagacgggtcaccgatctcgttcgttcgtggagcaactccaagactcggaacgtattactgtattctggtactcgacgacaaccgtcccgaaggtactccggacccccctaaacgtcctaccacctaccgaaggtacggtaaactaacgttccgacggtcccggacccgtacggtaccgggggttacccctcggtaacccggtacctttacgtcccggtcgggtaccctaacccggtaacgtttccgttaccgggacccttaaccggtacccgaccggtacccccttacccggtaccggaacccgttacgtacccgggtaacgggttacggggtacccggttaccccgggtaccggtacgggacgttacgggaacggttcttacggtaaacctttagtttaacccggttaggtacccgtaccgttaacgggaaccccggtaccggggtaaaccgtaaccggaaacggttacgggttaacgggggaaaccttttaccggaaacctttacggttaccgttaaaggggggtccgggttttaaccggggggttttacgggggggtacgggtttaaccccggggggacggggtaaaccggggaaaccccgttaaacccggggtttaaccggttaacccccggggtttaccggttacggggttaaaccccgg

SEQ ID NO: 25036 - DNA, 315 bp, Homo sapiens
  misc_feature: GYAE6OF02FNVPQ.21.22.B11.1.454.CMB.1.raw
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (300)..(315): a, c, t, g, unknown or other
  misc_feature (300)..(315): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctgttccccgccctcctccgagcgacgactgagcgggntggcaggcncatagnnnnnnnnnnnnnnnn

SEQ ID NO: 25037 - DNA, 603 bp, Homo sapiens
  misc_feature: GYAE6OF02G0HXX.21.22.B11.1.454.CMB.1.raw
  modified_base (211)..(211): a, c, t, g, unknown or other
  misc_feature (211)..(211): n is a, c, g, or t
  modified_base (503)..(503): a, c, t, g, unknown or other
  misc_feature (503)..(503): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactcccaggaatcggacccccaaactcctcactccagaagaataatcagccgccctcgacggggtccctagaccgtattcctcgtggcctaccgaagttcctggccctaccctcacgtccctccctcgacccatccgaggtcgggcctcccgggtccgaggctggaggtcctaggtaccttattaccgtggtcgactagtccgaacggggtacaccaaacgngtacgggaatcgaactactcggtaggacgggttcgggtttggggtcggttcgggacgggtaacggaacctaaaccggtcggacccgttacgtagggtacc

SEQ ID NO: 25038 - DNA, 598 bp, Homo sapiens
  misc_feature: GYAE6OF02HZXM4.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccggnaggagggtcaccatctcttgttctggagcaactccaacatcggaagtaattatgtattctggtatcagcaactcccgaggaactcggacccccaaactcctcatccgagaagtaataatcacgccggccctcgacggggtccctggaccgtattctctggcctaccgaagtctcggacctacctcacgtccctccctgaccctatcaggtcggccgtccgggcgaggtatcggaggctagactttatacgtgtagctagtaccggacggtacacaaacgtgtgggaatcgaactagttcgtaggacgggttcggggttgggttcggttaccgggcgggtaacgggaaccctaaacggttcgggaacccgtttccggtaggtacccg

SEQ ID NO: 25039 - DNA, 716 bp, Homo sapiens
  misc_feature: GYAE6OF02GHR2W.21.22.B11.1.454.CMB.1.raw
  modified_base (210)..(210): a, c, t, g, unknown or other
  misc_feature (210)..(210): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtattatgtattctggtatcagaaactcccaggaatcggcccccaaatcctcatccagaggaataatcagcgcctgacgggtccngaccgattcnctggcctacgaagtctcggccacctcgacgccctccctagaccctatccgaacgggtcggggcccgttcccgggtaccgggacggtacgtcggacggtccgtagtaaccttagttaccgtggttaccgacgtaacgtaccggaaccggggtaccgaccgtaaacgtagggtacgggggaaacttacgggaacccgttaacgttaccgtacgggtaacgggttcccgggggggtttttaggggttcggggttttaacccgggggcccgggggtaaaccggggtaaaccccccgttaaaacggggtttaccccggggtaaccccgggttttcccccgggttaacgggggttcccccgtaaacccgggg

SEQ ID NO: 25040 - DNA, 708 bp, Homo sapiens
  misc_feature: GYAE6OF02G93OT.21.22.B11.1.454.CMB.1.raw
  modified_base (211)..(211): a, c, t, g, unknown or other
  misc_feature (211)..(211): n is a, c, g, or t
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnaggagggtcaccatctcttgttcgtggaggccaactccaacagtcggaaagttaattatgttaatttcgtaggttactcagactaaacctcccgaaggaatccggacccccaaactcctacactccgagaagaatancacgccgcctgacgggtcccngacgtnttcncgtcgtctacgaagtcncggcctaccctcgacgtcccctcctacgtaccagtcgacgggttccggccgttacccgggtccgaaggtcgtcggaacggtccttacggtaaacctttacgtttaccgttaggtaccgtacccgtacgggtaaccggacccggggaactaacccgtaaaagttacggggtaagggacttaagggaaacctacgtttagggtcggtaacggggttccgggggtttaaggggtccgggttacccgggggaacgggaacgggttaaaccccgtaaacggttcccgggtaaccccggttacggtaggtaaccccgg

SEQ ID NO: 25041 - DNA, 660 bp, Homo sapiens
  misc_feature: GYAE6OF02ISNS4.21.22.B11.1.454.CMB.1.raw
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (247)..(247): a, c, t, g, unknown or other
  misc_feature (247)..(247): n is a, c, g, or t
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (402)..(402): a, c, t, g, unknown or other
  misc_feature (402)..(402): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctnagcgtctcgggacccccgggnagnggtccaccatctcttgtctggagcaactccaanagtcggaagtaattatgtattcgtgtatcagcaactcccaggatcggacccccaatcctcatccgagaggtaaatatcagccggccctgacggggtccncgacgtacttcnctggctaccgagtcnggccactccacgtccctccctgtaacccngtccgaggtcgggcccttccgggtacgaacgggtctaggacggtcttacgtacttacgtttcagtggtaccaggttaccggaaccggggtctaaccgaacgtaaggttacgggaactacgtaactacgttactcggggtaacggtttacggggggtttcgggttaccgggttaccggggggaacccggttaaacgggggtaaccccttaaacggttacccggggtacccggtttaaccccggtagggttacccccggg

SEQ ID NO: 25042 - DNA, 667 bp, Homo sapiens
  misc_feature: GYAE6OF02H3KG1.21.22.B11.1.454.CMB.1.raw
  modified_base (209)..(209): a, c, t, g, unknown or other
  misc_feature (209)..(209): n is a, c, g, or t
  modified_base (255)..(255): a, c, t, g, unknown or other
  misc_feature (255)..(255): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccggnagagggtcaccatctcttgtctggaggcactcaacatcgaagtatntgtatctgtatcagcaactcccaggactcggccccaatcctcactccgaagacggaatatacgagccggaccctagacggggttccctagtaccgtattcctctggcctacctaacgtctacgggcctaacccttccgacgtccccgtcccgtcgaaccctagttccacgggttcgggcccgttccccgggtaacggaaggtacttgggacggaccgttgaaccttaagtttacctggtaccgactaacgtccggaacgggtaccgtccgtaaaacgtcgggtacggtaagttaccgaacctaacgttcggtagggtccggttaccggggttgggttccgggttacgggaacccgggtaagggtaacccctaaacggtccgggtaccccggtttaccggtagggttaacccg

SEQ ID NO: 25043 - DNA, 650 bp, Homo sapiens
  misc_feature: GYAE6OF02J22BR.21.22.B11.1.454.CMB.1.raw
  modified_base (211)..(211): a, c, t, g, unknown or other
  misc_feature (211)..(211): n is a, c, g, or t
  modified_base (252)..(252): a, c, t, g, unknown or other
  misc_feature (252)..(252): n is a, c, g, or t
  modified_base (559)..(559): a, c, t, g, unknown or other
  misc_feature (559)..(559): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccgggnaggagggtccaccatctcgttgtctggacgcaactccaacntacggaattaatatgtattcgtgtatcagacaacctccgaggtaactccggaccccaaactcctacactccgaagaacggtaaataacgtcgacgtccggtaccctacggtaaccggggtcccctaggacccgtattccgtcggtacggcctaccgtaagtccgtaggcctaacctcgacgtcccctccctacggaccctactcgtagggttccggcccgtaccgggtccgaaggacgttcggaacggtccttacgacctttaagttcctaggtcgactacgtaccgaacggggtacaccgtaacgnggtacggattacgatacgcgttcggacgggttcgggttaggtcggttcgggacggtaacggtacaacgtcggtaccggtccgtaaggtccg

SEQ ID NO: 25044 - DNA, 804 bp, Homo sapiens
  misc_feature: GYAE6OF02I30HT.21.22.B11.1.454.CMB.1.raw
  modified_base (191)..(191): a, c, t, g, unknown or other
  misc_feature (191)..(191): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctnacgcgtccgtcggggaccccccgggcaggagggtccacctattctcttgttcctgggacggtcaacctccaacagtacggaagtaattatgtattctaggtactcgacgaccaacctcccgaaggtaactccggacccccctaaaacgtcccctacctaacttacccgaaaggtaacggtaaaacttaacgtaccaacgggacccggtccccttacggtaccgggggttacccctacgggtaacccgtattccgttaccgtcgggtaccctaaccgtaacgtccgttacggccctacctaccgacgtccccttcccgtacgacctacgtcgtacgggttcgggaccgttacccgggtaccggagggtacgtaggtacgggtaccgtcgttaacctttaacgttacgtcggttacgaccgtaaccttcccgggaaacgggaacctacccgtaaaggttcggtaacggggattaacccggaaactacggttacggtacgggtaacggggttccgggggtttagggggtaccggttaccggggggtaccgggtaaacgggggtaacccctaaaccgggttaccgggacccccggtttacggtaacgggtaccccgg

SEQ ID NO: 25045 - DNA, 707 bp, Homo sapiens
  misc_feature: GYAE6OF02IHPHX.21.22.B11.1.454.CMB.1.raw
  modified_base (212)..(212): a, c, t, g, unknown or other
  misc_feature (212)..(212): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (312)..(312): a, c, t, g, unknown or other
  misc_feature (312)..(312): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccacctcagcgtcgtcgggacccccgggnagagggtcaccatctcttgtcnggagcaactccaantacggaagttaattatgtatttctggtatcagcaactccgaaggaactccgaccccaaactccncactccagagaataatcacgccggcctacgacggggtccctacggaccgtattcctcgtcggctaccgtaaggttcctacggcctaccgtcgaccgtcccgtacccgtcgaacctaacgtccgtacgggttccgggtacccgtacccggggtaccggaggtacgttggaacgggtcttacgtaacctttacgttacgtcggtacgtacgtaacgttcccggaaacggggtacctaaccgaacggtacgttaacggggaacctaaggtaaccgtaaacgttccggtaacggtaaccgggggttgggtttacgggggttcggttaacccggggacgggaaaccgggttaaccgtaaacccggttacggtacccggttacccggtaagggtaccccgg

SEQ ID NO: 25046 - DNA, 701 bp, Homo sapiens
  misc_feature: GYAE6OF02GOIC4.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggcaggacgggtcaccatcttcttgttctggaggcaactccaacatcggaagtaattatgtattctggtatcagcaactcccaggatcggaccccaaactcctcatccagagaataatcgagccggcctcgacggggtccctagaccgtattctcgtcggcctacctaagtcgtcggacctaccctccgaaccgtccccttccgtacgaacccagttaccgacgggttccggggccttacccggggtaccggaagggtacgtgggaacgggtccttagggtaacccttaatttaccgttgggttcgaccaacggttaccggaaccgggggtacaaccgaaacgtaggtacgggtaaacgttacaacggttaactcggtaagggaccgggtttcgggggttacgggggttcgggtttacccgggacgggggttaacgggtaaaccctaaaacgggttcccggtaaccccggttacggttaacgggtacccgg

SEQ ID NO: 25047 - DNA, 574 bp, Homo sapiens
  misc_feature: GYAE6OF02HAFU1.21.22.B11.1.454.CMB.1.raw
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
  modified_base (449)..(449): a, c, t, g, unknown or other
  misc_feature (449)..(449): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggcagagggtcaccatctcttgttctggaggcaactccaacatcggaagtaattatgtattctggtatcagctaactcccgaaggaactcggacccccaaactcctcactccagagaataatcagcgccctgacgggtccngacctatctcngctcagtctggcacctcacgccctccngaccactcgaggtcgggccttccggaccggaggagtcggacggctacggaacttacgttacngtcgacacgtacgacgggacacgaacgtaggtacggatagaactagcgttaggacggttcgggttagggtcggttcgggacggtaacgggaaccctaaggttccggaccgttccggtacgtaccg

SEQ ID NO: 25048 - DNA, 358 bp, Homo sapiens
  misc_feature: GYAE6OF02FM7ZW.21.22.B11.1.454.CMB.1.raw
  modified_base (309)..(309): a, c, t, g, unknown or other
  misc_feature (309)..(309): n is a, c, g, or t
  modified_base (316)..(317): a, c, t, g, unknown or other
  misc_feature (316)..(317): n is a, c, g, or t
  modified_base (319)..(358): a, c, t, g, unknown or other
  misc_feature (319)..(358): n is a, c, g, or t
tcagtcgtcgctcgcacgaccggtgctcgatttagacgacagctcagggggttcccgtgaccgattctctggctccaagtctggcacctcaggccctccctgaccatcaggtgggctccggtccgaggatggaggcctggactattactgtgcatcacgggacgcaacatgggatgacaatctgagcggttgggtgttcggcggagggaccaaactgaccgtctaggtcagcccaaggctcgccccctggtccactctgttccccacctcctcctacgtctctactggacgccgggctcggcaagggcncatagcnngnnnnnnnnnnnnnnnnnnnnnnnnnnnnnnnnnnnnnnnn

SEQ ID NO: 25049 - DNA, 308 bp, Homo sapiens
  misc_feature: GYAE6OF02GVVLF.21.22.B11.1.454.CMB.1.raw
  modified_base (299)..(308): a, c, t, g, unknown or other
  misc_feature (299)..(308): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctgtcccacctcctcctcgtctctactgagcgggctggcaaggccgcatagnnnnnnnnnn

SEQ ID NO: 25050 - DNA, 578 bp, Homo sapiens
  misc_feature: GYAE6OF02GAHO4.21.22.B11.1.454.CMB.1.raw
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
  modified_base (425)..(425): a, c, t, g, unknown or other
  misc_feature (425)..(425): n is a, c, g, or t
  modified_base (474)..(474): a, c, t, g, unknown or other
  misc_feature (474)..(474): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggcagagggtcaccatctcttgtctggagcaactcaacatcggaataattatgtattctggtatcagcaacctcccaggaactcggaccccaaactcctcatccagagaataatcagcgcctcgacgggtcccagaccgtattcnctggctaccgaagttcncggcaccctnactccctcccngaccactcgaggtcggtctcccgggtccgaaggntcggagtcctgaccttaattcgtgtgacagtcgaacgggacacaaacgngtagggactagaacctatccgtaggtacggtcgggtttggggttcggttcgggaccgggaacgggtacccgtaaaagtcggtaacccgttaccgtagggtaccc

SEQ ID NO: 25051 - DNA, 755 bp, Homo sapiens
  misc_feature: GYAE6OF02H36ZZ.21.22.B11.1.454.CMB.1.raw
  modified_base (241)..(241): a, c, t, g, unknown or other
  misc_feature (241)..(241): n is a, c, g, or t
  modified_base (366)..(366): a, c, t, g, unknown or other
  misc_feature (366)..(366): n is a, c, g, or t
tcagtcgtcgctcgcacgaccggtgctcgatttagacgacagctcaggggggggaagcgtcagcttcagctgtggtagagaagacaggactcaggacaatctccagcatggccggcttccctctcctcctcaccctcctcactcactgcgcagggtcctgggcccagtctgtcgctgaactcagccacctcagcgtcgtcggggaccccggcaggacgggtcaacccattctcttagttcngggacggacaactccaaatacgtacggaaagttaattatagtattctaggtaactcagtaccaacttaccaaggaactaccggacccctaaaactcacctactaccgaagtaacggaaattaacncaacggccggacccgtacgtaacggggtaccccacggtaaccgtaacgttcgttaccgtcggtacctaacgtaccgttacgtcggtacctaccgtacgaccgtccctccgttacgactaccgtacgtacggccggttcgtccccggggttaaccgaaggtacgtaacggtacggtaccggttaacgtaacgtttaacgtacgttacggacgttaacgaaccgttacgaaccgggggactaacccgaaagaacgggtttcggaaagttaccggaacttaacgacggttacggaacggggtttaccgggtttggggtccgggtttaacgggacccgggtaacggtaaacccgaacgtttaccgggacccggtttaccgacggttaacccgg

SEQ ID NO: 25052 - DNA, 813 bp, Homo sapiens
  misc_feature: GYAE6OF02JFPIB.21.22.B11.1.454.CMB.1.raw
tcagtcgtcgctcgcacgaccggtgctcgatttagacgacagctcagggtcctgggcccagtctgtgctgactcagccaccctcagcgtctgggacccccgggcagagggtcaccatctcttgttctgggaggcactccaacatcggaagtaattatgtattctggtatcagcaactcccaggaatcggaccccaaactcctcatccagaggaataatcagccgcctcgacgggtccctgaccgattctcgtcggctaccgaagtctcggcctacctcgacgtccccttacccgtgaacccctagtccgagggttcggggcccgttccccggggtacccggaagggtacgttcgggaacggtccttacggtaaccttttaacgtttaccgtggttcgacctacgttacccggaaccggggaccgtaccgaaaaccgtaggtacggggtatacggtaaactaacgttcgtagggaacggggttccggggttagggggtttccggttaccggggaacggggtaaccggggtaaacccgtaaaccggttaccggtaaccccggttacccggttaacgggtaccgtaaccgggaccccggtaaacgggtccccgtaccccgggtccccccggttccgggttacccgtacccgtttcccgttcccgtttaccccccccgtaccccgttccccgttcccgttaccccgtttaccgttacccgttacgtacgggaccgggtccgggtccgtaccgggaccgaacgggtccgtaacgtacggtacgtctacggactcgtacgcacgtcgactcgcgtcgcg

SEQ ID NO: 25053 - DNA, 615 bp, Homo sapiens
  misc_feature: GYAE6OF02FMDV0.21.22.B11.1.454.CMB.1.raw
  modified_base (212)..(212): a, c, t, g, unknown or other
  misc_feature (212)..(212): n is a, c, g, or t
  modified_base (493)..(493): a, c, t, g, unknown or other
  misc_feature (493)..(493): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnaggagggtcaccatctcttgttctggagcaactccaacatcggaagtaattatgttattctggtatcagcaacctcccgaaggaatccggacccccaaactccctacactaccaagaaggtaaatactcgaacggccggtccctacggacggggtccctaggaccgtattcctcgtcggcctaccagtccgtcggacctacctcacgtccctccctcgacctatcgacggtcggccgtcccgggtcggaggactggacggtctacgtaacttacgtttcgnggtcgctacgtccggacgggacacgagtaggtggatcgaactatcggtagacgggttcgggtttgggtgttaccggggacggacgggtaacctaacggtcggtaacccggtcgtacggtacc

SEQ ID NO: 25054 - DNA, 700 bp, Homo sapiens
  misc_feature: GYAE6OF02I02WZ.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggnagagggtcaccatctcttgttctggaggcaactccaacagtacggaagtaattatgttattcgtaggtactcagcaactcccaaggtaactccggaccccctaaactcctacactccgaagaggaaataactcgagccggtccctcggaccggggttccctggaaccgtattcctcgtcggccttaccgtaacgttccgtcggacctacccgtccgaaccgtccccttacccacggtaaccctagtccgacgggttccgggcccgttacccggggtaccggaagggtactacgggacggtccttacggtaccttacgttaccgtggtacgaccgtagtaccgggaacgggaccacgaacgtaggtagggtaactacggaatacgtcggtaggtacgggttacgggtttggggttaccggtacggggaccgggtaacgggtaacccctaaacggttcccgggaacccggttaccggtagggtaacccg

SEQ ID NO: 25055 - DNA, 641 bp, Homo sapiens
  misc_feature: GYAE6OF02JKUAR.21.22.B11.1.454.CMB.1.raw
  modified_base (191)..(191): a, c, t, g, unknown or other
  misc_feature (191)..(191): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (460)..(460): a, c, t, g, unknown or other
  misc_feature (460)..(460): n is a, c, g, or t
  modified_base (493)..(493): a, c, t, g, unknown or other
  misc_feature (493)..(493): n is a, c, g, or t
tcagtcgtcgctcgcacgaccggtgctcgatttagacgacagctcaggggggggaagcgtcagcttcagctgtggtagagaagacaggactcaggacaatctccagcatggccggcttccctctcctcctcaccctcctcactcactgcgcacgggtcctgggcccagtctgtgctgactcagccaccctnagcgtctcgggaccccccggnagngggtcaccatctcttgttcnggacggcaactccaacntcggaataattatgtattctggtatcagcaacctcccaagggactcggaccccctaaatccctcactccaggagaaactaatcaggccggcctcgacggggtcccnggacccgtattcncgtggccttaccgaagtcctacgggcctacccgttcgacgtcccctcctagacccagtccgaggttcgggccttcccgggtacgaggtntaggacggtcccttagacccttaagtttaccgngggttcaccgtaacttcccgggaacggggttacccacgtaacgtggtagggacttgaacctagttcgaggtaacgggttccggtttggggtccgtacgggaccgggacgggtaaccctaagtcgggaaccccgtttctaagggtcccg

SEQ ID NO: 25056 - DNA, 812 bp, Homo sapiens
  misc_feature: GYAE6OF02GA2O3.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcacctcctcactcactgcgcagggtcctgggcccagtctgtgctgactcagccaccctcagcgtcgtcgggacccccgggnaggacgggtcaccgatcctcttgttctggacgcaactccaaacatacggaagttaattagtgtacttcgttggtactcagcctaaccgtcccgaaggtaacgtcccggaccccctaaaacgttccctactacgtaccgaaggaacggtaaactaacgtccgacgtcccggacccttacgggaccggggttccctaggtaccgtacttccgttccgtcggtcctaccgtaaggttccgtcggtacccaaccgttccgacccgtccccgttcccaccggtaacccacggttcccgtaacggggttccggggtaccccgtttcccggggtaaccggacgggttacggtacgggtaaccggtcgtttaaccgggttaacctttaacggtttaccggtcggttaaccgacgttaaccgttacccgggaaccgggttaacgaccgtaaacgtcgggttaacgggtagtaaccgtaaccgttaacggtcggttacgggtaacgggttcggggtttacggggtaccggggttacccgggaacggggtaaccgggtaaccccttaaaccgggtcgtaacccccggggttttacgaaccgggttaacccgg

SEQ ID NO: 25057 - DNA, 307 bp, Homo sapiens
  misc_feature: GYAE6OF02H5XBS.21.22.B11.1.454.CMB.1.raw
  modified_base (303)..(307): a, c, t, g, unknown or other
  misc_feature (303)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaacgtgaccgtcctaggtcagcccaaggctcgccccctggtcactctcgttcccgccctcctcctcgtcctctacctgagcgggctggcaaggcgcatgnnnnn

SEQ ID NO: 25058 - DNA, 315 bp, Homo sapiens
  misc_feature: GYAE6OF02H8Q70.21.22.B11.1.454.CMB.1.raw
  modified_base (304)..(315): a, c, t, g, unknown or other
  misc_feature (304)..(315): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctcgttcccgccctcctccctcgtcctctactgagcgggctggcaaggcgcatagcnnnnnnnnnnnn

SEQ ID NO: 25059 - DNA, 763 bp, Homo sapiens
  misc_feature: GYAE6OF02GJQU9.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcgggacccccggnagagggtcaccatctcttgttctggagcaactaccaacatacggaagtaattatagttattcgtaggtactcagacaactcccgaagaacgtccggaccccctaaactccctcactccaaggaaggaactaatcgacgtccggacccgtcgacggggtccctacgacccgtattcctcgtcggaccttaccgtaacgtccgtcgggacctacccgttaccaccggtccccttaccccgacgtaaccctaacgttcccgtaacgggtccggggtaccccgttcccggggtacccggaagggtacggttcggaaccggtctacgggttaacctttaacgtttaacgttcggtacggtaccgtaacgttacccgggaacccggggtacgaaacccgaacgttaaaccgggtgggtaaacggttaccgtaaacctaacgttccggttaacgggacggggttaccgggggttttggggtacccgggtttacggggaccgggttaaccggggtaacccttaaaaccggcggttaacccccggttacgtacgggtaacccg

SEQ ID NO: 25060 - DNA, 560 bp, Homo sapiens
  misc_feature: GYAE6OF02HM1HW.21.22.B11.1.454.CMB.1.raw
  modified_base (383)..(383): a, c, t, g, unknown or other
  misc_feature (383)..(383): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
  modified_base (551)..(553): a, c, t, g, unknown or other
  misc_feature (551)..(553): n is a, c, g, or t
  modified_base (555)..(560): a, c, t, g, unknown or other
  misc_feature (555)..(560): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgacggggtccctgaccgattctctggctccagtctggcacctcagcctccctgaccatcaggtggctcccggtccgaggctggaggctgactagttactgtgcatcgacgggacgacaaagtgggatgacaatcagagtcgggttgggtgtcggnggacgggaccaacgtcggaccgtccgtacggtcgacgcccgaagggcctacggcccccgttcgggtcctacgtccgttccgttccccaccccttcccgtccctcgttccttcctaccgtgtacggtccgggctcggacgacggccgactacgtacggtnctcgnacgnnngnnnnnn

SEQ ID NO: 25061 - DNA, 693 bp, Homo sapiens
  misc_feature: GYAE6OF02IOQV1.21.22.B11.1.454.CMB.1.raw
  modified_base (404)..(404): a, c, t, g, unknown or other
  misc_feature (404)..(404): n is a, c, g, or t
tcagtcgtcgctcgcacgaccggtgctcgatttagacgacagctcgagggggggggaagctcagcttcagctgtggtagagaagacaggactcaggacaatctccagcatggccggcttccctctcctcctcaccctcctcactcactgcgcgagggtccgtcgggcccagtctgtgctgactcacgccaccctcagcgtcgtccggggacccccgggcaggacgggtccacctatcttctttggttcgtgggacggcaactaccaacagtacggaaagttaattatgttatttctggtatcagacaacctcccgaaggaactccggaccccctaaactcctacactaccgagaagaaataacgtcaacggccggccctcggaccggggtccctacgaaccgtnttccgtcgtacggtcctaccgtaacgttccgtcggaccctacccttcgacccgtccctacccgtcgaaccctataccgagggtcggtcccgtccgggtaccggaggagtacgggaggttccgtacgtaactttagttaccgtggtcgtacacgttaccggaccggggtacaccgaaagtcggaacggtagtacgaacagttcggtaggtaacgggttcgggttggggttcgtaccggggacggaacgggtaacccaacgtccgggtaacccgttccggtaggtacccgg

SEQ ID NO: 25062 - DNA, 309 bp, Homo sapiens
  misc_feature: GYAE6OF02IJM2W.21.22.B11.1.454.CMB.1.raw
  modified_base (299)..(309): a, c, t, g, unknown or other
  misc_feature (299)..(309): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcgacgggacgcaacatgggatgacaatctgagcggttgggtgttcggcggagggaccaaacgtgaccgtctaggtcagccaaggctgccccctggtacacgtctcgttcccacctcctcctgtctctactgagcgggctggcaagcgtcatgnnnnnnnnnnn

SEQ ID NO: 25063 - DNA, 797 bp, Homo sapiens
  misc_feature: GYAE6OF02IOAAD.21.22.B11.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
tcagtcgtcgctcgcacgaccggtgctcgatttagacgacagctcagggggggggaagctcagcttcagctgtggtagagaagacaggactcgaggacaatctccagcatggccggcttccctctcctcctccaccctcctcactcactgccgcgagggtccgtcgggcccagtctgtgctgactcacgcctaccctnagtccgtccggtcggggacccccggnacggtacgggtccacctatccgtcgtttgttccgtagggacgctaaccgtaccaactacgtacggaagttaattacgtgttacttcgtaggtactccaagtcctaaccgtacccaagggtaaccctacggtaccccctaaaccgtcccttacaccgtaccgaaaggtaacgtaaacgtaaaccgtaccggtaaccgtacggggtacccccgtacggttaaccgggggtacccttacggggtaacccttaggttccgttaccgtacggtaccctaccggtaaccgtccggtaccggtccgaacccctttccgaccgttacccctacccgttccgaaccgttcgaccgtacggggttccggacccgtttaccgggtccggtaaggaccgttaggaacggtctttaacggacctttaggtttacaccggttagtacccgaacggttccgaaaccggggtaactacgtaaacggcgttaaggcctaggtactagtacggttggaacggttcgggtacgggtacggttacggaaccggtaaggccgtaaaccgttgggaaccctttcggacgtaccgg

SEQ ID NO: 25064 - DNA, 634 bp, Homo sapiens
  misc_feature: GYAE6OF02GBPZH.21.22.B11.1.454.CMB.1.raw
  modified_base (523)..(523): a, c, t, g, unknown or other
  misc_feature (523)..(523): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctggcccagtctgtgctgactcagccaccctcagcgtctgggacccccgggagagggtcaccagtctcttgttctggaggtcaactccaacatcggaagtaattactgtattctggtatcagacaactcccaaggaactcggcccccaaactccgtcaactccaagacggtaataattcacggaccggccctcgacggggttccctgaaccgtattccgtactgggccttccgaaggttcctgggtcctacccgttccaggccctaccctcgaacccagtcaacggtcgggtcctacccggtccgaaggtacgtacgtagggtcctggaccttaagttcctgtgtccaagttccgaggggtaccgntaaccgagttgggaatcgggaacctagtctaaggacgggttcgggtttcggggtcgtttacgggaccggaagggtccctaaaacggtggaacccggtttccgaagtcccgg

SEQ ID NO: 25065 - DNA, 680 bp, Homo sapiens
  misc_feature: GYAE6OF02J1PZB.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggcagagggtccaccatcctcttgttctggaggcaacctccaacatcggaagtaattatgtattctggtatcagcaactcccaggaatccggaccccctaaactcctacactccaagacggaataatcgacgccggtcctcgacggggtccctgaccgtacttcctcgcggtacctaccgtaagttccgtggaccctaccgtcacgtcccctacccgtagaccctatacgacggtcgggtaccctcccggggttcgaagggtactggacgtccgtagtaccttaacgttacgtgtacgtctacgtccgaacggggacctaccgtaaacgtggttacgggaacttagggaacccttaacgtcgtacgggtaacgggttcggggtttagggtcccgggttagggggacccgggtaacggggtaacccgtaaaccggttccgggtaaccccggtttaccggtaaggttacccgg

SEQ ID NO: 25066 - DNA, 661 bp, Homo sapiens
  misc_feature: GYAE6OF02HER7T.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggagggtcaccatctcttgttctggaggcaacctccaacatacggaagttaattatgttattctggtactacagaccaactcccaaggaacgtccggaccccccaaactccgtacactccgaaggaaggaaataagctacggccggtacccctacgggaccgggttaccctacggaccgtacttccgtcgtacggccttaccgaagtccgtggacccacctcaccgtccctcccgtagaacctcgtacgtacgggtcgggtccctcccggggtacgaaggtacgtacgtacgggtctaacggtacttacgttactgggtacactacggtacccgacggggtaactaccgaaacgtaggtacggaatacgaattaacggtctaggtacggttcgggttagggtcggttcgggacggaacggtaccaagtccgtacggtccgtaggtaccg

SEQ ID NO: 25067 - DNA, 603 bp, Homo sapiens
  misc_feature: GYAE6OF02FTTQP.21.22.B11.1.454.CMB.1.raw
  modified_base (211)..(211): a, c, t, g, unknown or other
  misc_feature (211)..(211): n is a, c, g, or t
  modified_base (498)..(498): a, c, t, g, unknown or other
  misc_feature (498)..(498): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgtctggaggcaactccaacatcggaagtaattatgtattctggtatcagcaactcccaggaatcggaccccaaatcctcatccagagaatatcagcgcctcgaggggtccctgaccgtattcctcgtggacctaccgaagttcctgggacctaacccgtcgaacgtcccctccctcgaaccctatccgaggtcgggcctcccgggtaccgaggacgtggacgctgacttaagttcgtgtcgctagtccgaacggggtccacgtaaacgngtcgggaatgaacctagtacgtggtacgggtccggtttgggggtacgttccggggacgggtacgggtacctaaacccgttcggaacccgttcggtacgggtaccg

SEQ ID NO: 25068 - DNA, 704 bp, Homo sapiens
  misc_feature: GYAE6OF02GB7W2.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgcgcagggtcctgggcccagtctgtgctgactcacgccaccctcagcgtcgtcgggaccccgggcagacgggtcaccatctcttgtctggaggcaactcaacatacggaataattatgtattctagtatcagccaacctccaggtaactccggacccccaaactccctcactaccgaagagaaataactcacggccggccctacggacggggtccctagaccgtacttcctcgtcggccttaccgtaagtccgtcggacctacccgtacaccgtccctccctacgaaccctatcgtacggggttccgggtaccgttaccccgggtacggaaggtacgtacgggtacggcttacggtaactttacgtttacgtcggcggaacctaacgttccgggaaacggggacctaaccgaaagtggtaccggggaattaaccgaacttaacgttccggtaagggttcgggtttacgggggtttcgggttacggttaccgggggaccgggtaaacggggaaccctaaaccgggtttcggaacccggttttaccgtagggtacccg

SEQ ID NO: 25069 - DNA, 559 bp, Homo sapiens
  misc_feature: GYAE6OF02FGOWA.21.22.B11.1.454.CMB.1.raw
  modified_base (273)..(273): a, c, t, g, unknown or other
  misc_feature (273)..(273): n is a, c, g, or t
  modified_base (390)..(390): a, c, t, g, unknown or other
  misc_feature (390)..(390): n is a, c, g, or t
  modified_base (455)..(455): a, c, t, g, unknown or other
  misc_feature (455)..(455): n is a, c, g, or t
  modified_base (461)..(461): a, c, t, g, unknown or other
  misc_feature (461)..(461): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgtctggaggcaactcaacatcggaagtaatatgtatctggtatnagcaactcccaggaatcggcccccaaatcctcatccagagaataatcagccgcctcgacgggtccctgaccgattctctggcctcaagtctggcacctcacgccctcccgtgacctntcaggtcggcctcccgggtcaggactggagcttagacttattacgtgtgcagtccgacggggacncaacgngtacgggtatacgaactagtcgtaggtacgtcggggttggggttcgttcggggacgggtaacgggacctaaacgtcggaccggttccgtaggtacccg

SEQ ID NO: 25070 - DNA, 302 bp, Homo sapiens
  misc_feature: GYAE6OF02HI6VE.21.22.B11.1.454.CMB.1.raw
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (296)..(302): a, c, t, g, unknown or other
  misc_feature (296)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccacctcctcctcgtctctactgagcggntggcaaggcncatgnnnnnnn

SEQ ID NO: 25071 - DNA, 757 bp, Homo sapiens
  misc_feature: GYAE6OF02J2EHY.21.22.B11.1.454.CMB.1.raw
  modified_base (412)..(412): a, c, t, g, unknown or other
  misc_feature (412)..(412): n is a, c, g, or t
  modified_base (736)..(736): a, c, t, g, unknown or other
  misc_feature (736)..(736): n is a, c, g, or t
  modified_base (740)..(741): a, c, t, g, unknown or other
  misc_feature (740)..(741): n is a, c, g, or t
  modified_base (747)..(747): a, c, t, g, unknown or other
  misc_feature (747)..(747): n is a, c, g, or t
  modified_base (750)..(750): a, c, t, g, unknown or other
  misc_feature (750)..(750): n is a, c, g, or t
  modified_base (753)..(753): a, c, t, g, unknown or other
  misc_feature (753)..(753): n is a, c, g, or t
  modified_base (755)..(756): a, c, t, g, unknown or other
  misc_feature (755)..(756): n is a, c, g, or t
tcagtcgtcgctcgcacgaccggtgctcgatttagacgacagctcagggtcctgggccagtctgtgctgactcagccaccctcagcgtctcgggaccccgggcagagggtcacatctcttgttcgtggagcaactccaacatcggaaagtaattatgttattctggtaactcgacgactaaccgtcccgaaggaactcccggaaccccctaaactcctacacaccgaagaacgtaaatacacgccggccggccctagggaccgggttccacgaacgttcttctcgtcggtcctaacctaagttcacggtccacctaccgccgtcccttaccgccgtaacgactaccggtagggttccggaaccggttccggtcgacggtacgtaggtcgtacggtactacttagtttaacgngtcgacgtacgacgaccgggacgaactttccgggaagtacggtactaaggacccttagggtacgtaccgggttacggggtacggggttttcgggtaccggggtacggggtcccgggtaaaaccgtacgggtaaaacccggttcccggtaaacgggttcccgtaaacggtcccgtaaccgggaccccgtaacggtccccgtacccggttcccgtaaccggtttccctctttccccggtcccgttacccgtcccctttccgtacccgttcgtccgttacgcgttccgggacggtcggtccacgaccggtacacgtacgtgtcggcncacnncgcgcncgngcncnnc

SEQ ID NO: 25072 - DNA, 312 bp, Homo sapiens
  misc_feature: GYAE6OF02I59E1.21.22.B11.1.454.CMB.1.raw
  modified_base (263)..(263): a, c, t, g, unknown or other
  misc_feature (263)..(263): n is a, c, g, or t
  modified_base (300)..(301): a, c, t, g, unknown or other
  misc_feature (300)..(301): n is a, c, g, or t
  modified_base (303)..(312): a, c, t, g, unknown or other
  misc_feature (303)..(312): n is a, c, g, or t
tcagtcgtcgctcgcacgaccggtgctcgatttagacgacagctcagggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggaggaccaaactgaccgtctagtcagcccaaggctcgccccctggtccactctcgttccccgccttccncctcgtctcctactgagcgggctggcaagcgcaatgnncnnnnnnnnnn

SEQ ID NO: 25073 - DNA, 538 bp, Homo sapiens
  misc_feature: GYAE6OF02GS69J.21.22.B11.1.454.CMB.1.raw
  modified_base (453)..(453): a, c, t, g, unknown or other
  misc_feature (453)..(453): n is a, c, g, or t
  modified_base (524)..(527): a, c, t, g, unknown or other
  misc_feature (524)..(527): n is a, c, g, or t
  modified_base (529)..(529): a, c, t, g, unknown or other
  misc_feature (529)..(529): n is a, c, g, or t
  modified_base (532)..(538): a, c, t, g, unknown or other
  misc_feature (532)..(538): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgacggggtccctgaccgtattcctcgtggcctccaagttctggccacctcacgccctccctgacccatcaggtggcctccggtccgaggatgaggctgacttattacgtgtgcatcgacgggacacaaaagtgggatgacaatctggagtcgggttggtgtcgggcggagggaccaacgtcgaccgtccgtaggtcacgccgaggcctccgcccccgtcggtccnccttcctcgtccccaccctccctcctcgtctcctacgtgacggccggcgtcggcgacgggcacgagtacgnnnncngcnnnnnnn

SEQ ID NO: 25074 - DNA, 761 bp, Homo sapiens
  misc_feature: GYAE6OF02I3Y5I.21.22.B11.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcacgcgtcgtcggggacccccgggcaggagggtcaccntctcttgttctggagcaactccaanatcggaagtaattangttattctggtatcagcaactcccagaactcggacccccaaactcctacactaccgaacggaagaaactaactcgaacggccggtccccgtagaccgggggtcccctacggaaccgttaatttccgtaccgtgggcccttaccgaaacgttccgtacggtccacccgtaccgtacgtaccccttccccgtacggaaaccctagtaccgtagggttcgggtacccgttcccgggtaacccggtagggacggttacggtacggtccctttaaggaaccctttaagtttaccgttaggtacgtaacccgtaagtcccgggaaaccggggaccgaacgaaacccgttaagggcgggtaacttaacgggaccttaacggtcgacggggttaaccggttacgggggtttcgggggttaaccggttaccggggaacgggtaaacccgggacccctaaaacggttccgggaaccccggtttacccggacccgggttaccgg

SEQ ID NO: 25075 - DNA, 731 bp, Homo sapiens
  misc_feature: GYAE6OF02H26YK.21.22.B11.1.454.CMB.1.raw
  modified_base (716)..(716): a, c, t, g, unknown or other
  misc_feature (716)..(716): n is a, c, g, or t
  modified_base (729)..(729): a, c, t, g, unknown or other
  misc_feature (729)..(729): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactccaggaatcggccccaaactctcatccagagaataatcgagcgccctcgacgggtcctgaccgattctctggcctacaagttctggccaacctcacgtccctcctgaccatcaggtcgggcctcccggtcgaggatggaggctgacttattactgtcgacacgtcgaccgggacacaacgtagtgggaatacgaactaagttccgtaggaacgggttcggggtttcggggttacggttaccgggggacggggaaaccgggtaacccgtaaaaccggtacgggtaaaccccgttacccggttaacgggtacccgaaccggtacccccggtaaacgggccccgtttaccccgggtaccccccggttacgggttaccctacccgtttcccgtttacccgggttcccccgtcccctttccccgtttcccgtttaccggttccccttaccgtttaacccgtcgggtaaccggggtcccgggtaccgttccgggaacgtaacccggggtacccgtaccgtaaggtaccggtagcgtacacgtcgngtcgtcgctctcntc

SEQ ID NO: 25076 - DNA, 565 bp, Homo sapiens
  misc_feature: GYAE6OF02HOC32.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggcagagggtcaccatctcttgttctggaggcaactccaacatcggaagtaattatgtattctggtatcagcaactcccaggatcggcccccaaactcctcactccagaggaataatcagcggccctcgacggggtccctgaccgtattctctggctccaagtctggccacctcacgccctcctcgaccatcaggtcgggctcccggtcgaggactggacgctagacttattactgtgctatcgacggacacaacgagtgggatcgaactatcgtaggtaggtccgggtttggggtcgttccggggacggaacgggaaccctaaaccgttcgggaacccgttcgtaacgggtacccg

SEQ ID NO: 25077 - DNA, 667 bp, Homo sapiens
  misc_feature: GYAE6OF02JZVVI.21.22.B11.1.454.CMB.1.raw
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (391)..(391): a, c, t, g, unknown or other
  misc_feature (391)..(391): n is a, c, g, or t
  modified_base (520)..(520): a, c, t, g, unknown or other
  misc_feature (520)..(520): n is a, c, g, or t
  modified_base (593)..(593): a, c, t, g, unknown or other
  misc_feature (593)..(593): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcacgcgtcgtcgggacccccggcaggcgggtcacatctnttgttctggagcaactccaacngtacggaagttaattatgttattcgtggtatcagtacaactaccaggtaacnccggacccccaaactcctaccataccaggaacgtaaataactacgacggccggaccctacggtaaccggggttccctgggaacccggttntttccgtcgtacgggtccttaccgtaacggtcctacgggacccaccgttccgacgtccctccctacggacctagttccgcgggtcgggtcctacccggggttacgacgggtacgtacggacgtaccgtntaacgttacgttaacgtggtaaccgtctacggttaccggacgggtaccaacgaaacgtcgttagggaccttanaacacttcgagggttcgggcggtttagggttccggacggtagtacgaaccgtacacggtcgaccgttccaaggg

SEQ ID NO: 25078 - DNA, 572 bp, Homo sapiens
  misc_feature: GYAE6OF02JFW1N.21.22.B11.1.454.CMB.1.raw
  modified_base (210)..(210): a, c, t, g, unknown or other
  misc_feature (210)..(210): n is a, c, g, or t
  modified_base (458)..(458): a, c, t, g, unknown or other
  misc_feature (458)..(458): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaagtaattatgtattctggtatcagcaactcccaggaatcggacccccaactcctcatccagagaataatcagccggccctacgacgggtccctagaccgtattccgtctcggcctccaagtccgtcggcctacctcacgtccctccctacgaccatcgaggtcgggcctcccgggtacgaggctggaggtctagtacttattcngtagctagtccgacgggacactacgagtacggatacgaactatcgtggacggtcgggttgggtcgttcggggacggtacgggaacctaacgtcggacccgtacgttacggaccg

SEQ ID NO: 25079 - DNA, 772 bp, Homo sapiens
  misc_feature: GYAE6OF02JKW4T.21.22.B11.1.454.CMB.1.raw
  modified_base (374)..(374): a, c, t, g, unknown or other
  misc_feature (374)..(374): n is a, c, g, or t
tcagtcgtcgctcgcacgaccggtgctcgatttagacgacagctcagggggggggaaggctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccgggcagacgggtcaccgatctcttgttctggaggcaactccaacatacggaagtaattatgttattctggttatcagccaacctcccgaaggaatacggaccccctaaactccctcactccgaagacggaataatcgacgccggcccgtagacggggttccccngaacccgtatttcctacgtcggactcccaaagttcgttcgggaccctacctcgaaccgccccttcccgtagaccccagttccggaacggttcggggcccttacccggggtacccgaagggtagttccgggaagggtcccttagggtaacctttagtttaacccgttcgggtcgacccgttaagttccccggaaaccgggggaaccggtaccctaaaaaccggtgggtttaaaggggacccttaaggaaaccgtttaacgttccggtacgggaaccgggttttcggggggttttaacggggggttcccggttttccggggggaaacggggtacggggtaaaccccccttaaaacggttcccggggtaaccccgttttaccggtacgggttaacccccgg

SEQ ID NO: 25080 - DNA, 584 bp, Homo sapiens
  misc_feature: GYAE6OF02FEQVF.21.22.B11.1.454.CMB.1.raw
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (563)..(563): a, c, t, g, unknown or other
  misc_feature (563)..(563): n is a, c, g, or t
  modified_base (570)..(570): a, c, t, g, unknown or other
  misc_feature (570)..(570): n is a, c, g, or t
  modified_base (574)..(584): a, c, t, g, unknown or other
  misc_feature (574)..(584): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggccctcgacgggggtcccctgaccgattcctctggcctccaagtcctggccacctcagcccttccctgacccatccaggtggcctccgggccgaggatgaggctgactatactgtncatcgacgggacncaactgtgggactgaactaagtctagggagtccggggtttggggtcggtttccgggcgggaacggggaaccaaacgtcggtacccgtaccgtagggtccacggacccgaacggcctccgtcccccgttcggtccctacctccgttcgttcccccgtcccttccttcccgtccgttcctccttacgtgaccgggccggcgtcggacgacggtcncgagtgntcgnnnnnnnnnnn

SEQ ID NO: 25081 - DNA, 805 bp, Homo sapiens
  misc_feature: GYAE6OF02F4GZN.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcaggagggtcaccatctcttgttctggaggcaacctccaacatcggaaagttaattatgttattctggtatcagcaactccgaggaactccggacccccaaactcctacactccaagagaataatcacggccgccctacggacgggtccctagaccgtattcctcgtcggtctaccgtaagttccgtcggaccctaccctccgaaccgtccccttaccccgtacggtaaacccctacgttaccggtaacggggttccggggtaccccgtttaccccgggggtacccgaaggggtaacgttcggggaaccggttaccgttaacggtaaacccgtttttaaacgtttaccgtttacgggttaccgaaccgtacggtttaccccggggaaaccgggggtacccgtaacccgtaaaacgtacgggttacggggtaacttaacgggtaacccgtaacgtttcggtaacggggttaacggggttccgggggttttacgggggtttaccggttaccggggggtaaccgggtaacccggggtaacccttaaaaccgggttccccgggtaaaccccggtttacccggtaacgggtaaccccggg

SEQ ID NO: 25082 - DNA, 667 bp, Homo sapiens
  misc_feature: GYAE6OF02GJHCK.21.22.B11.1.454.CMB.1.raw
  modified_base (393)..(393): a, c, t, g, unknown or other
  misc_feature (393)..(393): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtttcgggacccccgggcaggacgggtccaccactctcttcgttctggacggcaacctaccaaacagtacggaagttaattatacgttattctggttatcagacaacctccaaggtaactcggaccccctaaacctcctacactacccagaacggaataatcacgccgcccctacgacgggtccctacgacgtacttcncgtcggcctacgaactcgtcggcccacctctaccgtccctcctacgacctatcgacggtcggccggtccggaccggaggtactaggcgtctagtacttacttacgtgtacgctacgacggtaccgggacgaacgtaccgtagggtacggtagtacgtaaacgtagttacggtcggtaagggttcgggtttgggttccgggtacggggtaaccggggtaacggaacccggtaaccggtccggttaaccccgtacggttacggacccgtaaccggg

SEQ ID NO: 25083 - DNA, 708 bp, Homo sapiens
  misc_feature: GYAE6OF02I3RJ0.21.22.B11.1.454.CMB.1.raw
  modified_base (689)..(689): a, c, t, g, unknown or other
  misc_feature (689)..(689): n is a, c, g, or t
  modified_base (692)..(692): a, c, t, g, unknown or other
  misc_feature (692)..(692): n is a, c, g, or t
  modified_base (696)..(696): a, c, t, g, unknown or other
  misc_feature (696)..(696): n is a, c, g, or t
  modified_base (699)..(699): a, c, t, g, unknown or other
  misc_feature (699)..(699): n is a, c, g, or t
  modified_base (702)..(702): a, c, t, g, unknown or other
  misc_feature (702)..(702): n is a, c, g, or t
  modified_base (704)..(705): a, c, t, g, unknown or other
  misc_feature (704)..(705): n is a, c, g, or t
  modified_base (707)..(707): a, c, t, g, unknown or other
  misc_feature (707)..(707): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagccggccctcgacgggtccctgaccgattctcgtggcctaccaagtctggccacctcacgtccctccctgaccctatccgaggtcgggccttcccgggtccggaggtagtcggaacggtcctaggtaacctttacgtttaccgtggtcgacgtacgttcccggaaccggggaccacaaaccgtggtacggggaatacggaacctaagtcgtagggacggttcggggtttggggtacggttccggggacgggtaacggggaaccgtaaaccgtcggtaacccggttaccggtacggtaccgtacggacccgtaacgggtacccgtcccggtacccccgttccggtacctaccgttcccgttcccgttccccgtccccgttcccgttccccgttcccgttcccttaccgttaccggtcggtaccggtccgggtaccgtcggaccgtaccgggcgccgtaagtacggcacgtncgngtcncgngcngnngng

SEQ ID NO: 25084 - DNA, 706 bp, Homo sapiens
  misc_feature: GYAE6OF02IQOTZ.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcgggaccccccgggnaggagggtcaccatctcttgttctggagcaactccaacatcggaagtaattatgttattctggtatcagccaactcccgaggaatcggacccccaaatccctacactccagaaggaataatcagccggcctcgacggggtccctaggaccgtattccgtcgtcggcctaccgaagttcctcgggcccacccttcgacgtcccctcccctacgaaccctatccgaacgggttcgggtcccgttcccgggttccggaagggtactacgggaaccgggtcttacggtaaccttaacgtttaccgtggttacgaccttacgtacccggaaccggggaccgtaacctaaacgtcggttaggggacttacgggaaacctagttaccggtagggtacgggtttaccggggtttcgggggttcgggtttacccggggaaccgggggtacgggaaacccttaaacgggttccgggtaaccccggttaccggtaacggtacccgg

SEQ ID NO: 25085 - DNA, 529 bp, Homo sapiens
  misc_feature: GYAE6OF02HC6LF.21.22.B11.1.454.CMB.1.raw
  modified_base (209)..(209): a, c, t, g, unknown or other
  misc_feature (209)..(209): n is a, c, g, or t
  modified_base (231)..(231): a, c, t, g, unknown or other
  misc_feature (231)..(231): n is a, c, g, or t
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
  modified_base (434)..(434): a, c, t, g, unknown or other
  misc_feature (434)..(434): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctgggaccccccggnagagggtcaccatctctgttcnggagcaactccaacatcggaataattatgtattctggtatcagcaactcccaaggaatggcccccaaaatcctcatccagagaataatcagcggccctnaggggtccctgaccgattcnctggctccaagtctggcactcagcctcctgaccatcagtggctcggtcaggatgaggctgactattactgtgcatcgacgggcncaacagttgggatgactaagtcctaggacgtcgggttgggtacgttcgggacgggtacgggaaccctaaacgtcggtacccgtacgtaggtaccg

SEQ ID NO: 25086 - DNA, 734 bp, Homo sapiens
  misc_feature: GYAE6OF02HYUV6.21.22.B11.1.454.CMB.1.raw
  modified_base (210)..(210): a, c, t, g, unknown or other
  misc_feature (210)..(210): n is a, c, g, or t
  modified_base (367)..(367): a, c, t, g, unknown or other
  misc_feature (367)..(367): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcgggacccccggnagagggtcaccatctcttgttctggaggcaactccaacatacggaaagtaattatgtattctggtatcagcaactcccagaactcggacccccaaactcctacataccagaaggaactaatcgacgtccggccctagacggggtccctggaaccgtnttactcgtacggcctaccgaaagttcgcggacctaccctcaaccggacccttcccgacggaaccctacgtccgacggttacgggccttcccgaaaggttcccggaagggaacttacggggaacggtccttagggtaaacccttatttaaccggtagttccggaacttaaggttacccgaaaccgggggaaccctaacgtaaaaccgtaaggttaccgggggaaatttaacccgaacgtaaacgtttccgaaggggtaaccgggttaccgggggttttggggggtacttttaccgggggggacgggtaaacccgggggttaaacccaaaaaccgggtttaccgaccccggggtttacctaaccggggg

SEQ ID NO: 25087 - DNA, 781 bp, Homo sapiens
  misc_feature: GYAE6OF02GV1LW.21.22.B11.1.454.CMB.1.raw
  modified_base (211)..(211): a, c, t, g, unknown or other
  misc_feature (211)..(211): n is a, c, g, or t
  modified_base (619)..(619): a, c, t, g, unknown or other
  misc_feature (619)..(619): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccacctcagcgtcgtcgggacccccggnagcgggtcaccatctcttcgtctggacgcaactccaacagtacggaacgttaattagtagtatttccgtaggtactacagacctaccgtaccgacggaactccgggaccccctaaaccgtccctacacttaccgaaggtaacggtaaacgtaactacgaacggcccgggtaccccgtacgggtaccggggttacccgtacggaacccgttattaccgtcgttcggacccttaccggaacgttcgtcggaccctcccgtacgtacccgtcccctcccgtagaacccctagttaccggacgggttccgggcccgtaccgggtcccgaagggtacgtcggacgtttccggtacgaacgttacgtttaccgttgggaaccgtaccgtaacgggttaccgaacccggggttanaacccggaaagttacggggtacgggtaataccggtaaacctagttccggtagggtccggggtttagggtttcccggggggttacgtccggggggtaacggtaacgggtaacctaacccggggtttaccgggaccccgtttccgggtaacggtaacccccggg

SEQ ID NO: 25088 - DNA, 730 bp, Homo sapiens
  misc_feature: GYAE6OF02JPFON.21.22.B11.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctcgggcccagtctgtgctgacctcacgcccaccctcacgccgtcgtcggggacccccgggnaggacgggtccaccatctcttgttctggacgccaactccaaactagtacggaaagttaattagtgttaacttcgtaggttactcgaacgacctaaccgtacccgaaggtaacgtcccggacccccctaaaactccctacacgtacccgaaggaagtaaataactacgacgtcccggtccgtacggtaccggggtaccctacgtaaccgtactttccgtacgttcggaccttaaccgtaacggttccgtaccggtaccctacccgttaccgaccggtcccctttacccgtaccgtaaacctacgttacggacgggttcccgggtacctcccggggtaacgacgggtactacgggacggtaccttacggtaacctttagtaccgttggtaccgacgtacgttccgggaaccgtacgaacagtcggtaggtactacgacgtatcggtaggtacggttcgggttgggttacgacgggtacgaacgtaccacggtccgtaaccgttcgacgtacgg

SEQ ID NO: 25089 - DNA, 606 bp, Homo sapiens
  misc_feature: GYAE6OF02GN655.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaatcctcatccagagaataatcagcgccctgacggggtccctgaccgattctcgtggctaccaagtctggcctacctcacgccctccctcgacccatccgaggtcgggccttcccggggtaccgagggactcggacggctacggtaaccttagttacgtggtcgctacgtccgaacgggggacctcgaaacgtagtacgggaatcgaacctagttccgtagggtacggtcggggtttagggtcggtttaccgggcgggtaacgggaccctaaacgttcgggaccccgttaccgtaggtacccgg

SEQ ID NO: 25090 - DNA, 510 bp, Homo sapiens
  misc_feature: GYAE6OF02FW01X.21.22.B11.1.454.CMB.1.raw
  modified_base (343)..(343): a, c, t, g, unknown or other
  misc_feature (343)..(343): n is a, c, g, or t
  modified_base (348)..(349): a, c, t, g, unknown or other
  misc_feature (348)..(349): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (403)..(404): a, c, t, g, unknown or other
  misc_feature (403)..(404): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagtcgtcgctcgcacgaccggtgctcgatttagacgacagctcgtagggggtccctgaccgacttctctggctccaagtctggcacctcagccgtcccctgaccatcagtgggctccggtccgaggatgaggctgactagttactgtagcatcacgggacgacaacagtcgggatcgacctaactcctgagtcgggttgggttcgttcggacgggagggaaccaaacgtcgaccgtcctaggtcacgcccgaaggcctacgcccctggtacactcgtcgtcccgtcctaccgtccgagcgacgactgacggcgggctacggccaagggccataagtacggntagcnngtacgtagagtgtcagtgcgancgangtncgtcnganaggtcttcncncncngnngcncncgngcncnctnatgtctactctactctactcganacnatgtntctcgngtgcgcgngcgacgagananacgagngctgcncntgacnctactctctctctc

SEQ ID NO: 25091 - DNA, 622 bp, Homo sapiens
  misc_feature: GYAE6OF02G08HU.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaacatcggaataattatgtattctgtatcagcaactcccaggaactcggaccccctaaatccctacactccaaggagaatactcacggccggccctacgacggggtccctaggacccgtattcctcgtaggcctaccgaagttccgtaggccacccgttcaccgtccctacccgtgaccctatccgaggtcgggtaccgtcccgggtacgaggactcggacggcttagacttagttacctggtcacgtatccggacggggactaccgaagacgttggactagaacctagtcgtaggagggttcgggttagggtacggttccgggacgggtaacggtaaccctaaacggttccgggaacccgtttccgaagggttcccg

SEQ ID NO: 25092 - DNA, 594 bp, Homo sapiens
  misc_feature: GYAE6OF02GVHUE.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccggnagagggtcaccatctcttgttctggagcaactccaacatcggaagtaattatgtattctgtatcagcaacctccaggaactcggaaccccaaactcctcactccagaggaataatcagccgcctcgacggggtccctagaccgtattcctcgtcggctaccaagtctcggccacctcacgtccctccctagaccatcgaggtcgggtcctcccgggtacgaggacgtggacggtctagtaacttattacgtcggtcgactaacgtccggaacgggaccgacaaacgagtacgggatacgaactagtcgtaggtgggtcgggttggggtcggtccgggacgggtacggaaccgtaaacgtccggtacccgttaccgtaggtaccg

SEQ ID NO: 25093 - DNA, 711 bp, Homo sapiens
  misc_feature: GYAE6OF02HPH1K.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagaggtcaccatctcttgtctggagcaactccaacatacggaagtaattatgttattctggtatcagctaacctcccgagaactccggacccccaaactcctcactaccgaaggaagtaaataactcacgccggccctagaccggggttccctagacccgtatttcctaccgttcggacctaccgtaaacgttccgtacggaccctaccctcgaccgtcccctaccctacggaccctacgttaccgagggttcgggtacccgttaccccggggtacggaacggttacgtaggaccggtcgttacggttaaccttaatttaccggttggtacgtaccgtaacttccgggaaaccgggtacctaaccgaaacgttagggtaagggaacttagggaacctacgttcggtaggtacgggttaccggggtttggggttacggttaccgggacggggaacgtaacccgtaaaccggttccggtaacccggttccggtaacggtccg

SEQ ID NO: 25094 - DNA, 773 bp, Homo sapiens
  misc_feature: GYAE6OF02FQ9XM.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgtctggaggcaactccaacatcggaagtattatgtattctggtatcagcaactcccaggaactcggacccccaaacttcctacataccgaagaggaaataatcagcggccctgacgggggtcccctaggaacccgtattcctacgtcgggtacctaccgaaacggttcctacggggaccctaaccccgttccgaaccggtccccctttacccccgtacggtaaaccccctacgttacccggtaaacggggttccgggggtcccgtttacccccgggggtaccccgggaagggttaacggttcgggtaaacggggtccctttaagggtaaccctttaacggttttaacgtcggttacgacccgtaaacgttcccgggaaaccggggtaccggtaccctaaaacgggtaacgttagggggaaccttaagggaacccttaacgttccggtagggtaaccggggttccggggttttggggtaccgggtttaccggggacggtaacggggtaccctaaaacggtcggtacccggttacgtagggtacccg

SEQ ID NO: 25095 - DNA, 611 bp, Homo sapiens
  misc_feature: GYAE6OF02GGCMX.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaacctcccaggaactcggacccccaaatccctcactccagagaatatcagccggcctacgacggggtccctgaccgtacttctcgtcggcctaccgaagtctcggcacctccaacgtccctccctacgaccctatccgtagggtcgggccttcccgggtacggaaggacgtcggacggtccttacggtaacttacgtttacgcggttcgactacgttcggaaccgggtacaccaacgtagtgggaactcgactaacgtcgtaggacggtgggtttcgggttggtccgggacggtaggaccgtaaacggtggacccgttacgacggtacccg

SEQ ID NO: 25096 - DNA, 613 bp, Homo sapiens
  misc_feature: GYAE6OF02F2EEB.21.22.B11.1.454.CMB.1.raw
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcaggagggtcaccatctcttgttctggaggcaactccaacatacgaagtaattatgttatctggtatcagcactccaggatcggcccccaactcctcactcagagaatatcagccgcctcgacggggtcccagacctattcnctggctacagtcgcgccacctcncgtcctcccgtgaccctatccgtgtcgggtccctccgggtcgacgagtggacggtctacgacttacgttactgggctactaacgttccggaaaccgggggactccgaaaacgttggtacggggaattacgaacgtacgtcggtagggtaacgggttccgggtttagggggtccggtttaccggacggggggtaacgtacccgtaaacgttcccgggacccgttacggtaggtaacccg

SEQ ID NO: 25097 - DNA, 304 bp, Homo sapiens
  misc_feature: GYAE6OF02FPRYR.21.22.B11.1.454.CMB.1.raw
  modified_base (299)..(304): a, c, t, g, unknown or other
  misc_feature (299)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgcccctggtcactctcgtccccgcctcctcctcgtctctactgagcggctggcaaggcgcatacgnnnnnn

SEQ ID NO: 25098 - DNA, 689 bp, Homo sapiens
  misc_feature: GYAE6OF02ILAX6.21.22.B11.1.454.CMB.1.raw
  modified_base (215)..(215): a, c, t, g, unknown or other
  misc_feature (215)..(215): n is a, c, g, or t
  modified_base (293)..(293): a, c, t, g, unknown or other
  misc_feature (293)..(293): n is a, c, g, or t
  modified_base (549)..(549): a, c, t, g, unknown or other
  misc_feature (549)..(549): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgacgggtcctcgggcccagtctgtgctcgactcacgcccacctcagcgtcgtcgggaccccggnaggacggtccacatcttcgttgtcgtggacgaccaactccaactagtacggaaattaattatgtattcgtgtatcgancaacctccgaaggtactcgacccctaaactcctacgactacgaagaagtaaactaactacgacgcccggtcccgtacgtacggggtccctagaaccgttcttccgtcgtcggcctaacggtaacgttcgccggacctacccgtacgccgttaccccgtacctacggaacctacgttacgaacggtccgggtccacgtaaccgtaccggaggtagtacggtaagtccgtaacgtacgttacttacggtgtaccgtanacgtaaccgacgggaactaccgaaagacggtaggtagaaccgtataacgttcgacgggtaggttcggggttcgggttacggttacgggacgggtaaaccggtaaccaaaccgggttaccggtacccgttacggtaaccgg

SEQ ID NO: 25099 - DNA, 672 bp, Homo sapiens
  misc_feature: GYAE6OF02G8O3B.21.22.B11.1.454.CMB.1.raw
  modified_base (212)..(212): a, c, t, g, unknown or other
  misc_feature (212)..(212): n is a, c, g, or t
  modified_base (282)..(282): a, c, t, g, unknown or other
  misc_feature (282)..(282): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtctcggggacccccggnaggacggtcaccatctcttgttctggagcaactccaacatacggaataattatgtattcgtaggtatacngacactcccgaaggaactccggacccctaactcctacactaccgaagagtaaatactcacggccgaccctcggacggggtccctacgaccgtattccgtctcggtaccttacgtagtcgtacgacctacctcaccgtcccctcccacgtaccactcggtacgggtcggtcccgtaccgggtccggaaggtcgtacggacggccttacgtaacttacgtttcgtcgtacgccgtacggttaccggaaccggtaccaccgaagtcgggtaacgatacgaactacgtcggtagggcgggtttaccggggttagggttcgggtacccgggacggggtaacggtaaacccgttaaccggttcccgggtaacccggtttcgggaaacggtccccgg

SEQ ID NO: 25100 - DNA, 309 bp, Homo sapiens
  misc_feature: GYAE6OF02FVMTR.21.22.B11.1.454.CMB.1.raw
  modified_base (300)..(309): a, c, t, g, unknown or other
  misc_feature (300)..(309): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctgttccccgcctcctcctcgtctctactgagcgggctggcaaggcgcatagnnnnnnnnnn

SEQ ID NO: 25101 - DNA, 305 bp, Homo sapiens; identical to SEQ ID NO: 23996
  misc_feature: GYAE6OF02FLL2G.21.22.B11.1.454.CMB.1.raw
  modified_base (299)..(305): a, c, t, g, unknown or other
  misc_feature (299)..(305): n is a, c, g, or t

SEQ ID NO: 25102 - DNA, 377 bp, Homo sapiens
  misc_feature: GYAE6OF02G0RST.21.22.B11.1.454.CMB.1.raw
  modified_base (159)..(159): a, c, t, g, unknown or other
  misc_feature (159)..(159): n is a, c, g, or t
  modified_base (207)..(207): a, c, t, g, unknown or other
  misc_feature (207)..(207): n is a, c, g, or t
  modified_base (322)..(322): a, c, t, g, unknown or other
  misc_feature (322)..(322): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (357)..(377): a, c, t, g, unknown or other
  misc_feature (357)..(377): n is a, c, g, or t
tcagtcgtcgctcgcacgaccggtgctcgatttagacgacagctcaggggtccctgaccgattctctggctccaagtctggcacctcagcctccctgacccatcagtgggctccggtccgaggatgacggctggactattactgtgcatcacggggacncacatggatgacgaatctgagcggttgggtgtcggcggaggcaaacgngaccggtcctaggtcagcccaaggtacgcgtaccccccgtcgttaccgctccgttgttcccccgcccgttccccctcgttcccgtgtaccttaaccttcggagccgggcttcggnaacggccggtaccctaaaggctnacgngcntctannnnnnnnnnnnnnnnnnnnn

SEQ ID NO: 25103 - DNA, 622 bp, Homo sapiens
  misc_feature: GYAE6OF02IDZ40.21.22.B11.1.454.CMB.1.raw
  modified_base (213)..(213): a, c, t, g, unknown or other
  misc_feature (213)..(213): n is a, c, g, or t
  modified_base (249)..(249): a, c, t, g, unknown or other
  misc_feature (249)..(249): n is a, c, g, or t
tcagtcgtcgctcgcacgaccggtgctcgatttagacgacagctcagggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnaggaggtcaccatctcttgtctggagcaactccaanatcggaagtaattatgtattctggtatcagcaactcccaggaactccggacccccaactcctacactccaggagaataatcacggccgccctcgacgggtccctagacctattctcgtcgcctaccgtagtctcggcctacctcaccgtccctaccctcgtaacctactcgacggtcgggtccgtcccgggtaccggaggacgtcgggacggtccttacggtaacctttagtttaccgtggtcgactacgtaccggaaccgggaccgacaaacgtagtaggatacgaactagtcggtaggtcgggttcgggttggggtacggtcgggaacgggaccggaacctaacggtcggtacccgttacgtacggtaccg

SEQ ID NO: 25104 - DNA, 660 bp, Homo sapiens
  misc_feature: GYAE6OF02JSYGF.21.22.B11.1.454.CMB.1.raw
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (402)..(402): a, c, t, g, unknown or other
  misc_feature (402)..(402): n is a, c, g, or t
  modified_base (613)..(613): a, c, t, g, unknown or other
  misc_feature (613)..(613): n is a, c, g, or t
  modified_base (621)..(621): a, c, t, g, unknown or other
  misc_feature (621)..(621): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgtctggagcaactccaacatcggaagtaattatgtattctggtatcagcaactcccaggaatcggccccaaatcctcagtccagaggtaataatcagccggtccctgacggggtccctgaccgtattcctctggcctaccaagttcctggaccacctcgcgcctccctgacccatccgaggtggcctcggtccgaggactcgaggtctaggacttattacgngtcgacatcgacgggacngaacnggtagggatgaacaagtcgtgacggtcggtttgggngttcgggacggtaacgggaaccaacgttcgaccgttaccgtagggtcacgacccgtaagggcctaaccggtcccccgttaggtacctaccgttccggttaccgtacccctacccggttccttaccgttcgtcccgttacgttacgtccgggaaccggtcgggtcccgttaagggaccgtaaccggttccgaacgtttccgtaaagggtccncggtaacnccgtagtactaacgtaccgtacgtacgtacgtacgtacg

SEQ ID NO: 25105 - DNA, 643 bp, Homo sapiens
  misc_feature: GYAE6OF02IVDB6.21.22.B11.1.454.CMB.1.raw
  modified_base (211)..(211): a, c, t, g, unknown or other
  misc_feature (211)..(211): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (462)..(462): a, c, t, g, unknown or other
  misc_feature (462)..(462): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgtctggaggcaactccaacatacggaagtaattatgtattctagtatcagcaacctcccgagaactcggacccccaaactccacatccagacggtaataatcagccgcctagacgggtccctagaccgtattcncgtcgctacagttcngccanactcacgtccctacccgtagaccagtcgtacggtgggtccctaccgggtaccggaggattggacggtctagtaccgttnttaacgtgtagtactaagtaccgacggggtacccacgtaaacgagtaacgggtaatacggaacgtaagtttaccggtagggaaccgggtttcgggggttttggggtaccgggtttacggggaaccgggtaacgggtaaacccgtaaacggtaccgggtaccccggttaccggtaacccggg

SEQ ID NO: 25106 - DNA, 693 bp, Homo sapiens
  misc_feature: GYAE6OF02JGFGS.21.22.B11.1.454.CMB.1.raw
  modified_base (216)..(216): a, c, t, g, unknown or other
  misc_feature (216)..(216): n is a, c, g, or t
  modified_base (595)..(595): a, c, t, g, unknown or other
  misc_feature (595)..(595): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgttccgtcggggaccccccggnaggagggtccaccattcctctttcgttcgtagggacggcctaaacctccaaacacgtacggaaagttaactttagtcgttattcttggtatcagtccaaacctcccaggaactacggacccccaaactcctcaactccgaaggaaggaaactatacgacgccggcccgtacgacggggttccctaggacccgtattccgtcgtggcctaccaaggtctcggactacccgtcgacgtccctcctacgaccctagtccgtagggtccgggaccctttaccgggccgtaaggacttcggaaacggtccgttacggaacctttacgttacggtggtacgcctaacggttccggaacgggtaccgacgaacgttcggagggtanaccgtacacgtcgtagggtaacggttcgggtttaggggccgtttccggggaacgaacggggtaccctaaagtccggtacccggttaccgtacggcccg

SEQ ID NO: 25107 - DNA, 614 bp, Homo sapiens
  misc_feature: GYAE6OF02FJI6T.21.22.B11.1.454.CMB.1.raw
  modified_base (558)..(558): a, c, t, g, unknown or other
  misc_feature (558)..(558): n is a, c, g, or t
  modified_base (577)..(577): a, c, t, g, unknown or other
  misc_feature (577)..(577): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcaggacgggttcaccatcttcttgttcgtggacggcaacctccaactacgtacggaagtaaacttagtagttacttcgttaggtactcgacgacaacctcccgaaggtaacgtccggacccccaaaactcctacactccgaggaagaataatcacgccgcctcggacgggtcctcggaccgtacttcctcgtcggcctacgtaacgtcgtacggcctaaccgtcaccgtccctaccctacgacctatcgagggtcggaccgttccgggtccgtaggcgtggacgcgtacgtactacttacgtgtcgactagtaccgacgcgacaacgagtaggatcgatacgtcgtagnggtcggtggtcggtacggnggaacggtactaaacgtcgtaccgtacgtaggtaccg

SEQ ID NO: 25108 - DNA, 616 bp, Homo sapiens
  misc_feature: GYAE6OF02HNSV2.21.22.B11.1.454.CMB.1.raw
  modified_base (410)..(410): a, c, t, g, unknown or other
  misc_feature (410)..(410): n is a, c, g, or t
  modified_base (537)..(537): a, c, t, g, unknown or other
  misc_feature (537)..(537): n is a, c, g, or t
  modified_base (593)..(593): a, c, t, g, unknown or other
  misc_feature (593)..(593): n is a, c, g, or t
  modified_base (602)..(602): a, c, t, g, unknown or other
  misc_feature (602)..(602): n is a, c, g, or t
  modified_base (604)..(605): a, c, t, g, unknown or other
  misc_feature (604)..(605): n is a, c, g, or t
  modified_base (607)..(607): a, c, t, g, unknown or other
  misc_feature (607)..(607): n is a, c, g, or t
  modified_base (609)..(616): a, c, t, g, unknown or other
  misc_feature (609)..(616): n is a, c, g, or t
tcagtcgtcgctcgcacgaccggtgctcgatttagacgacagctcagggtcctgggcccagtctgtgctgactcagccaccctcagcgtctgggacccccggcagagggtcaccatctcttgttctggaggcaactccaacatcggaagtaattatgtattctggtatcagcaactcccaggaatcggaccccaaactcctcatccagaggaataatcagccggccctcgagggtccctgaccgtattctcgtggctccaagtctggcacctcacgccctcctagacctatcaggtcggccttccgggtccgaggtagtggaacggtctaggacctaagtttaccgtgtgactacgttcgaaccggggacacgaaacgtgtacggggacttagaaccaacttcgtaaggnggttcggggttagggtgtcgggacggtaagggaacccaaacgttcggaccgttccgtaggtacgacgacccgaggtaccgtccggtacccgttccgtcgtaaccgttccttccgttccccggtcccncccgttccgtccgttaccgtcctaacggtcgacgtcgggtcctggaccgaggccgnacggtacgntnngngnnnnnnnn

SEQ ID NO: 25109 - DNA, 660 bp, Homo sapiens
  misc_feature: GYAE6OF02GBZGI.21.22.B11.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggcaggagggtcaccatctcttgttctggaggcaactccaacagtcggaagtaattatgttattctaggtatcagcaacctcccgaggaactcggaaccccaactcctnactccagagaataactcagccgcctgtacgggtcctgacctattcctgtcggcctaccgtaagtccgtcggcctaccctcaccgtcccctcccgtaccgaacctacgttcgacgggttcgggtacccgttccccgggtacggaaggtacgtggaacggtctacgtaacgttacttaccgtgtcgacgtaactccgggaaccgggtaccacgaaaccgtaggttacggaataccgaagttactcggtaggtacgggttcggggtttggggtcggttaccggggaacggggaacggtaacccttaaaccgggttccggaacccggtttacggaacggtacccg

SEQ ID NO: 25110 - DNA, 822 bp, Homo sapiens
  misc_feature: GYAE6OF02G055R.21.22.B11.1.454.CMB.1.raw
  modified_base (210)..(210): a, c, t, g, unknown or other
  misc_feature (210)..(210): n is a, c, g, or t
  modified_base (327)..(327): a, c, t, g, unknown or other
  misc_feature (327)..(327): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcaactccaacatcggaagtaattatgtattctggtatcgagacaactccaggactccggaccccaaactcctcactccaagagaataactnacggccgcccgtcgacgggttcccagaccgtacttctacgtcgtacctactaacgtcgtcggacctacccgtccgtaacgtccctcccgtagaccctaattccggacggttcgggtcccgttacccgggggtccggtaagggtacgttcggggacgttacccgttacggtaaaccttttaaacggtttacgttcgggtaacggtacccgtaaaccgttcccggggtaaaacccggggtaccgtaaccgtaaaaccccgggttaggggtacccggggttaaagtttaaccggggtaaaacccttaaacgggtttttccccgggtagggggttaaaacccggggggttttcccggggggtttttaggggggtttaaacccgggttttaccggggggggaacccgggggttaaaacccgggtaaaccccggttaaaaccggggttacccccggggtaaaccccgggttttacccgggtaaacggggttaacccccggg

SEQ ID NO: 25111 - DNA, 690 bp, Homo sapiens
  misc_feature: GYAE6OF02F1RVQ.21.22.B11.1.454.CMB.1.raw
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggcaggcgggtcaccatctcttgttcgtaggagacaacctccaacagtacggaaagtaattagtgttattcgtaggtatcgagacaacctccgaaggtaatcccggaaccccctaaacctcctacactaccgaagaagaataactcgacggccgtcccgtacggtacgggtccctagaccgtattcctcgtacgtctaccgtagtccgtcgaccctaccttccgacgtccctacccgtcgaacccttaagtccgtagggtcccgggtcccgttacccggggtacggaaggtacggtaggacggtccttaagttaccgttacttcgtcggtctacgtacgtccgggaaaccgggcctaactaacgaacggtcggtaagtaccgtaaacgtcgttacgacgggtgggtccggggtttacgggtcggaccgggtacgggtacggtaaccctaacggcccggttacgttaccggtagtaacccg

SEQ ID NO: 25112 - DNA, 672 bp, Homo sapiens
  misc_feature: GYAE6OF02GNM1N.21.22.B11.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccgggcaggagggtcaccatctcttgttctggaggcaactccaacagtacggaagtaattatgtattctggtatcagcaactcccgagaactcggacccccaaactcctcatccagagaataancgagccgccctcgacgggtccctgaccgtattctcgtcggcctaccgtaagtccgtgacctacccgtccacgtccctcccctagacccaagttccgacgggttcgggcccgttcccggggtcccggaagggacgttagggacggctttacgtaaccttaacgtttactcggtacgccgtaacgttccgggaaccggggaccaacgtaaacgtggtaaggacttaacggaacctagtacggtcggggtaaggttccggggttttaggggtaccggttcggggaaccggggtaacgggaccctaaaacggttcgggaaccccggtttaccggacggttacccgg

SEQ ID NO: 25113 - DNA, 304 bp, Homo sapiens
  misc_feature: GYAE6OF02GSZ51.21.22.B11.1.454.CMB.1.raw
  modified_base (298)..(304): a, c, t, g, unknown or other
  misc_feature (298)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaacgtgaccgtcctaggtcagcccaaggctcgcccctcggtcactctcgtcccgcctctcctcgtctctactgagtcggctggcaggcgcatagnnnnnnn

SEQ ID NO: 25114 - DNA, 650 bp, Homo sapiens
  misc_feature: GYAE6OF02FZVEU.21.22.B11.1.454.CMB.1.raw
  modified_base (418)..(418): a, c, t, g, unknown or other
  misc_feature (418)..(418): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccgggcaggagggtccaccatcctcttgttctggaggcaactccaacatcggaataattatgtattctggtatcagcaactcccgaggatccggacccccaatcctcactccgagaagtaataatcgagccggccctcgacggggtccctaggaccgattctcgtgcctcaacgtctcggaccacctcacgtccctcccgtcactcgtcgnggcgggtcgtcccgggtacggaggtcgtaggaacggtctacggtaacttacgtttacgtgtacgtactaacggtcccgaacggggtccgaactaaccgagggtcggaaagttcggaaaccctagtccggtaggtccgggttacgggtttggggtaccgggtttaccgggacggggtaaccggtaaccccgtaaagggttcccgtaaccccgggtacggttaccgggtacccg

SEQ ID NO: 25115 - DNA, 821 bp, Homo sapiens
  misc_feature: GYAE6OF02IID5S.21.22.B11.1.454.CMB.1.raw
  modified_base (213)..(213): a, c, t, g, unknown or other
  misc_feature (213)..(213): n is a, c, g, or t
  modified_base (349)..(349): a, c, t, g, unknown or other
  misc_feature (349)..(349): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggagggtccaccatctcttgttctggacggcaactccaacagtcggaagttaattatgttattctggtatcgagacaactcccaaggaactccggaccccctaaactcctacactaccgaaggaagaaattaacncgagccgtcccgtacgacggggttcccctagaaccgtattcctacgtcggacctaccgtaaagttccgtacggaccctaccctaccgaccggtcccctttacccggtacgtaacccctacgttcggaacgggttccggggtacccgttccccggggtaaccggtaaagggtacggttacggaaccggggtaccttaacggtaacccgttttaacgtttaccggttcgggttaccgaccttaaaccgggttacccgggaaaccggggggtaacccttaaccggaaaacgtttcgggtaacgggtaaacgttaaccggaaaccttaaccggttccgggttaacggggtaaccgggggttccgggggtttttaagggggtaccgggtttaccccggggaacggggaacccggggttaaacccctaaaccgggtttcccggtaaccccgggtttaccggtaacgggtaaccccggg

SEQ ID NO: 25116 - DNA, 361 bp, Homo sapiens
  misc_feature: GYAE6OF02HKCZ0.21.22.B11.1.454.CMB.1.raw
  modified_base (319)..(322): a, c, t, g, unknown or other
  misc_feature (319)..(322): n is a, c, g, or t
  modified_base (324)..(327): a, c, t, g, unknown or other
  misc_feature (324)..(327): n is a, c, g, or t
  modified_base (329)..(361): a, c, t, g, unknown or other
  misc_feature (329)..(361): n is a, c, g, or t
tcagtcgtcgctcgcacgaccggtgctcgattttagacgacagctcagggggtccctgaccgattctctggctccaagtctggcacctcagcctccctgaccatcagtgggctccggtccgaggatgaggctgactattactggtgcatcgacgggacgcaacgatgggatgacaatctgagcggtttgggtagttcgggacggagggaccaaaactggaccgtcctaggtcagcccaaggctcgccccctggtccacgtcgtcgttccccgcctcctccgtcgtctctactgacggcggctggacaaggccacatagnnnncnnnnannnnnnnnnnnnnnnnnnnnnnnnnnnnnnnnn

SEQ ID NO: 25117 - DNA, 701 bp, Homo sapiens
  misc_feature: GYAE6OF02HDP7A.21.22.B11.1.454.CMB.1.raw
  modified_base (234)..(234): a, c, t, g, unknown or other
  misc_feature (234)..(234): n is a, c, g, or t
  modified_base (357)..(357): a, c, t, g, unknown or other
  misc_feature (357)..(357): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttcnggaggccaactccaacatcggaagtaattatgtattctggtatcagcaactccaggaactcggccccaaactcctcactccgagagaataatcagccggcctcgacggggtccctagaccgtnttacctcgtcggctaccaacgttctacggaccctacccgttcacccggtcccttccccgtcgaaccctacgttaccgaacgggtttcggggacccttacccgggggtaccgacggggtaactcgggtaaaccgggtcgttacggaaccttttaacgttaccggttcgtacgaccgtacgttacccgaacggggggtaaccctacgtaaaacgtcgggtaagggaacttaggaaccgtaacgttccgttagggacgggttaccggggtttgggggttccggttacggggacggtaacgggtaacccctaaaggttcgggtaaccccgttggtaacgggtacccgg

SEQ ID NO: 25118 - DNA, 788 bp, Homo sapiens
  misc_feature: GYAE6OF02FT61A.21.22.B11.1.454.CMB.1.raw
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcacgccaccctcacgcgtcgtccggggacccccgggcaggacgggtccaccattcctcttgttcgtgggacggacaaccgtaccaacgagtacggaagttaattatagttattcgtaggttactcacgaccaacctacccgaaggtaacgtcccggaccccctaaactcctaccactccgaaggtaacggaaattaactcgacggcccggtaccctacggaccgggggttccctacgtaccgttacttcccgtacgtcgggtaccttaaccgtaacgttccggtaccggtaccctacccgtaccgacccgtccccgtttccccgtaaccggtaaccttacgtaccggtccggggttaccgggtcccggttacccggggtacggaacgggtacgttacgggtacggtccgttaacggttaacctttaacgtttccggttacggtcggtaactacggtaccgggaaccggggtaaccaaccggtaacgttacgggtacggtaaacttagaaccttacgtacggtagggtacgggttcggggtttacggggtcggttaccgggacgggtaaccggaaccgttaacgtccggtaccgtaccgttaggaccgg

SEQ ID NO: 25119 - DNA, 579 bp, Homo sapiens
  misc_feature: GYAE6OF02FJYCK.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagacgggtcaccatctcttgttctggaggcaacctcaacatcggaataattatgtattctggtatcagcaactcccaggaatcggacccccaaatcctcatccagagaaatatcagccgcctgacgggtccctgaccgattctcgtggctacgaagtctggcctacctcacgtccctcccgagaccctatcgacggtcgggcctccgggtcgaggatggacgtctacgacttagttacgtgtacgctaacgtccgacggggtacacgtaaacgtagtacgggatacgactacgtcgtaggaggtcgggtttgggtcgttcggggacggacgggtaacctaaacggtcggtaacccgtcgtacggtccg

SEQ ID NO: 25120 - DNA, 626 bp, Homo sapiens
  misc_feature: GYAE6OF02FFWP1.21.22.B11.1.454.CMB.1.raw
  modified_base (211)..(211): a, c, t, g, unknown or other
  misc_feature (211)..(211): n is a, c, g, or t
  modified_base (326)..(326): a, c, t, g, unknown or other
  misc_feature (326)..(326): n is a, c, g, or t
  modified_base (472)..(472): a, c, t, g, unknown or other
  misc_feature (472)..(472): n is a, c, g, or t
  modified_base (507)..(507): a, c, t, g, unknown or other
  misc_feature (507)..(507): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatcctcttgttctggacgcaacctccaacatacggaagtaatatgtatctggtatcagcactcccaggactcggacccccaaatcctacactccgagagaatancagccggacctcgacggggtccctagaccgtattcctctcggacctaccaagtcctggacctaccctgacgccccttaccagaccatccgaggtccgggtccgtcccgggtacggagacgtggacggccttacgacttattaccgngttcgacctagccgtaacggggaccactaaaccgngttagggactacggtaactaacgttccgagggtaccgggttggggttacgggttaccggtttccgggaacgggaccgggtaaacctaaccggccggtaacccgtttcggtacggtaccg

SEQ ID NO: 25121 - DNA, 343 bp, Homo sapiens
  misc_feature: GYAE6OF02IVJIO.21.22.B11.1.454.CMB.1.raw
  modified_base (296)..(296): a, c, t, g, unknown or other
  misc_feature (296)..(296): n is a, c, g, or t
  modified_base (302)..(304): a, c, t, g, unknown or other
  misc_feature (302)..(304): n is a, c, g, or t
  modified_base (306)..(309): a, c, t, g, unknown or other
  misc_feature (306)..(309): n is a, c, g, or t
  modified_base (311)..(311): a, c, t, g, unknown or other
  misc_feature (311)..(311): n is a, c, g, or t
  modified_base (313)..(314): a, c, t, g, unknown or other
  misc_feature (313)..(314): n is a, c, g, or t
  modified_base (316)..(343): a, c, t, g, unknown or other
  misc_feature (316)..(343): n is a, c, g, or t
tcagtcgtcgctcgcacgaccggtgctcgatttagacgacagctcaggggtccctggaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaacgtgaccgtctaggtcagcccaagctcgccccctggtcactcgtcgttccccgccctcctcctcgtctctactgagcggctggacaggcncatagnnnannnncngnngnnnnnnnnnnnnnnnnnnnnnnnnnnnn

SEQ ID NO: 25122 - DNA, 685 bp, Homo sapiens
  misc_feature: GYAE6OF02HI1OQ.21.22.B11.1.454.CMB.1.raw
  modified_base (243)..(243): a, c, t, g, unknown or other
  misc_feature (243)..(243): n is a, c, g, or t
  modified_base (278)..(278): a, c, t, g, unknown or other
  misc_feature (278)..(278): n is a, c, g, or t
  modified_base (670)..(670): a, c, t, g, unknown or other
  misc_feature (670)..(670): n is a, c, g, or t
  modified_base (674)..(674): a, c, t, g, unknown or other
  misc_feature (674)..(674): n is a, c, g, or t
  modified_base (680)..(680): a, c, t, g, unknown or other
  misc_feature (680)..(680): n is a, c, g, or t
  modified_base (682)..(682): a, c, t, g, unknown or other
  misc_feature (682)..(682): n is a, c, g, or t
  modified_base (684)..(684): a, c, t, g, unknown or other
  misc_feature (684)..(684): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatcggccccaaactcctcatccagaggaataatcagcgccctcgacgggtccctgaccgnttctctggctccaatctggcacctcacgcctccgngaccatcacggtcgggcctccggtccggaggatggagggctgtaacttattacgtgtcgctacgtccggaacgggtacgacaacgagtagggtacgtgaaactaagtcgtaggacggttcggggttagggtggttaccgggcgggaaggggtaaacccctaaaggtccggtaacccggttaccgtaacgggttaccgaacgggtacccgtaaacgggtccgtcccggtacccccggttcggtaccctaacccggttccgtttacccggttccccccgtcccgttccccttacccggttccttacccgttacccgttacgttaccggaccgggtccggtaccggtacgggacccgtacgggtccggacgtacgttaaggcgtccgatcgagcncggnaccgtncncnc

SEQ ID NO: 25123 - DNA, 751 bp, Homo sapiens
  misc_feature: GYAE6OF02H2BEK.21.22.B11.1.454.CMB.1.raw
  modified_base (210)..(210): a, c, t, g, unknown or other
  misc_feature (210)..(210): n is a, c, g, or t
  modified_base (286)..(286): a, c, t, g, unknown or other
  misc_feature (286)..(286): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctcgggccagtctgtgctgactcagccaccctcagcgtcgtcgggaccccggnaggaggtccaacctatctcttgttctggagacaactaccaactagtacggtaagtaattatcgtattacgtggtancagcaactaccgaaggaacgttcggaaccccctaaactcctcaactacgaacggaaggtaaaataactcgtaacggccggtacccgtaggtaccggggtaccctagggaaccttacgttcctcgtacggtacctaccgtaacgtctacggacctaccgtacaccgtcccttacctccgtaacctacgtacgtaacggttcgggccgttacccgggtaccggagggtacttaagggaaccgtcgtacgttaaccgttaacgttacgtacggtacgaccgttaaacgtccgggaaacccggtaccggtaacaaaccgttaacgggtaacggtaagttaaccgtaaacgttacgttacgaaggggttaaccggttcgggggttttacggtaacggggttacccgggaaccgggttaacgggaaacccgtaacgttaccgggtaccccgtttaccgggtagtaacccgg

SEQ ID NO: 25124 - DNA, 632 bp, Homo sapiens
  misc_feature: GYAE6OF02G18KI.21.22.B11.1.454.CMB.1.raw
  modified_base (236)..(236): a, c, t, g, unknown or other
  misc_feature (236)..(236): n is a, c, g, or t
  modified_base (298)..(298): a, c, t, g, unknown or other
  misc_feature (298)..(298): n is a, c, g, or t
  modified_base (314)..(314): a, c, t, g, unknown or other
  misc_feature (314)..(314): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctggcccagtctgtgctgactcacgccaccctcagcgtctcgggacccccggcagagggtcaccatctcttgtctggngcactcacatcgaagtatatgtattctgtatcagcaactccaaggatcggaccccaactccncactccagagaactancagccgcctgacggtccngacctnttctcgtgctacagtctggccacctcacgtccctccgtacgacctacgtacgacgggttcggccgtacccgggacgaggagtggacggctacgtactacgttactggtcacgtagccggaaccgggacaccgtaaacgtcggtaaggggtatacggtaactaacgtttccgaagggttacgggttaccgggggttttcggggttacgggtttaacccggggggacgggtaaaccggggtaaccccttaaaccggggttaccgggtaaccccggttttaccgggaaggtacccgg

SEQ ID NO: 25125 - DNA, 314 bp, Homo sapiens
  misc_feature: GYAE6OF02GXXE4.21.22.B11.1.454.CMB.1.raw
  modified_base (304)..(314): a, c, t, g, unknown or other
  misc_feature (304)..(314): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaacgtgaccgtcctaggtcagcccaaggctcgccccctggtcactcctcgttcccaccctcctcctcgtctctactgacggcggctggcaaggcacatagnnnnnnnnnnn

SEQ ID NO: 25126 - DNA, 777 bp, Homo sapiens
  misc_feature: GYAE6OF02HTD8N.21.22.B11.1.454.CMB.1.raw
  modified_base (746)..(746): a, c, t, g, unknown or other
  misc_feature (746)..(746): n is a, c, g, or t
  modified_base (772)..(772): a, c, t, g, unknown or other
  misc_feature (772)..(772): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgtctggaggcaactccaacatcggaagtaattatgtattctgtatcagcactccagaatcggccccaaactctcatccagaggaataatcagccgcctcgacgggtcctagaccgtattctcgtacggctccaagtccgtcggccacctcacgtcccctaccccgtcgaaccctactcgtacgggtcgggtacccgttccccgggttacccggaagggtacggtggtaaccgggtcgttacgtaaccgtttaacgtttaaccgttgggtacgtaccgtaacgttaccggaaccgggggtaaccaacccgtaaacgtaacggttggggaataccggtaaacgtaactcggttaggaacggttcggggtttcggggtttacggttaccgggaccggggaaaccgggtaacccgaaacgttccggtaaccccgggttccgtaacggtaccgaccgacccggtaacggtccgtacccggtccccgttacccgggtcctacgttcccgttacccgttcccccgtaccccgtttccgttccccgttccgttaccttacccgttaacgtccgggtcgaccggggtccgtacgggtacccgtacgggccggtaccgttaacggcggtaaccngtaccgactcacgcgtcgagtagtcncgtcg

SEQ ID NO: 25127 - DNA, 309 bp, Homo sapiens
  misc_feature: GYAE6OF02FSWPD.21.22.B11.1.454.CMB.1.raw
  modified_base (296)..(296): a, c, t, g, unknown or other
  misc_feature (296)..(296): n is a, c, g, or t
  modified_base (301)..(309): a, c, t, g, unknown or other
  misc_feature (301)..(309): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcacgcccaaggcctcgccccctggtcactctcgttcccacctcctcctcgtctctactgagcggctgcgaaggcgnatagnnnnnnnnn

SEQ ID NO: 25128 - DNA, 861 bp, Homo sapiens
  misc_feature: GYAE6OF02JCXQV.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccacctcagcgtcgtcggggacccccgggnaggacgggtccaccatctcttgttctggacgcaacctccaacatacggtaaactaattagtgtacttcgtaggtatcgaagccaaccgtcccgtaaggaacgttccggaacccccctaaacttcccctactacctacccgaagggaacggtaaaactaaacgtccgaacggccccgggtaccccgttcgggaaccggggggttcccctacgggaacccggttaactttcccgttacgtcccggggtacctttacccgaaacgggtttcccgtacggggtacccctaaccccctacggaacccggttccccctttaccccgtaaccggtaacccctaacggtttcccgtaacgggggttccgggtacccgggtttaccccggggtaacccggggtaacgggtaagttccggggaaacgggtttccgttaaccggtaaacccttttacgtttaaccgtcggttaccgtaccgtacgttaccccgggaacggggttaaccaccgtaaaacgcggttacgggaacttacgaaccgtaacttcgggaagggtcgggttaaccgggggttttcgggtcggttacccgggggaacgggaaccggtaacccggtaaacggttcccggtaacccggtttacccgtaggtaaccccgg

SEQ ID NO: 25129 - DNA, 615 bp, Homo sapiens
  misc_feature: GYAE6OF02GA6XP.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcgaagtaattatgtattctggtatcagcaacctcccaggaactcggacccccaaactcctacactcccaaggacggaaataactcgacgccggccctcggacggggtcccctgacccgtattccgtcgtcggcctccgaaaggttcctcgggacccaccgtcgacgcccttcccgtacgaccactcgaggtcgggccttaccgggcgaggtatcggacggtctacgacttaacttcgtgtcgacctagtccggacgggtacgaccgaactcggtaggaactacgtaacagtcgtaggacggttcgggttagggtcgttaccgggacgggacggtaccgtaacgtcggacccgttcgaggtacccg

SEQ ID NO: 25130 - DNA, 798 bp, Homo sapiens
  misc_feature: GYAE6OF02GM1XV.21.22.B11.1.454.CMB.1.raw
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctnagcgtcgtcgggacccccggnaggaggtccaccatctcttgttctggagcaactccaacagtacggaagtaattagtgttacttcgtaggtactacgagacctaaccttacccgaaggaacgtccggacccccctaaaaccttcccgtacctaactacccgaaggtaacggtaaataacgtcgacggtcccggtaccccgtacggaccggggtccctagtaaccgtacttcctcgtacggcctaccgtaacgtccgtacggaccctaccgtacctacgtcccctaccccgtacgtaaccctacgttccggaacggggttcccgggtacccgttaccccggggttaccggtaaggggtaccgttagggtaaccggtaccgttacgtaaccgtttaaagtttaccgtcgggtacctacgtaaccgtaccggggtaacccggaaccgtaacgaaacgtacgggttacggggtaactaccgtaaagtaccgttcggtacggggtaacgggtttcggggtttacgggggttccgggttaacccggggacggggtaaacccggtaccggttaaaaccggttcccgggaacccggtttacggtacggtaacccgg

SEQ ID NO: 25131 - DNA, 633 bp, Homo sapiens
  misc_feature: GYAE6OF02JFNS1.21.22.B11.1.454.CMB.1.raw
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
  modified_base (317)..(317): a, c, t, g, unknown or other
  misc_feature (317)..(317): n is a, c, g, or t
  modified_base (352)..(352): a, c, t, g, unknown or other
  misc_feature (352)..(352): n is a, c, g, or t
  modified_base (439)..(439): a, c, t, g, unknown or other
  misc_feature (439)..(439): n is a, c, g, or t
tcagtcgtcgctcgcacgaccggtgctcgatttagacgacagctcagggggggggaagctcagcttcagctgtggtacgagaagacaggactcaggacaatctccagcatggccggcttccctcgtacctcctcaccctctcacctcactgcgtcagggtcctgggcccagtctgtgctgacctcagcaccctgagcgtcgtcgggaccccggnagaggtcaccatctctgtctggagcactcacntcgaagtatacagtattcaggtactcagcactccagtancggccccaatcctcactccaggacgactaacncagcgcctcggacggtcctacggaccgtacgttcncgtacggcttacgaacgtctacgggcctaccgtacacgtccctcgtcgaacctatccgaggttacggctacccgggtacgaggtacnggtacgtctagacttattaccgtgtgacctaggtacccgacgggttacgcccgtaaagtacgggttcgggaaccttacgggaaccgttagtaccggttaggaaacgggtttcccgggtttagggttcccggtacggggtcccgggaacgggtaacccttaaaccggtcggtaccccggttagttacccgggaac

SEQ ID NO: 25132 - DNA, 730 bp, Homo sapiens
  misc_feature: GYAE6OF02H0E6M.21.22.B11.1.454.CMB.1.raw
  modified_base (717)..(717): a, c, t, g, unknown or other
  misc_feature (717)..(717): n is a, c, g, or t
  modified_base (722)..(722): a, c, t, g, unknown or other
  misc_feature (722)..(722): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcatccagaggaataatcagcggccctgagggtccctgaccgattctctggcctccaagtctcggcacctcacgcctccctgaccatccgaggtcggctcccggtccgaggacgtggagtcgtacgacgttacttacgtggtcgactacgtccggacgggaacgacgtaaaaggtgggaactagaactaaactcggtacggacgggttcgggtttggggttacggtttacggggaccgggtaacggggtaacccgtaaaacgtccgggtaaccccggttacccggttaacgggtacccggtaaccggtacccgtaaaccggggtcccggttaacccggtccccccgttaccggggttaccctacccgttaccgttacccgttacccccgtaacccgtccccgttcccggttacccgttaccgttcccgtaaccgttcggtaccggtccggggtcccgtacggaaccgtaaccgggtccgtaccgacgtacggacgcgtcgcgtacgacgcgtacngtcgngtcaggcg

SEQ ID NO: 25133 - DNA, 699 bp, Homo sapiens
  misc_feature: GYAE6OF02JFPFE.21.22.B11.1.454.CMB.1.raw
  modified_base (252)..(252): a, c, t, g, unknown or other
  misc_feature (252)..(252): n is a, c, g, or t
  modified_base (314)..(314): a, c, t, g, unknown or other
  misc_feature (314)..(314): n is a, c, g, or t
  modified_base (369)..(369): a, c, t, g, unknown or other
  misc_feature (369)..(369): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccaggtctgtgctgactcagccaccctcagcgtctcgggaccccccgggcagagggtcaccatctcttgttctggaggcaactccaacngtcggaagttaattatagttattctggtatcagcactcccaggaatcggaccccaactcctnactccagacggaactatcgagccggccctcgacggggtccctgaccgtattcctntcggacctcgaacgtctacggcctaccctcacgcccttacccgtgacccatcgacggttcgggccttcccgggtcgaggtatcggaacggttctaggttaccttaagtttaccgtggtacgtaccgtaattacccgggaacgggggaccaacctaaacgtaccgggtttaggggaactttcggaaaccgttacttcggtacgggtaacgggtttccggggggtttaacggggttcgggtttacccggggggaccgggtaaacgggggtaacccccttaaaacgggttcccgggtaaccccggtttaccccgggtaaagggttcccccggg

SEQ ID NO: 25134 - DNA, 664 bp, Homo sapiens
  misc_feature: GYAE6OF02GAGFP.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggagcaactccaacatcggaagtaattatgtattctggtatcagcaactcccaggaactcggacccccaaactccctacactccaagacggaaataactcgagccggccctcgacggggtccctagacccgtattccgtactggtcctaccgaagtcctcggcctaccgtcacgtccctaccctacgaacccataccgtaggtcgggccttcccgggtacggaggtacgtggaacggtctacgtacttacgtttacgtgtcgacctacgtaccgaccggggactaccgaaactaggttacgggactacggtaactaagttcggtaggtacgggtccgggttttagggggttacgtttcccgggggaacgggtaaccggggtaaccctaaaccgggttcggtaaccccggtttaccggtaggtaaccccgg

SEQ ID NO: 25135 - DNA, 673 bp, Homo sapiens
  misc_feature: GYAE6OF02IZRKX.21.22.B11.1.454.CMB.1.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
tcagtcgtcgctcgcacgaccggtgctcgatttagacgacagctcaggggggggggaagctcagcttcagctgtggtagagaagacaggactcaggacaatctccagcatggccggcttcctctcctctcacctcctcactcactgcgcagggtcctgggcccagtctgtgctgactcagccaccctcagcgtctgggacccccggcagagggtcaccatctcttgttcnggaggcaactccaacntcggaagtaattatgtattctggtatcagacaactccaggaactcggacccccaaactcctcaactccaagaggaataactcagccggccctcgacggggtccctggacccgtattcctctcggcctaccaagtcctggcccaccttccacgtccctccccgtagaaccctagtacccgtagggtcggggtcccttacccgggggttacccgaagggtacgttcggacgggttccgtacggttaacccttaagtttaacccgttgggtacggtctacgttaccgaaccggggtaccgacaaaccgtagggtcgggaattaccgaatacttcggtagaacgggttcggggtttagggttacgggttccgggacggggacggtaacccgtaaacggttcccggtaacccggtttccgtagggtaccccg

SEQ ID NO: 25136 - DNA, 636 bp, Homo sapiens
  misc_feature: GYAE6OF02GKA5O.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcggggacccccgggnaggacgggtcaccatctcttgttctggaggcaactccaacatcggaagttaattatgtattcgtggtatcagcaacctcccgaaggtaatccggacccccaaactcctacactaccagaaggaataatcgacgccggaccctcggacggggttccctaggaacccgtatttcctacgtcggaccttacgtaacgtcgtcgaccgtacctcgacgtccctcctacgacctagtcgacggtcggtccctccgggaccgaggtacggtcgggctacggtaacttagttacgtggtcgactacggtaccgggtaacggacacgaacgtaggtcggacgttagacctagtcgtaggacgggttcgggttaggtcggtacgggaggtaccggaaccaggtccggtacccgttacggtacggacgaacccgg

SEQ ID NO: 25137 - DNA, 815 bp, Homo sapiens
  misc_feature: GYAE6OF02GT2CZ.21.22.B11.1.454.CMB.1.raw
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggaccccggnaggaggtcacatctcttgttcgnggagacaactaccaacacgtacggtaagttaattatagttattcgtaggtatcgagacctaactcccgaaggtactccggaacccccctaactcctacactaccgaaggaacggtaaactaacgtccgacgggtccccggtaccccgtagggtacccggggttccctaacgggtaacccgttagtttcccgtacggttcggtacccgttaacccgtaaacgggtttcccgtacgggacccttaaccccggtcgtaacccggtccccctttaccccgtaacgtaacccgtcggttaacggtaaccggggtccggggttcccgtacccggggttaacgacgggttacgcgggtacgttaccgttaggtacctttaacgttcggtgtacgtacgtacgtacccgggaaccgggacctaacgaaccgttaagggtacgggtaacgtaaccgtaacgttacgttcggacggggtttaacggggttcggggttttaccggggttaacgggttcccgggggaaaccgggtaaccggtaaccctaaacgggttcccgggtaaccgttcccggttaaggtaaccccgg

SEQ ID NO: 25138 - DNA, 697 bp, Homo sapiens
  misc_feature: GYAE6OF02IZY1A.21.22.B11.1.454.CMB.1.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (569)..(569): a, c, t, g, unknown or other
  misc_feature (569)..(569): n is a, c, g, or t
  modified_base (598)..(598): a, c, t, g, unknown or other
  misc_feature (598)..(598): n is a, c, g, or t
  modified_base (606)..(606): a, c, t, g, unknown or other
  misc_feature (606)..(606): n is a, c, g, or t
  modified_base (617)..(617): a, c, t, g, unknown or other
  misc_feature (617)..(617): n is a, c, g, or t
  modified_base (650)..(650): a, c, t, g, unknown or other
  misc_feature (650)..(650): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctctcacctcctcactcactgcgcagggtcctgggcccagtctgtgctgactcacgccaccctnagccgtcgtcggggaccccccggnaggagggtcaccatcttcgttgttcgnggacggacctaaacctccaaaacncgttacggaaagttaattaagtcggttattacgtggtaactcaacgacctaacctacccgaacggtaacgtcccggtaaccccctaaacttcccgtactacctaccgaaggaaacggtaataactaccgacgccccggtcctcggaaccggggttcccctaggtaacctcgtttccgtacgttccgacttccgtaagtccgtcgtccaccctcgaccgtcccctcccgtagacccacgtaccggtgtccgggtacccgtaccggtccggtaagcgttacgacggtcttcgaaccttattaccggngtcaccgtagccggtaaccgcacgtaagngttaggtnacgtataccgngtacgggtcggtagggtttggggaacttccggngggaaaccggttacctaaaggtccgacccgtttaccggtaggtcccg

SEQ ID NO: 25139 - DNA, 324 bp, Homo sapiens
  misc_feature: GYAE6OF02IY3AZ.21.22.B11.1.454.CMB.1.raw
  modified_base (299)..(324): a, c, t, g, unknown or other
  misc_feature (299)..(324): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggaggaccaaaactgaccgtcctaggtcagcccaaggctgccccctcggtcactctcgttcccgcctcctcctcgtctctactgacgcggctggcaaggcgcatagnnnnnnnnnnnnnnnnnnnnnnnnnn

SEQ ID NO: 25140 - DNA, 626 bp, Homo sapiens
  misc_feature: GYAE6OF02HXVJX.21.22.B11.1.454.CMB.1.raw
  modified_base (274)..(274): a, c, t, g, unknown or other
  misc_feature (274)..(274): n is a, c, g, or t
  modified_base (344)..(344): a, c, t, g, unknown or other
  misc_feature (344)..(344): n is a, c, g, or t
  modified_base (611)..(611): a, c, t, g, unknown or other
  misc_feature (611)..(611): n is a, c, g, or t
  modified_base (615)..(615): a, c, t, g, unknown or other
  misc_feature (615)..(615): n is a, c, g, or t
  modified_base (619)..(619): a, c, t, g, unknown or other
  misc_feature (619)..(619): n is a, c, g, or t
  modified_base (622)..(622): a, c, t, g, unknown or other
  misc_feature (622)..(622): n is a, c, g, or t
  modified_base (624)..(625): a, c, t, g, unknown or other
  misc_feature (624)..(625): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatcggacccccaaatcctcatccagaggaataatcagcggccctgacgggtccctgaccgattctctggcctaccgaagtctggcaccctnacgtcctccctgacccatccaggtcgggcctcccgggtccgaggactggagtccgtgacgtacgtttacnggtcgacacgtccgaacgggtacaccaaccgtagtcgggaattacgaactaagtccgtgaaggtcgggtttcgggtggttccgggacgggtaacgggaccgtaaacgtcggtacccgttcgtacggtacgtacggacccgtaggccctacggcccccgttcggtacctacgtcctcgttccccaccctccgttccgtaccgtccgtccgtacgtcgacggtccgggcgtaccggacgtaacggcgaccgtacgtacggctgaccgtnccgngcgncgncnnc

SEQ ID NO: 25141 - DNA, 573 bp, Homo sapiens
  misc_feature: GYAE6OF02G2C09.21.22.B11.1.454.CMB.1.raw
  modified_base (371)..(371): a, c, t, g, unknown or other
  misc_feature (371)..(371): n is a, c, g, or t
  modified_base (559)..(566): a, c, t, g, unknown or other
  misc_feature (559)..(566): n is a, c, g, or t
  modified_base (568)..(573): a, c, t, g, unknown or other
  misc_feature (568)..(573): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactccaggaatcggccccaactcctcactccagaggaataatcagccggccctcgacggggtcccctgacccgtattcctcgtggcctaccaagttctcggcctacctcacgccctccctgacccatcgaggtcgggcctccggtccgaggactggacggctagactattactgtcgcatcgacgggacactaaagnggatgactagtcgtagaggtcgggttggtcggtcggcgggaacgggaacctaacgcggtaccgtaccgtaggtccgacgacccgaaggccgtccgaccccgtcggtcctaccgttcgtcccgttccctccctccctccgtccgttctccttacgtcgacggtccgtcgtcgacgacggcgacagtacnnnnnnnncnnnnnn

SEQ ID NO: 25142 - DNA, 658 bp, Homo sapiens
  misc_feature: GYAE6OF02HK5AC.21.22.B11.1.454.CMB.1.raw
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (268)..(268): a, c, t, g, unknown or other
  misc_feature (268)..(268): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcgggacccccgggnagagggtcaccatctcttgtcnggagcaactccaacatcggaagtaattatgtattcnggtatcagcaactcccgaggaatcggcccccaaatcctcactccagaagaataatcagccggcctcgacggggtccctgaccgtattctctggcctaccgaagtcctggcctacctcacgtccctaccctgaacccatcgacgggtcgggccgttcccgggtaccggaaggtagttcggaacggtctacggtaacttaacgttacgtcggtcgacctaacgttccggaaccgggggtaactacccaaagtacgtacggggaacttacggaactaacggtttccgtagggaacgggttccggggttttgggggttccggtttaccggggaccgggtaacgggaaccccttaaaacggttccgggaacccgtttacccggtaaggtacccgg

SEQ ID NO: 25143 - DNA, 315 bp, Homo sapiens
  misc_feature: GYAE6OF02HHFGY.21.22.B11.1.454.CMB.1.raw
  modified_base (294)..(294): a, c, t, g, unknown or other
  misc_feature (294)..(294): n is a, c, g, or t
  modified_base (301)..(302): a, c, t, g, unknown or other
  misc_feature (301)..(302): n is a, c, g, or t
  modified_base (304)..(315): a, c, t, g, unknown or other
  misc_feature (304)..(315): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggaggaccaaactgaccgtcctaggtcacgcccaaggctcgccccctggtcactctcgttcccaccctcctcctcgtctctactgagcggctggccaaggcncagtagnngnnnnnnnnnnnn

SEQ ID NO: 25144 - DNA, 715 bp, Homo sapiens
  misc_feature: GYAE6OF02IN1J6.21.22.B11.1.454.CMB.1.raw
  modified_base (214)..(214): a, c, t, g, unknown or other
  misc_feature (214)..(214): n is a, c, g, or t
  modified_base (433)..(433): a, c, t, g, unknown or other
  misc_feature (433)..(433): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggacccccggnaggagggtcaccatctcttgtctggagcaactccaacagtacggaagtaattagtgttattcgtggtatcgagccaacctcccgaaggtaactccggaaccccctaaacgtcctacactccgaagaacgtaaataactcgacgccggccctacggtacgggtccctaggaaccgtattcctacgtcggtcctacgtaacgtccgtcggacctaccgtcnccgtaccctccgtacgaacctatccggtacgggtccgggtcccgttacccggggttacggaacggtcgtacggggtacggtccttacggtaaactttacgttacggtcggttaccgactaaccggttccggaaaccggggtacaaccgtaaacggttaggtacgggtaactacggtaacctaagttccggtagggaaccgggtttcggggtttacgggtcggtacccggggacggtaacgggtaaccctaacggtaccggtacccggttcggacggtaccgg

SEQ ID NO: 25145 - DNA, 338 bp, Homo sapiens
  misc_feature: GYAE6OF02FGS40.21.22.B11.1.454.CMB.1.raw
  modified_base (309)..(309): a, c, t, g, unknown or other
  misc_feature (309)..(309): n is a, c, g, or t
  modified_base (311)..(338): a, c, t, g, unknown or other
  misc_feature (311)..(338): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggtgggtgttcggcggagggaccaaactgaccgtcctaggtcagcccaaggctcgccccctcggtcactcctcgttccccgccctcctcctccggtctcctctgacggcgggctggcaaggcgccagtagntnnnnnnnnnnnnnnnnnnnnnnnnnnnn

SEQ ID NO: 25146 - DNA, 585 bp, Homo sapiens
  misc_feature: GYAE6OF02IYRKP.21.22.B11.1.454.CMB.1.raw
  modified_base (502)..(502): a, c, t, g, unknown or other
  misc_feature (502)..(502): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(585): a, c, t, g, unknown or other
  misc_feature (581)..(585): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggccccaaatcctcatccagaggaataatcagccggccctcgaggggtccctggaccgtattctcgtcggctaccaagtcctggccaccctcacgccctcctgaccatcaggtcgggcctccgggtaccgaggatggacgctgaaccttattacgtgtgctaatccgaacgggacgacaacgtagtgggatgaactaagtctggaggtcgggttgggtcggttcggacggacgggaaccgaacgtcgaccgttccgtacggtcaacggcccgtaaggccgtcgccccgttcggtcctaccgtcttcccgttccccncccgttccctccctccgtcctaccgtaccgtcgacggtccggtctcggacacggccgagtacgtagcntncgcgncngnnnnn

SEQ ID NO: 25147 - DNA, 537 bp, Homo sapiens
  misc_feature: GYAE6OF02FHUHW.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaacatcggaagtaattatgtattctggtatcagcaactcccaggaatcggcccccaaactcctcatccagagaataatcagcgcctcaggggtccctgaccgattctctggctccaagtctggcacctcacgccctccctgaccatcagtcggctccggtcgaggatgaggctgactatactgtgcatcgaacgggcgacaacgtgtagggatagactatcgaggtaacggcgggttgggtggttccgggcgggaacgggacccgaaacgtcggtaacccggttcgtacggtacg

SEQ ID NO: 25148 - DNA, 930 bp, Homo sapiens
  misc_feature: GYAE6OF02HJZF3.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccccgggnaggacgggtcaccgtatccttcttgttcgtgggaggccaacctccaaacagtaccggtaaagttaaatttacgttagttaactttcgttagggttacttaccgaacggtacctaacccgtaccccgaagggtaaacgtaccccgggtaacccccctaaaaccttcccctacctaaccgttaccccgaagggtaaacggtaaaacttaaacgtccgaacgggccccgggtaccccgttaaccgggtaccgggggttacccctacggaacccgtttactttcccgttacggtccgggtacccttaacccgtaaacggttcccggttaccgggtacccgtaaccccgttaccggaacccgttacccccgttaccccgttaccgaacccctaacggttacccggtaacgggtcccggggtacccgttacccggggtaacccggaacgggtacgttaccggggaacggtaccgttacggttaaacctttacgtttaccgtcggtttacgaccggttaaccgtacccgggaacggggtaacccgtaaccgtaacggtaacgggttacgggtaacgttaacggtaaaccgttacggttcggtacggggttaaggggttcccgggggttttacggggttacgggggttaaccgggggaccgggtaaccgggtaacccgtaaaccggttcccgggtaacccggtttacccggtaggtaaccccgg

SEQ ID NO: 25149 - DNA, 793 bp, Homo sapiens
  misc_feature: GYAE6OF02IC45R.21.22.B11.1.454.CMB.1.raw
tcagtcgtcgctcgcacgaccggtgctcgatttagacgacagctcaggggggggggaagctcagcttcagctgtggtagagaagacaggactcaggacaatctccagcatggccggcttccctctcctctcaccctcctcactcactgcgcacgggtcctgggcccagtctggtgctgactcagccacctcacgcgtcgtcggggacccccgggcaggagggtccaccattctcttgttcgtaggacgcaactccaacagtcggtaaagtaacttatgttattctaggtatacacgacaactacccgaaggtaactccggaccccaaactcctacactaccgaaggaacggtaaataactacgacggacccggtccctacggtaaccgggggttcctacggtacctagtttctcgtcggtctaccgtacgttcgtacggtacctacccgtacgtaaccgtcccttacccgttactaaccgggggggtaactcggtacgggtaccgggtccggttacccgggttaccggacgggtaacggaggaaccggtacgttacggttaccgttaacgttacgttacgttacgtaccgtacgtaccggtaaccgggtaccggtaaccgaaccggtaaacggtacggtaacgtaacgaacgtaaccgttacggttacgggtaacgggttaccggggttaggggtttaccgggttaccgggggtaaccggggtaaccgggtaaacccgggtaaaccggttaacccgggtaacccgggttaacccggttaccggttaacccggg

SEQ ID NO: 25150 - DNA, 308 bp, Homo sapiens
  misc_feature: GYAE6OF02F0KJ9.21.22.B11.1.454.CMB.1.raw
  modified_base (301)..(308): a, c, t, g, unknown or other
  misc_feature (301)..(308): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctcgttcccgccctcctcctcgtctctactgagcgggctggcaaggcgcatagnnnnnnnn

SEQ ID NO: 25151 - DNA, 576 bp, Homo sapiens
  misc_feature: GYAE6OF02GFZZT.21.22.B11.1.454.CMB.1.raw
  modified_base (211)..(211): a, c, t, g, unknown or other
  misc_feature (211)..(211): n is a, c, g, or t
  modified_base (439)..(439): a, c, t, g, unknown or other
  misc_feature (439)..(439): n is a, c, g, or t
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggagcaactccaacatacggaagtaatatgtattctgtatcagcactccgagaatcgacccctaaactcctcactccagacgaaataactcagcggccctacgacggggtccctggaccgtattcgtctcggtacctaccgaatccgtggtaccacgtccgacgtccctcccgtagacctatcgagtccggcgtccggtcgaggntaggacgcttagacttaattctggcncgtacncgtacgggacacagtgacggtatgaactacgcgtaggtcggtgggttcgggtggttaccggcgggaaggaccctaaacggttccgaaccgggttcctaggtaccg

SEQ ID NO: 25152 - DNA, 1016 bp, Homo sapiens
  misc_feature: GYAE6OF02F29AV.21.22.B11.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgcgcgtagggtcctgggcccagttctgtgctgactcagccacctcagcgtcgtcggggacccccgggnaggtacgggtccaccctagttccggttcctttggttcgtacgggacggtcctaaaccgtccaaaccagttaccggtaaagttaaagtttacttacggttaaattttccgttagggttaacttaccgtaacggacctaaacccttaccccggaagggtaacgtaccgggtaaccccccgtaaaaccgttccccgtaccgaacgtaccccgtaagggtaaacgggtaaattaaaccgttaccgaacgggtaccccggggtaccccgttacgggtaccgggggtttacccccgtacgggtaaaccccggtaactttcccgttaccgtttacggggtaccctttaccggtaaacggttcccgtacggggtacccctaacccgtttaccgaacccggttccccctttaccccgtaccggaacccctaaaccgttaccggtaaaccggggtttcccggggtaaccccgttttaccccgggggtaacccggtaaacgggggttacgttaccgggtaacgggtcccgttaacggtaacccgtttaaaccgttttaccggttgggtaccggttaccctaaacgggttacccgggaaacccggggtacccggtaaccgtaaaccgggttacggttaacggggttaacttaacgggttaaccgtaacgtttccggttacgggtaaacggggttttcccgggggtttaaggggttaccgggtttacccgggggacgggggttaaaccggggttaacccgtaaaaccggtttacggggtaaccccgttttccgggtaaaccgggtaaccccgg

SEQ ID NO: 25153 - DNA, 562 bp, Homo sapiens
  misc_feature: GYAE6OF02G3DV6.21.22.B11.1.454.CMB.1.raw
  modified_base (238)..(238): a, c, t, g, unknown or other
  misc_feature (238)..(238): n is a, c, g, or t
  modified_base (282)..(282): a, c, t, g, unknown or other
  misc_feature (282)..(282): n is a, c, g, or t
  modified_base (312)..(312): a, c, t, g, unknown or other
  misc_feature (312)..(312): n is a, c, g, or t
  modified_base (352)..(352): a, c, t, g, unknown or other
  misc_feature (352)..(352): n is a, c, g, or t
  modified_base (545)..(546): a, c, t, g, unknown or other
  misc_feature (545)..(546): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
  modified_base (556)..(557): a, c, t, g, unknown or other
  misc_feature (556)..(557): n is a, c, g, or t
  modified_base (559)..(562): a, c, t, g, unknown or other
  misc_feature (559)..(562): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcatccagaggaataatcagcgccctcgaggggtcccngaccgattctcgtggctccaagtctggcacctcacgccttcccngaccatcgaggtcggcctccggtccgaggntggaggctgacttattactgtgcatccgacgggcacaacngtgggatgaacattcgagaggtcgggttgggtgttcgggacgggtaacggaccaaacgtcgaccgtccgtaggtcacgacccgaggcctccgccccgtcggtccacttcgtaccgtccccacccttccctcccgtccgtccttccttacgtcggcgtccggggtctcgggacgaacgggcgaccgtacgtcgnngangngnngnngnnnn

SEQ ID NO: 25154 - DNA, 730 bp, Homo sapiens
  misc_feature: GYAE6OF02FSVMX.21.22.B11.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcacgcgtccgtcggggaccccccgggcaggacgggtccaccatcttcttgttcnggaggcaacctccaacagtacggaagtaattatgttattctggttatcagactaactcccgaaggtaactccggaacccccaaccttcctaccatccgaagaaggtaaactaacgtacacggccgtaccctacggaccggggtccctacgaccggtactttcctacgtcggcttacctaagtcgcgtacctacctcacccgtccctcccgtacgacctagtccgtaagggttcccgggcccttacccggggtacccgggaacggttacggtacggggtacgtacgttacgtaacgtttaacgtttactgggtacgactacgtaccgggaacgtaccgaacctaacggagttaacgggtaagtcggaacctaagttaccgggtagtccgggttacggggttgggttccggttaccgggggaaccgggtaaccgggtaaacccgtaaaccgttccgggtaaccccgtttaccggaacgggtaccccggg

SEQ ID NO: 25155 - DNA, 694 bp, Homo sapiens
  misc_feature: GYAE6OF02GOOMZ.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggcaggaggtccaccattcttcttgttcgtgggaggccaacctaccaacagtaccggaaagttaattagtgtattcttaggtactacgagccaacctacccgaaggtaacgtccggacccccctaaacttccctacaaccaccaaggagaaatactacgacggccggcccgtacgaccggggtccctcggaccgtacttcgtcgtcggtcctaccgagtcgtcgccaccgtcaccgtccctcccgtacgaccctagtcgtaacgggtccggtccggtacccggtacgtaggagttcggacgcttacgacttacgtttaccgtgacgtcgtaaccgtacgggaaccgggccaacccgtaagtacggttgggaactcgtaaacttcgtacgggtacgtaggggtaccgggtttcgggttgggtaccggtaccggggaaccgggtaaccttaaaccgggtcggtacccgttaccggtacggaccccgg

SEQ ID NO: 25156 - DNA, 638 bp, Homo sapiens
  misc_feature: GYAE6OF02FKUBX.21.22.B11.1.454.CMB.1.raw
  modified_base (211)..(211): a, c, t, g, unknown or other
  misc_feature (211)..(211): n is a, c, g, or t
  modified_base (511)..(511): a, c, t, g, unknown or other
  misc_feature (511)..(511): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnaggagggtcaccatctcttgttctggaggcaacctccaacatcggaagtaattatgtattctggtatcagcaactcccaaggactcggacccccaaactcctcactccaggaacggaataatccgacggccggtccctacggacggggtccctaggacccgtattccgtcgtcggtcctaccgaagttccgtcgggacctacccgtcgacgtccccgtccctacgaccctagtccgtagggttccgggccgttcccggggtacgaggtactcgggacggtccttagtaccttagttacgnggtcgacctaagtccggaaccgggactacgaacgtaggtacggatacgaactagtcgtagggtacggtcgggttgggtcggttacggacgggtaacgaccctaagtcggacccgttacgtaggtccg

SEQ ID NO: 25157 - DNA, 618 bp, Homo sapiens
  misc_feature: GYAE6OF02FF92L.21.22.B11.1.454.CMB.1.raw
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
tcagtcgtcgctcgcacgaccggtgctcgatttagacgacagctcagggggggggaagctcagcttcagctgtggtagagaagacaggactcaggacaatctccagcatgccggcttccctctcctcctcaccctcctcactcactgcgcagggtcctgggcccagtctgtgctgactcagccaccctcagcgtctcgggacccccgggcagacgggtcaccatctcttgttctggaggcaactccaacatcggaagtaattatgtatctggtatcagcactcccaggatcgccccaatcctnatccagacgaataancagccggtcctcgacggggtccctagaccgtattcctcgtggcctaccaagtcctggaccaccctcacgccctccctgaccctatcgacggtcgggccttcccggggtaccgaggtacgtcggacggccttaggacccttaagttaccgtggtcgccaagttcccggaaccgggtaaccgacctaaacgagtacgggatcgaactacgtccgtaggtacggtccgggttgggttaccggttaccgggaccgggaacggtaaccctaaaccggtcggaccccgttaccgttacggtacccg

SEQ ID NO: 25158 - DNA, 599 bp, Homo sapiens
  misc_feature: GYAE6OF02GJK2Y.21.22.B11.1.454.CMB.1.raw
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggcagagggtcaccatctcttgttctggaggcaactccaacatcggaagtaattatgtattctggtatcagcaactccaggaatcggacccccaatcctnactccagacggaataancgacgcgccctcgacggggtccctgaccgtattctcgtcggcctaccaagtctggccacctcacgtccctcctgaccatcgaggtcggccgtccgggtcgaggatggacggtctgaaccgttattaccgtgtcgactacgttccggaaccggggtacaccgaacgtaaggtcgggaactggaacctagtccgtaggacgggttcgggtttaggggtcgttaccggggacggaacgggtacctaaacggttccgacccggttcgacggtacccgg

SEQ ID NO: 25159 - DNA, 643 bp, Homo sapiens
  misc_feature: GYAE6OF02IGXSP.21.22.B11.1.454.CMB.1.raw
  modified_base (211)..(211): a, c, t, g, unknown or other
  misc_feature (211)..(211): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (406)..(406): a, c, t, g, unknown or other
  misc_feature (406)..(406): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcggggacccccggnagagggtcaccatctcttgttcnggagcactccaanatacggaatattatgtattctggtatcagacaactccaaggatccggaccccaaacttccacactccagaacggtaataatcaggccgcctcgacggggtcctgaccgtattctcgtcggcctacgagtctacggccacccgtcgacgtcccgttcccncgaaccctatacgtaggtcgggtcctcccggggtaccggtaggtacgtaggacggtctacggtaacttacgttacgtggttacggctaacgttaccggaaccgggtaccgaccgtaaaccgtagggtacgggattacggaacctatcggtacggtaacggttggggttcggggttaaggttccggggacgggtacgggaaccctaaacggtccgtaacccggttcggttacggaccg

SEQ ID NO: 25160 - DNA, 684 bp, Homo sapiens
  misc_feature: GYAE6OF02HSTW9.21.22.B11.1.454.CMB.1.raw
  modified_base (254)..(254): a, c, t, g, unknown or other
  misc_feature (254)..(254): n is a, c, g, or t
  modified_base (341)..(341): a, c, t, g, unknown or other
  misc_feature (341)..(341): n is a, c, g, or t
  modified_base (376)..(376): a, c, t, g, unknown or other
  misc_feature (376)..(376): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcatcctcctcactcactgcgcagggtcctgggcccagtctgtgctgactcagcccaccctcacgcgtcgtcggggacccccgggcaggacgggtcaccatctcttgtctggaggcaactcaacntacggaaattaattatgttattcgtaggtatcgagacaactccgaaggaactccggaccccaaactcctacactccagaagaataancacgccgcctggacgggtccagaccgtattcgtcncggcctacgtagtcgtcggacctaccgtcgacgtccctaccctacggaaccctagtacccgtaggggttccgggtcccgttacccggggtaccggaagggttacgtacgggtacggaccctttacgaactttaacgtttaccggtggttaccgtaccgtaacgttacccggggaaccgggaacctaaaccgaaacggtaggtaacggggtaataaccgggtaactaacggttccggtagggtaccgggttggggttaggtcggtacgggacgggtaacggacctaacggtccgtacccggtagtacgg

SEQ ID NO: 25161 - DNA, 749 bp, Homo sapiens
  misc_feature: GYAE6OF02FXWCM.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggnaggacgggtcaccatcttcttgttctgggagcaacctaccaacatacggaagtaattatgtattcgtaggtatacagaccaacctcccgaaggaactccggaaccccctaaactccctacactaccgaagaacggtaaataactacgacggcccggccctacggtaccggggttccctacgaccgtacttccgtcgtacggtctaccgaagtctcggacctacctcacgtcctcccgtagaccctatcgacggtcgggtccgtccgggtaccgagggtatagggacggtctaacgtaacgttacgtttacgtaggtaccgcgtaacgtaccgggaacgggtaaccgaaccgtaaacggtacgggttagggtaacttaacgggtaaaccgttacgttcggtaacgggggttcgggtttaccgggggttttagggggttccgggttacccgggggtaacggggtaacccgggtaaaccccgtttaaaaccggttccggggttaaacccccggtttacgggtaacgggttaaccccgg

SEQ ID NO: 25162 - DNA, 803 bp, Homo sapiens
  misc_feature: GYAE6OF02ILX8K.21.22.B11.1.454.CMB.1.raw
  modified_base (210)..(210): a, c, t, g, unknown or other
  misc_feature (210)..(210): n is a, c, g, or t
  modified_base (263)..(263): a, c, t, g, unknown or other
  misc_feature (263)..(263): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccacctcagcgtcgtcgggaccccggnaggaggtcacatctcttgtcgtggagctaactccaacgagtacggaataattntgtattcgtaggtactcacgactaacctacccgaggtaacgtccgaccccctaaacgtcctactacgtcccgaaggtaacggaaactaactaccgacgggcccgtccgttacggaccggggtcccgtacgaaccgtacgttcctacgttcggacccttacgtaacggttccgtacgggtaccctaaccgtccgtaccggtaccccttacccgttacgtaacccctaagttacccggaacgggttcggggtacccgttacccgggttaccgggaaaggtcgttacgggaacggttacctaacggttaacctttaacggttcgttaacgggtaccggtcttaaaccggtaccgggtaaccggggtaaaccgaccgttaaacgtacgggttaacgggtaacttaaccggaaacgttaacgtttccggtaggggtacccgggtttaccgggggtttcgggttaacgggttaccggggaacgggttaaccgggaaaacccgttaacgggttacccggtaccggttaccggtaacgtaaccccggg

SEQ ID NO: 25163 - DNA, 758 bp, Homo sapiens
  misc_feature: GYAE6OF02IM9HS.21.22.B11.1.454.CMB.1.raw
  modified_base (609)..(609): a, c, t, g, unknown or other
  misc_feature (609)..(609): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctcgggcccagtctgtgctgactcagcccacctcagccgtcgtcgggaccccggcaggacggtcaccatctcttgtcgtggagctaactccaactacgtacggaaagttaacttagttagttacgtttcgtaggttaactacgaacgtacctaaacccgttaccccgtaaggtaacgtacccgggtaacccccctaaaaacttcccgtaccaaccttaccgaaggtaacgggtaaacttaacgtaccgaacggtccccggtacccgtccggtaaccggggttcccctacgtaccgtacttaccgtcgtacgtacctaccgtaacgtcgtacggtacctacccgtcgaccgtcccctacccgtacgtaacctcgtacgtacgggtcgggtccctaccgggtaaccgtagggtacgtacgggtacgtctaacggtacctttaacgttaccggngttacgtaacgacgttaaccgggacggaaccgtacgaaagtacgggtaggactaccgattacgtcgtacggtcgggttacgggtttcggttacgggtacgggaccggtacgggaaaccctacggtccggtaaccggtctacggtaccgg

SEQ ID NO: 25164 - DNA, 661 bp, Homo sapiens
  misc_feature: GYAE6OF02JJDQL.21.22.B11.1.454.CMB.1.raw
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcaggtcctggcccagtctgtgctgactcagccacctnagcgtctcgggacccccggnagagggtcaccagtcctcttgttacctgggacggccaaactccgaaacagtaccggaaagtaattatagtaattcgtaggttatcagacaactacccgaaggtaacgtaccggaccccaaactccctacactccaacgaaggaactaatcgacgccggccctacgacgggtcctgaaccgtattctcgtggactccgtaagtcgttacggctaccctacgaacgtcccttccgaccgaacactacgaaccgggtgggtaccgtaccgggtaccgaggtacgtaggacgtacgtacgtaccgtaattacgtacgtacgtacgtacgtaccggaacgggacctaacgtaaacgtaaggtggtaacgtaacacgtaacttgacgggtacggtacggggttaggttcggttcgggaaccggacgtaacccgaaggtcggtaacccgtacgtagaccgg

SEQ ID NO: 25165 - DNA, 779 bp, Homo sapiens
  misc_feature: GYAE6OF02H6S30.21.22.B11.1.454.CMB.1.raw
  modified_base (213)..(213): a, c, t, g, unknown or other
  misc_feature (213)..(213): n is a, c, g, or t
  modified_base (503)..(503): a, c, t, g, unknown or other
  misc_feature (503)..(503): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggnaggacgggtcaccattcctcttgttctggagcaactccaacagtacggaaagtaattatagttatttcgtggtactacacgactaaaccctcccgtaaaggaacgtccggaaccccctaaaaccttcctacgaacctaccgaaggtaaggtaaacttaacgtcgaacgtcccgggaccccttacgggacggggtttcccctaggtaaccggtacttcctcgttagggaccctaaccgtaacgtccgtggaccctacccgttccgaaccgttcccttcccgtacgtaaccncgtcgaacggtcgggtccgttacccgggtaccgaggtacgtaggaggtccgtaggtaactttacgttacgtacggtgtaccttaacgtaccggaaccgggtaaccgtaacgtaaaccgtaacggtacggtaacgtacgtaccgtaacgttacggttcggtaaacgggttcggggttttacgggggttcgggtttacccgggaacgggggtaaccgggtaaacccggtaaaccggttacccgggtaaccccggtttacggttaacccgggtacccgg

SEQ ID NO: 25166 - DNA, 727 bp, Homo sapiens
  misc_feature: GYAE6OF02JFAUW.21.22.B11.1.454.CMB.1.raw
  modified_base (450)..(450): a, c, t, g, unknown or other
  misc_feature (450)..(450): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggacccccgggcagacgggtcaccatcctcttgttctggacgcaactccaacacgtacggaagttattatgtattcgtggtatcagaccaactcccgaggtaactccggacccccctaaacgtccctactaacctaccgtaaggaacggtaaacttaataccgacggtacccggtccctacggtaaccggggggttcccctagggacccgtaactttcctaccgtcggtacctaccgtaacgtttccncgggtacctacccgttacgaccgtccccttcccgtagaccccagttcccgaaggggtccgggtcccgttcccggggttaccggaaggtgtacggacggccttacggacttacttacggtgtcgtacacgtaccggaccgggaacgtaccaaacggtggtaacgggtaattaccggaacttattcggcggtaacggggtttcgggttgggttacgttcgggtacgggaccgggtacgggaaacccttaaacgtccgggtacccgtaacccggtaacgg

SEQ ID NO: 25167 - DNA, 784 bp, Homo sapiens
  misc_feature: GYAE6OF02H48EC.21.22.B11.1.454.CMB.1.raw
  modified_base (215)..(215): a, c, t, g, unknown or other
  misc_feature (215)..(215): n is a, c, g, or t
  modified_base (240)..(240): a, c, t, g, unknown or other
  misc_feature (240)..(240): n is a, c, g, or t
  modified_base (588)..(588): a, c, t, g, unknown or other
  misc_feature (588)..(588): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctctccaccctcctcactcactgcgcgagggtcctgggcccagtctgtgctgactcacgccaccctcagccgtcgtcgggacccccggnaggaggtccaccatctcgttgttcnggacgcctaactccaacatacggaaattaatttagtacgttatttcgtagttactacacgacctaacgtcccgaaggtaaccgttccggaacccccctaaacttccctaacgactaccgaaggtaacgtaaactaacgtaccgacgtcccggtcccgtacggtacgggttcccgtagtaccgttataccgttccggtagtcccgttacgtaaccgtcgtacgtcccaacccgttccgaccgtaccccttacccgtccgaaccctagttcggacgggtttcccgggtccgtacccgggaccggtaaggccgtacggtacggtacctaacggttaactttacttaccggngttaaccggccttaaccgtacggggacccggtaaaccgaccgtaaaccgtaggtcggtaaactacggaacgtacggttcgtaaacggggtggtttaaccgggggtttcggggtttacgggcccggggtaaaccggaaaccgggaacccgttttaacggtaccgggtaaccccgggtttattaacccggggtacccg

SEQ ID NO: 25168 - DNA, 687 bp, Homo sapiens
  misc_feature: GYAE6OF02GS7BJ.21.22.B11.1.454.CMB.1.raw
  modified_base (213)..(213): a, c, t, g, unknown or other
  misc_feature (213)..(213): n is a, c, g, or t
  modified_base (258)..(258): a, c, t, g, unknown or other
  misc_feature (258)..(258): n is a, c, g, or t
  modified_base (298)..(298): a, c, t, g, unknown or other
  misc_feature (298)..(298): n is a, c, g, or t
tcagtcgtcgctcgcacgaccggtgctcgatttagacgacagctcagggggggggaagctcacgcttcagctgtggtagagaagacaggactcaggacaatctccagcatggccggcttccctctcctcctcaccctcctcactcactgcgcagggtcctgggcccagtcctgtgctgactcagccacccgtcagcgtctcgggacccccggnagagggtcaccatctcttgtctggagcactcacatcgaagtattntgtattctgtatcagcactccaggactcgccccaactccncatccagagtaatatcgagccgtcctcgacgggtccctgaccgtcttccgtcgtggtacctaccgtaacgttccgtcggtaccctacccgttccgaccgtccccttaccccgtcgaacccctacgttccgtaacgggtccgggtcccgttcccggggtacccggaggtacgtcgggacggtcccttaggtaccctttagtaccgttggtcgtacctagttacccgggacggggaccctacgaaacgttacgggtcggaacttaggaaccgttaacttccggttagggtaaccgggttccggggttttagggttacccgggtttacgggaaccggggttaacggaaacccttaaacggttcccgggtaacccgttccgtaagggtacccg

SEQ ID NO: 25169 - DNA, 769 bp, Homo sapiens
  misc_feature: GYAE6OF02IPZZI.21.22.B11.1.454.CMB.1.raw
  modified_base (354)..(354): a, c, t, g, unknown or other
  misc_feature (354)..(354): n is a, c, g, or t
  modified_base (750)..(750): a, c, t, g, unknown or other
  misc_feature (750)..(750): n is a, c, g, or t
  modified_base (755)..(755): a, c, t, g, unknown or other
  misc_feature (755)..(755): n is a, c, g, or t
  modified_base (761)..(762): a, c, t, g, unknown or other
  misc_feature (761)..(762): n is a, c, g, or t
  modified_base (764)..(769): a, c, t, g, unknown or other
  misc_feature (764)..(769): n is a, c, g, or t
tcagtcgtcgctcgcacgaccggtgctcgatttagacgacagctcagggtcctgggcccagtctgtgctgactcagccaccctcagcgtccgggaccccgggcagagggtcaccatctcttgttctggaggcaacttccaacatacggaagttaattagtgttattcgttaggtatacgacgacaacctacccgaaggaacgtcccggacccccaaacttcctacactaccgaaggaaggtaaataactcgacggcccggtcccctacggaccggggtccctacggaccgttacttcctccgtcggcctacgtaacgtcgtcggcctaccgtcacggccctccccgtacaccgntacgtagggtcggtcccgtccggggtaccggaggtagtacgggaggacgttcgtaaacttactttacgttggacgtaccgtaacggtccggaaaccggggaccgaaccgtaaacgaggggttaacgggacgtacgaaacttacgtacgttagggacgggtttgggggtttagggtccgggttcggggacgggaaaccgggtaaacccgtaaacggtccgtaacccggtaccggttacggacgaccgtaaccggaccggtccgtccccggtccccgtacggtcccgtaccttccggtacctttacccccgtcccttccccgttacgttcccgttaccctccgtacgtcggtaacgggtccggtccggtacggacgacgggttccgacaacgtacggntacgngctgcnncnnnnnn

SEQ ID NO: 25170 - DNA, 600 bp, Homo sapiens
  misc_feature: GYAE6OF02GS6YO.21.22.B11.1.454.CMB.1.raw
  modified_base (211)..(211): a, c, t, g, unknown or other
  misc_feature (211)..(211): n is a, c, g, or t
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagacgggtcaccatctcttgttctggaggcaactccaacatcggaagtaattatgtattctggtatcagcaactcccaaggaatcggacccccaaactcctcactccaagaagaatancagccggccctgacgggtccngaccgtnttcncgtgcctacagtctggcctacctcacgtccctccctagacctatcgaggtcgggcctccgggtacgagggtatcggacgtcctacgaacttacttacgtggtcgactacgtaccggacgggacacaacgtgtcggaatcgaactagttccgagggtacggtcggggtttagggtcggttaccggggacgggtacgggaaccctaaacggtccgggtaaccgtttaccggaggtaacccg

SEQ ID NO: 25171 - DNA, 739 bp, Homo sapiens
  misc_feature: GYAE6OF02FVZAR.21.22.B11.1.454.CMB.1.raw
  modified_base (711)..(711): a, c, t, g, unknown or other
  misc_feature (711)..(711): n is a, c, g, or t
  modified_base (719)..(719): a, c, t, g, unknown or other
  misc_feature (719)..(719): n is a, c, g, or t
  modified_base (735)..(735): a, c, t, g, unknown or other
  misc_feature (735)..(735): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaactcggacccccaaactcctcactccagagaataatcagcgccctcgacggggtccctggaccgtattcctcgtcggcctaccgaagtccgtcggaccaacccttccagccccttccctgaccctatcgaggtcgggccttcccgggtcggaggatggacggctagaacttattactgtagccagtccggaacgggacacaacgtgtaggggatacgaacaagttcgtagggtacgggtcggggtttggggtacggttccgggaacggggtaacggggtaacccgtaaacggtaccggtaacccggttcccggttaacggtacccgaaccggtaccccggtaaacgggtacccgttcccggtccccccggttacggttaccccgtaacccgtttccgtttcccgttaccccccgttacccgtttacccccgttcccgttcccgttaccctttcccgttaaccggtaccggtaccggggtcccgggtcggttaccgggaccgggtaaccgggcggtaaccgagtacggngtacgccngtacgcgtcgcacgcncatc

SEQ ID NO: 25172 - DNA, 902 bp, Homo sapiens
  misc_feature: GYAE6OF02I4Q5T.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctccctacactcacgtcgccgacggtacgggtccggtccgggacccgtacgttcgttggtcgtcgtacgtacctaccgaccgaccccctacccgtacgacggtcccgtttccgggccccgggggaccccccggagacggggtaccggtcccaacctacttcctttcgtttacgtttcggaggaccgtacctaaccctaaccaactacggtaacggtaaatttaattgtagtttacttcggtagtactacgacacctaccaccggaggtacgtacccccgaacccctaacgttccactaccgtaacgaaagggtaacgtaaaacttacgtacggaccgggtccccggtacccgtaacggggttaccccggttacccgtaccgggtaaccgttttcctttcccgtcgggttacccggtacccttaacgtaaccggtttcgacccgaccccttaccggtaccgtacccgttcccccgttcccaaacggtaccctaaggtaccgggttacggggaccccggtttacccggtaccccggggtaaggaacggttccggaacgggtacgttcccgtaacgtttaactttacgttacggtggaccgtaccgtaccgggtaccgggaaccgtaccgtaacacgggttaagggtcgtaactaaccgaatttacggtcggtaagggggtcgggttttaccgggggtcggttaccggaccggggaaacggttaccgaaaccgttcgggtacccggtaacccgtttagggcctaaacccgg

SEQ ID NO: 25173 - DNA, 723 bp, Homo sapiens
  misc_feature: GYAE6OF02IMXFR.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnaggaggtccacatctcttgttcgtggaggacaactccaactatcggaagtaattatgtattctggtatcagacaacctcccaaggatacggacccccaaactcctcactaccaggagaataactcagtccgcctacgacggggtccctacgtaccgtacttccttcgtcggtccttaccgtaaagtccgtacggacctacctcgaaccggtccctacccgtacgtaccctagttccgagggttccggggtccgttaccccgggtaccgggacgggtacggtacggacgggtccgttacgttaaccgtttaagtttaccgaggttacgtacctacggttaccggaaccggggtaccgaactaaaccgtacgggtaggtaacgtaacgaaccgttacttccggtaaggtcggggttaccgggtttggggggttcccgggttacgggaaccgggggtaaccggtaaccggtaaaccggtcccgggtaacccggttacccggtaagggtaccccgg

SEQ ID NO: 25174 - DNA, 727 bp, Homo sapiens
  misc_feature: GYAE6OF02HXPAW.21.22.B11.1.454.CMB.1.raw
  modified_base (285)..(285): a, c, t, g, unknown or other
  misc_feature (285)..(285): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcgaggggtccctgacccgattctctggcctaccaagtctggcacctcacgcctcccngacctatcagtcggctcccggtcgaggactgagctgactattactgtcgacactccgaacgggtaccgacaaacctagttcggggattacgaaactaaacgttcggtaggaacggttccggggttttggggtcggtttacggggaccgggggaacgggtaacccgtaaacgtcggaacccggtttaccgtaacgggtacctaacggacccgtaaagggtcctaccggtcccccgtcgggttaccctacgttcccgttaccggtttacccccgcccccttcccgttaccccggttcgttacccgttacccgtttaccggtaccggtaccggggtccccggggttacgtacccggggtaaccgtaaacccgggggttccgtacccggtaaggtaaccgggttcgaccgtacgtacgtcgcgtacgtacgtacgtcgtacgagcg

SEQ ID NO: 25175 - DNA, 553 bp, Homo sapiens
  misc_feature: GYAE6OF02G632F.21.22.B11.1.454.CMB.1.raw
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (518)..(518): a, c, t, g, unknown or other
  misc_feature (518)..(518): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (544)..(546): a, c, t, g, unknown or other
  misc_feature (544)..(546): n is a, c, g, or t
  modified_base (548)..(553): a, c, t, g, unknown or other
  misc_feature (548)..(553): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcatccagaggaataatcagcggccctcgagggtccctgaccgattctctggctcagtctggcacctcagccctccctgaccatcaggtgggcctccggtcgaggntggnggctgactattacngtgcagtcgacggcacaacgagtgggatcgacactcgtagacggtcgggttgggtggttcgggcgggacggaaccgaaacgtcggacccgtacgtacggtcacggccgaacggtccgtccgccccgtcggtcctacctccgtccgttccccgcccttccgtccctccgttccgtcctacgtcgacgccgggtcngggccacggcgactagtcgncncngnnngnnnnnn

SEQ ID NO: 25176 - DNA, 614 bp, Homo sapiens
  misc_feature: GYAE6OF02GL3MF.21.22.B11.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagacgacagctcagggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccgggcaggagggtcaccatctcttgtctggagcaactccaacntcggaagtaattatgtattctgtatcagcaactaccgaggaactcggaccccaactcctcatccagagaataactcacggccgcctcgacgggtccctgaccgtacttcgtctggacctaccgaagtccgtcggacctacctcaccgtccctcccagaccctaactcgaggtcggtccgtacccgggtccggaggtagtcggagcttgaaccttattactggtagcctagtaccgaccggggtaacacgaacctaaggtcgggaactagaacctagtacgtaggtaacggttcggggttacgggtcggttaccgggaacgggacggtaaccgtaaccgtacggacccggttacgcgggtaaccg

SEQ ID NO: 25177 - DNA, 765 bp, Homo sapiens
  misc_feature: GYAE6OF02GLBQU.21.22.B11.1.454.CMB.1.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcggggaccccggnaggacggtccaccatcttcttgttcnggagacaactccaacagtacggaaagttaattatgttattcgtaggtactcgacgactaaccttcccgaaggtaacgttccgggaacccccctaaaacttccctacaacgttacccgaaggaaacgggtaaacttaactacgaacggcccggtaccctacggtaccgggggttccctaggacccgttatttccgtacgtcggtaccttaaccgtaagtccgtacggaccctaccgtcgaccgtcccttcccgtaggaacccaagttccggaacgggttccggggtccctttacccggggaccgtaagggtcttacgggacggtactacggtaaacctttaagtttacgtcggtacaccgtagtacccgggaacgggtaccaacctaaagtacggttacggggaacttacgggaacctacgttcggtagggtaaccggggttcggggtttggggttaccggtaccggggtaacgggaacccggttaaccctaaacgggttcccggtaacccggttaccggtaggtacccgg

SEQ ID NO: 25178 - DNA, 718 bp, Homo sapiens
  misc_feature: GYAE6OF02F60OR.21.22.B11.1.454.CMB.1.raw
  modified_base (218)..(218): a, c, t, g, unknown or other
  misc_feature (218)..(218): n is a, c, g, or t
  modified_base (703)..(703): a, c, t, g, unknown or other
  misc_feature (703)..(703): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcatccagagaataancagccgccctgacgggtccctagaccgtattcctcgtcggctaccgaagtctcggccacctcacgcccctccctagacccatcgacggtcgggcctcccgggtccgaggacgtggacggctcggtaacttagttacctgtcgcgtacgtccgaacggggaccaccaacgtaggtggactacggaactaagttcgtagtcgggtcggggtttagggtcggtttccgggagggaccggggtaaccgtaaaccgtcggtaacccggtccgttacggtaccgtaccggacccgaacggtcccgtacccggtcccccgttaccggtacccgtaccgttaccgttcccgttacccccgtaccccgttacccggtacccggtaccggtcccgtaaccggtaccggtaccgggtaccgggccgggtaccggtccgggaccggaacgggcccggtaaaccgtaccggaacggctaaccggcgtcgtacggtacncgcgtcgcgcgcgcg

SEQ ID NO: 25179 - DNA, 795 bp, Homo sapiens
  misc_feature: GYAE6OF02FGGUW.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcagggggggggaagctcagcttcagctgtggtagagaagacaggactcaggacaatctccagcatggccggtcttccctctccctcctccacctcctcactcactgcgcgaggtcctgggcccagtctgtgctgactcacgccacctcgacgcgtccgccgggacccggnaggcggtcacctatccttcgttcgtcgtggacgtccaaccgtaccaaactaggtaccggtaaagttaacttacgttacgttacttcgttacggtactccgaacgacctaacccgtaccgaacgggtaacctacccgtaacccctaaaccttccgaactaccgtaacgaaggtaaaccgtaaactaacgtaccggtaccggtccccggtacccgtaccggggtaaccgggttccctaacggtaccgtactttccgtccggtaccgttaccgtacgtaacgtccgtaccggtaccctaccggtacctacccgacccctttcggtaaccgaacccttcgggtaccgtaccgggggtccggtaccccgtaccggggttaggaaacgtcggtaaccggtacgtccgttttaaaacgactttaaggttccgtacggtaacgaccgttacgggtacccgggaaacggttacccaaagtaccgtaggtacggtactaccgtaacgttcgagggtcgggttaacggggttcggacgggttacggacgggaccgaacgttaaccgcggtccgtccgtaggaccgtaacccg

SEQ ID NO: 25180 - DNA, 624 bp, Homo sapiens
  misc_feature: GYAE6OF02HGGJN.21.22.B11.1.454.CMB.1.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
  modified_base (531)..(531): a, c, t, g, unknown or other
  misc_feature (531)..(531): n is a, c, g, or t
tcagtcgtcgctcgcacgaccggtgctcgatttagacgacagctcagggggggggaatctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttcnggagcaactcaacatcggaagtaattatgtattctggtancagcaactcccaggaatcggaccccctaaactccctacatccgagaggtaaataactcgagccggccctcgacgggtcctgaccgtattcctctggctaccgtaagtctacggcctacctcgtacgccctaccgtacgaccctatcggtaaggtcgggccttacccgggtacgaggtactggacgggtcttacggacttaacgttactggtcgtaccgagttcccgggaacgggaccaccgtaaactagggtcggtaancgtaacccagttcgtaggcgggttaccgggtttgggtacgttaccgggacgggtacggtacccaaagtcggtaacccgttcgtacggtaccgg

SEQ ID NO: 25181 - DNA, 317 bp, Homo sapiens
  misc_feature: GYAE6OF02GR74W.21.22.B11.1.454.CMB.1.raw
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (307)..(317): a, c, t, g, unknown or other
  misc_feature (307)..(317): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcgggttgggtgttcggcggaggaccaaacgtgaccgtctaggtcacgcccaaggcctcgcccctcgtcnctctcttcccnccctcctcctcgtcctctactgacggtcgggctggcaacggcgcagtagnnnnnnnnnnn

SEQ ID NO: 25182 - DNA, 763 bp, Homo sapiens
  misc_feature: GYAE6OF02GQX8I.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagccgtcgtcggggacccccggnaggacgggtccaccatctcttgttcgtggacggacaactccaactagtacggaagttaattatagttattcgtaggtactcgacgacctaacctacccgaaggtaacgtccggaaccccctaaactccctacactaccgaaggaagtaaactaacgtccgaacggtcccggacccgtacggtaccggggtcccttacggacccttacttccgtcggtcggtacctaccgtaacgtcgtacggacctacccgtcgaccgtccctaccgtaacgaccctagttcgacgggtccgggtaccgttccgggtaccggtaagacgttacggacggtccgttaacgtacgttaactttaccggtcgtcgtaccgtaaacggtccccgggaaacggggtaaccaccgttaaacggtacgggtacggtaactaccgtaacgttacgttacggtacgggtacggggttacggggttttcggggtacgggttaccggggaccggtaaccgggtaacctaaacggtcccgggtaacccggttaccgtaacgggtacccgg

SEQ ID NO: 25183 - DNA, 828 bp, Homo sapiens
  misc_feature: GYAE6OF02IN2BD.21.22.B11.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtccgtcggggacccccggnacggacgggtcacctatccttcttgttccgtgggacggccaactccaacacgtacggtaaagtaattatagttacttcgtggttactcagacctaacctcccgaaggacgtcccggaacccccctaaaaccttcctacacgtacccaaggaacggtaaataaactcgaacggcccgggacccttaccgggacggggttcccctacgggtaacccgttacgtttcctcgttcggtaccctacccgtaaacgggtcccggaccctaacccgtacccgtaccgttccccgtaccccgtaggtaaccctagtacccgggtacggtccggggtccccgtttaccggggtaaccgggagggtacgttacgggaaccgggttcctttacggtaaccttttacgttacgtcgggacttacgtaacgtacccgggaaccggggtaccaaccgtaacccgttagggaacgggttacaaaccgggtaacctaacggttcgaacgggggttcggggtttaccgggttttaccggggttccggggttaacggggacccgggtaaacggtaacccgtaaacggttcccgggtaacccggttacggtttaccggaccggtaacccgg

SEQ ID NO: 25184 - DNA, 760 bp, Homo sapiens
  misc_feature: GYAE6OF02G4JVQ.21.22.B11.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagacgacagctcagggtcctgggcccagtctgtgctgactcagccaccctcagcgtctcgggacccccgggcagagggtcaccatctcttgtctggaggcaactccaacatcggaagtaattatgtattctaggtatcatcaacctcccaaggaatcggaccccctaaatcctcatccgagaggaataatcagccgccctcgacgggtcccngaccgtattcctcgtcggctaccgtaagtcctcggccacccgtcacgtccctacccgtacgacccatccgaggtcgggtccttcccgggccgtaggatcgggacggtcttacggtaacttacgttacgtgtacgaccgttataccggaccgggaacctcaaaacgtaggtcgggtaactaggaacctagtaccgtggtaacggtcgggttaggtcggtaccggaggaaccgtaaccgacgtacggtaccctaggttaccgcgaacggtacccgtagggtacccgtcccggtacccccgttacggtacctaacccgttccgttcccgtttccccccggacccgtttccccgtaccccggggtaccgaaacccgggttcccggaaacgggtacccgggaacccgggtttcgtaaaacccgggccgggttaaaacgggtcccccgggtaaaagtaaccggtaacgggtacctacgtacgtaccgtacgacgacgtacgtacgtacgtacgtcgagtcg

SEQ ID NO: 25185 - DNA, 586 bp, Homo sapiens
  misc_feature: GYAE6OF02HWOEV.21.22.B11.1.454.CMB.1.raw
  modified_base (216)..(216): a, c, t, g, unknown or other
  misc_feature (216)..(216): n is a, c, g, or t
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
tcagtcgtcgctcgcacgaccggtgctcgatttagacgacagctcagggggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggaccccccggnaggaggtcaccatctcttgttctggagcaactccaacatcggaaagtaattatgtattctggtatcagacaactccaaggaatcgaccccaaactcctcatccagaagaatancagcggcctgacgggtcccngaccgtattctcgnggtctacgtaagtctcggaccacctcacgtccctcctacgacccaatccgaggtcgggtcctccgggaccgaaggtactggacggtactacgtaacttagttaccgttgacgctacgtaccggacgggacacgaacgtagcggaatgaactagtcgtggaacggttcgggttggtcggtcgggacgggaacggtacctaacggcggtacccgtagtacgggac

SEQ ID NO: 25186 - DNA, 685 bp, Homo sapiens
  misc_feature: GYAE6OF02IAUU1.21.22.B11.1.454.CMB.1.raw
  modified_base (217)..(217): a, c, t, g, unknown or other
  misc_feature (217)..(217): n is a, c, g, or t
  modified_base (257)..(257): a, c, t, g, unknown or other
  misc_feature (257)..(257): n is a, c, g, or t
  modified_base (539)..(539): a, c, t, g, unknown or other
  misc_feature (539)..(539): n is a, c, g, or t
tcagtcgtcgctcgcacgaccggtgctcgatttagacgacagctcaggggggggggaagctcagcttcagctgtggtagagaagacaggactcaggacaatctccagcatggccggtcttccctctcctcctcaccctcctcactcactgcgcgacgggtcctcgggcccagtctgtgctgactcagccaccctcagcgtcgtccggggaccccggnagagggtcaccatctcttggtactggagactactacaacnacggaagtaatatgttattctgtatcagacaactccaaggatccggaccccaaactcctacactacgaagaacggaaattaacacgacggacccggtcctcgggtaccggggttaccctaggaacccgtattccgtaccgtggtcctactaaacggttccgtcggacctaccttacgaccgtcccgtaccgtaccgaaccgtaactcggtaccggtcgggttcccgtaccggggtaccgtaaggagtacggaacggtcgtaaacgtacttacttacgttcgngtactacgtaccggacggtaaccggaacctagaaggttagggtacaaggttaacagtttcggacgtaacgggttccgggtttaggggtccgggttacgggacgggaaggtaacccgaacgttacggacccgtacggtaccgtacgg

SEQ ID NO: 25187 - DNA, 723 bp, Homo sapiens
  misc_feature: GYAE6OF02IHKXT.21.22.B11.1.454.CMB.1.raw
  modified_base (213)..(213): a, c, t, g, unknown or other
  misc_feature (213)..(213): n is a, c, g, or t
  modified_base (260)..(260): a, c, t, g, unknown or other
  misc_feature (260)..(260): n is a, c, g, or t
  modified_base (376)..(376): a, c, t, g, unknown or other
  misc_feature (376)..(376): n is a, c, g, or t
  modified_base (479)..(479): a, c, t, g, unknown or other
  misc_feature (479)..(479): n is a, c, g, or t
tcagtcgtcgctcgcacgaccggtgctcgatttagacgacagctcagggggggggggaagctcagcttcagctgtggtagagaagacaggactcaggacaatctccagcatggccggcttccctctcctcctcaccctcctcactcactgcgcgagggtcctgggcccagtctgtgctgactcagccacctcagcgtcgtcgggacccccggnaggaggtccacctatcttcgttgttctagggacgaccaactccaaanacgtacggaaagttaaattatagttattcgtaggttatcgagacctaaccgtacccaaggaacgtacccggaaccccctaaactccctacgtactaccaggtaaagtaaactaacncgacggaccgtcccgtaggtaccgggtccctgaccgtactccgtgtcgtactaccgtagtctcgacctccgtactccgtccctacctacgaactactaccggngggttacgggccgtaccgggttaccggaggtacgtcggtaacgtcttaacgtactttaactacgtaggttcgaccgtaacggtacggtaaaccgggcgaaccggaaagtacggtagggtaactaacgggaaccgtaagtttcggacgggttacgggttacggggttcgggttaccggttcgggggaaaccggtcgggtaaaaccctaccgggtacccgtaaacccgggttcgtaaccgggaccg

SEQ ID NO: 25188 - DNA, 591 bp, Homo sapiens
  misc_feature: GYAE6OF02HAB00.21.22.B11.1.454.CMB.1.raw
  modified_base (248)..(248): a, c, t, g, unknown or other
  misc_feature (248)..(248): n is a, c, g, or t
  modified_base (393)..(393): a, c, t, g, unknown or other
  misc_feature (393)..(393): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacntcgaagtaattatgtattctggtatcagcaactccaggaactcggacccccaatcctcatccagagaataatcagccggcctcgacggggtccctgaccgtattcctctcggctccaagttctcggccacctcacgcccttcccngaccatcaggtcgggcctcccgggtacgaggtatggaggtcctagacttattactgtagcctagtccgacggggtacacgtaacgtagtcgggaatggaacctagttccgagggtacggtacggggttttcgggtacggtttccgggacgggtaacgggaacctaaacggtccggtacccggttccgtagggtacccg

SEQ ID NO: 25189 - DNA, 661 bp, Homo sapiens
  misc_feature: GYAE6OF02G1SR0.21.22.B11.1.454.CMB.1.raw
  modified_base (214)..(214): a, c, t, g, unknown or other
  misc_feature (214)..(214): n is a, c, g, or t
  modified_base (350)..(350): a, c, t, g, unknown or other
  misc_feature (350)..(350): n is a, c, g, or t
  modified_base (558)..(558): a, c, t, g, unknown or other
  misc_feature (558)..(558): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagccgtcgtcgggaccccccgggnaggagggtccaccagtcttccttgttcctgggaggccaaacgttccaaacattaccggaagttaaattattgttaatttcgtaggtactcagaccaaccgtcccaaggaactccggaccccctaaactccactacncgaacgaagaataactcacgccggtccctcggaccggtccctcgaacgttactcctcgtcgctaccgtaagtcgtacggcctaacctccgactccccgtcctacgactacgtccgtagttccgggtaccgtccgggtacgacggagtacgcgggtcctagtacttacttacgtgtacgctaacgtccgaaacgggccaacgttaacgnggttacgggaatacgaacctattcggaacggttgggttcggttgggttaccgggacgggtacggaaccggggtaccaccggtggtacccgttcgaacggtccg

SEQ ID NO: 25190 - DNA, 673 bp, Homo sapiens
  misc_feature: GYAE6OF02GJ8WW.21.22.B11.1.454.CMB.1.raw
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctgggaccccccggagagggtcaccatctcttgtctggaggcaactccaacatcggaagtaattatgttattctggtatcagcaactcccgaaggaatccggaccccctaaaactcctaccataccaagagaataatcgagccgccctcgacggggtccngaccgattccncgtggcctaccgaagtcgtcggccacctccgacgtccccttccccgtacgaccctagtacctagggtccggggtcccttacccggggtcccggtaacggggtacgttgggaacggtccgtaggtaaccttaacgtttaaccgtggtcgacctacgtaccgggacggggtaccgaacctaaccgtaagttacggggattacgaactacgttccgtaggacggttcggggtttggggtccggttcggggaccgggaaccgggtacccaaaacggttccggaacccgtttacccggtaagggtaccccg

SEQ ID NO: 25191 - DNA, 346 bp, Homo sapiens
  misc_feature: GYAE6OF02HSISV.21.22.B11.1.454.CMB.1.raw
  modified_base (314)..(316): a, c, t, g, unknown or other
  misc_feature (314)..(316): n is a, c, g, or t
  modified_base (318)..(346): a, c, t, g, unknown or other
  misc_feature (318)..(346): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgaggcggttgggtgttcgggcggaggaaccaaacgtcgaccgtcctaggtcacgcccgaaggcctacgcccccgtggtccactctcgtcccacctcctcctcgtctctactgagcgggctcggacgaaggccacagtagnnncnnnnnnnnnnnnnnnnnnnnnnnnnnnnn

SEQ ID NO: 25192 - DNA, 327 bp, Homo sapiens
  misc_feature: GYAE6OF02H1H8X.21.22.B11.1.454.CMB.1.raw
  modified_base (306)..(327): a, c, t, g, unknown or other
  misc_feature (306)..(327): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcgacgggacgcaacagtgggatgaacaatctgagcggttgggtgttcggcggagggaccaactgaccgtctaggtcacgcccaaggctccgccccctcggtcactctcgtcccgccttcctcctcgtctctactgaggcggctcggcaaggcgcagtagnnnnnnnnnnnnnnnnnnnnnn

SEQ ID NO: 25193 - DNA, 776 bp, Homo sapiens
  misc_feature: GYAE6OF02ILOW0.21.22.B11.1.454.CMB.1.raw
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcgagggtcctcgggccctagtctgtgctgactcagccaccctcagcgtcgtcggggacccccgggcaggacgggtcaccattccttcctttgttcgtgggacgacctaacctaccgaacagtacggtaaagttaactttagttagttaactttccgtaggttaacgtacgaacggtacctaaacctacccgtaagggtaaccgtccccggaacccccctaaaccttcccgtacctaacctaaccccgaaggaaacgtaaaactaaacgtccgaaccggcccggcccgtacggtaccggggttccctacggaccgttacgttccgtcggtacgtaccgtaaccgtaacgtccgtacggcctaccgtcgtaccgccctcccgtacgaccctgtacgtacggtcggtccgtaccgggtaccgaggtacgtacgggacggtacgacggtttaacttaacgttacgtcggtactaccgtaacgtccgggaacggtaccgacgtaagtaaggtaggactaacgtacgacttcggtaggtacggggttcgggttacggggttacgggttaccggggaccgggtaacggaacccttaagggtaccccggtaaccggttcggtaaccggtaccg

SEQ ID NO: 25194 - DNA, 743 bp, Homo sapiens
  misc_feature: GYAE6OF02JCGN9.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcgggacccccgggcaggacgggtcaccattcctcgttgttctggacgcaactccaaacactcggaagttaattattgttattcgtaggttactcgagacctaactcccgaagtaacgtccggaccccctaaaacgtcctactactaccgaaggaaggaaacttaaactcgaacggcccggaccccttcggaaccggggttcccctaggtacccgtatttccgtacgtcggtacctaccgaacgttccgtacggccctaaccgtccgacgtcccctacccgtaccgaaccctacgtaccggtacggttccggggtacccgttcccggggtaccggaagggtacttagggaacggcgttacgacctttaacgtcgttaggtcgtacacgtcccggaacgggaaccgtacgaaacgtaggttacgggaatacggtaacctacttacggtacgggtaacgggttcggggttttcgggtacgggttaccggggacgggtaaccgggtaacctaaacccggtcggttaaccccgtacggttaacggtaacccg

SEQ ID NO: 25195 - DNA, 698 bp, Homo sapiens
  misc_feature: GYAE6OF02GECQD.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccgggnagacgggtcaccatctcttgttctggacgcaactccaacatcggaagttaattatagtacttctggtactcagtccaacctcccaggtaactccggaccccctaaactccctacacgtccaaggaaggaactaactaccgacggaccggcccctacggacgggggtcccctaggacccgtatttccgtcgtcggtcctaccgaagttcccgtaggacctacctacgaccgtcccttacccgtacgaccctacgtccgtaagggtccgggtccgttcccgggtacggaaggtacgtggaacggtctacggtaaccttacgttacgtggtcgacctacgtaccgggaacgggtaccaccgaaacgtaggtagggaactacgaacctagttccggtagggtaacggttacggggttttcgggtacggttaccggggacgggtaacggtaacccgtaaccgttcggtaccccggttacgtaccggtaccg

SEQ ID NO: 25196 - DNA, 775 bp, Homo sapiens
  misc_feature: GYAE6OF02IHXWY.21.22.B11.1.454.CMB.1.raw
  modified_base (220)..(220): a, c, t, g, unknown or other
  misc_feature (220)..(220): n is a, c, g, or t
  modified_base (616)..(616): a, c, t, g, unknown or other
  misc_feature (616)..(616): n is a, c, g, or t
  modified_base (667)..(667): a, c, t, g, unknown or other
  misc_feature (667)..(667): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcacgaccctaccctcacgcgtcgtccggggacccccgggnaggacggtccaccatcttcgtttgttcgtggacggaccaactaccaacaacgttacggaaacgttaattagttacgttaacttcgtaggtaactcgaacgtacctaaaccgtaccccgtaagggaccgtaccccggtaacccccctaaaaccttccctactaaccgttaccgaaggtaacggtaaaactaacctcgggaaaccggtcccggacccgttacggtaccgggggtccctacgggtaccgttaacttccgtcgtcgaccgtaccgtaacgtccgtcgacctacccgtacctacggtccccttaccgacgtaaccctagtcggtacgggtcggaccgttcccggggaaccgtagggtactcggacggtcttaacggtacctttacgtacgnggtaccgatacgtacggaaccgggactaacgaacgtaggtaacggcgtaanaccgtaagtcggtggtaacggtacggggttacgggttaccgggtcgggaaccgggtacgtaacccgtttaaccggggaccggtaaccgttacccgggtacggtacccg

SEQ ID NO: 25197 - DNA, 770 bp, Homo sapiens
  misc_feature: GYAE6OF02JH0IQ.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggcagacgggtcaccatctcttgttcgtggaggccaacctccaacgatacggaagttaattatgtattctggtatcagcaactcccgaggaactcggacccctaactcctcatccagacgtaataagtcacggccggcctggacggggttcccagtaccgtattcgtcgtcggtcctacctaacggtccgttcggaccctacccgtacaccggttaccccctcccgttacggaacccttagtacccggtaagggttcccgggggtccctttacccgggggtaccggaagggtaacgttacggggacggttacccgttaacgggttaaacctttaaccggttttacgtcgggtttaccgaccgttaacggttaaccccggggaaccgggggacccgtaaacggaaccgtaaggggtttacgggaacgttccggaaacttaaccgtttcgggcgggttaacgggggttcgggttttacgggggtcgggttacccggggtaagggaaccggttaacccgtaaacggttcccgggtaaccccgggttacgtttaccgggacccgg

SEQ ID NO: 25198 - DNA, 643 bp, Homo sapiens
  misc_feature: GYAE6OF02G1ORZ.21.22.B11.1.454.CMB.1.raw
  modified_base (123)..(123): a, c, t, g, unknown or other
  misc_feature (123)..(123): n is a, c, g, or t
  modified_base (211)..(211): a, c, t, g, unknown or other
  misc_feature (211)..(211): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
tcagtcgtcgctcgcacgaccggtgctcgatttagacgacagctcagggggggggaagctcagcttcagctgtggtagagaagacaggactcaggacaatctccagcatggccggcttccctntcctcctcaccctcctcactcactgcgcagggtcctgggcccagtctgtgctgactcacgccaccctcagcgtctcgggacccccggnaggacgggtcaccgatcgtcttgtctgggagcaactcaacatacggaataattatgtattctggtatcagcaactccaggaactcggaccccaaactcctcactccaggaagaataatcgacgccgcctcgacgggtccngacctntctctcgctcgtagtcgngacaccgtcacgtccctctacgaccatccggagtcgggctccggggactagggactcggacggtctaggtaacttgtttacgtcggtgacccgtaagtcccggacggggtaacctaaccgaaacgtagggtacgggtaaaccttacgggaaaccttagttccggtagggtacggtttacggggggtttcgggttacggttaccgggggaaccggtaacggggtaaccctaaacgggtcccgtaaccggtttacggtacggtaacccgg

SEQ ID NO: 25199 - DNA, 579 bp, Homo sapiens
  misc_feature: GYAE6OF02FH63M.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagtaattatgtatctggtatcagcaactcccaggaatcggacccccaaactcctcatccagaggaataatcagccggccctcgacggggtccctgaccgattcgtctcggctaccaagtctggccacctcagccctccctgaccatcgaggtcgggcctcccgggtaccgaggactggacggtctagaccttatacgtgtcgctatccgacggggacacaacgagtgggatacgaactactcgtaggtcggtcgggtttagggtacggttcgggacgggtacgggaaccctaaacggtacggtaccccgttcgttaacggtacccg

SEQ ID NO: 25200 - DNA, 647 bp, Homo sapiens
  misc_feature: GYAE6OF02GSWSE.21.22.B11.1.454.CMB.1.raw
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcaggtcctgggcccagtctgtgctgactcagccaccctctagcgtctcgggacccccgggcagagggtcaccactctcttcgttctggacggcaacctaccaacactcggaaacgttaattatgttaattcgtggttatcgagacaactacccaggaactcggacccccaaaactcctacatccagagaataatcgagcgcctcgacgggtcctgtaccgtnttcctntcggctacgaatcgtcgaccacctcacgcctccgtcaccgtatccgagttcgggcctacccgggtaccgaagggtacgtaggacggtccttacgtaaaccgttactttaacgtcggttacgacaacttcgggtaaccggggaacctacggaaactacggtacggtaatacgggtactaagtcccttaggggaaccggttgggttcgggttacggaccgggtagggaacgaacccggtaacgtacgggtacccgtacgtacggtacccg

SEQ ID NO: 25201 - DNA, 667 bp, Homo sapiens
  misc_feature: GYAE6OF02J17PB.21.22.B11.1.454.CMB.1.raw
  modified_base (211)..(211): a, c, t, g, unknown or other
  misc_feature (211)..(211): n is a, c, g, or t
  modified_base (252)..(252): a, c, t, g, unknown or other
  misc_feature (252)..(252): n is a, c, g, or t
  modified_base (306)..(306): a, c, t, g, unknown or other
  misc_feature (306)..(306): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccggnaggacgggtcaccatctcttgtctggacggcaactccaacntacggaagtattatgtattctgtatcagcactccagaatccggaccccaactcncatccagacgtaatactcacgccgccctcgacgggtccctcgtaccgtacttcgtcgtcggacctaccgtaacggttccgtcggaccctaccctaccgaccgtccccttacccgtacgtaccctacgttaccgacggggttccgggtacccggttcccggggtaaccggtaggaaccgttcgggaacggtccttaacggtacctttactacggtcgttcgacctacgtaccggaacgggaccacaacgtgtacgggatacgaactcgtacgtacgggacgggttcggttacggggtggttacccggggaccgggtacggaacccgtacgggtacccgtaccggtccggtaacggtacccgg

SEQ ID NO: 25202 - DNA, 685 bp, Homo sapiens
  misc_feature: GYAE6OF02GRXZ8.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggnacggagggtccaccatctcttcgttctggaggcaactccaacatacggaagttattatgtattcgtaggtatcagacaacctcccgaaggaactccggacccccaaactcctacataccgaagacggaataactcaggccggccctacgacggggtcctgaccgtattctcgtcgctaccgtacgtcgtcggaccacctccacggcccttacccgtaggaacccacgttcgaacgggttccgggcccgttacccgggtaccggaaggtctcgggacggtcttacggtaacttacgtttcgtagtcgactacggtacgaccggggactaccaaacggtggtcgggtaaactacgaaacgttagtaccgtagggtcgggttcgggggtttacggggtacggtaccgggggacggggtaaacgggtaacccgtaaacggttccgggtaaccgggtttaccgaagggttacccgg

SEQ ID NO: 25203 - DNA, 768 bp, Homo sapiens
  misc_feature: GYAE6OF02IM5TK.21.22.B11.1.454.CMB.1.raw
  modified_base (125)..(125): a, c, t, g, unknown or other
  misc_feature (125)..(125): n is a, c, g, or t
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (284)..(284): a, c, t, g, unknown or other
  misc_feature (284)..(284): n is a, c, g, or t
tcagtcgtcgctcgcacgaccggtgctcgatttagacgacagctcagggggggggaaggcgtcagcttcagctgtggtagagaagacaggactcaggacaatctccagcatggccggcttccctntccctctccaccctcctcactcactgcgcagggtcctcgggccagtctgtcgctgactcacgccaccctcagcgtctcgggaccccggacgnggtccncatctctttgtcnggacgcaactccaanatacggaactaatagttagtattcgtggtatanagactaacctccgtaaggataccggaccccaaacttccgtacactacgacgtaacgaactaatccacggaccgccgtacggtaaccggggtccccgtagtaacccgtacgtttcccgttcggttacggtacctacgtaacggttcctacgggaccgtaccctacgtaccgtcccttcccgtacgtacccgacttacccgtacgggttcggtacccggttacccgggtacggtacgggtaacgtaccggttacggtacgttacccgtaacgtttaaacgttcgttacggttcgaccgttaacgttaccgaaccggggtaccgttaaacgccgaagggttaacgggccgtttaaaggaaccttagttaaccggttacgggaacgggttttcggggttaccggggtttacgttaccgggggacgggttttaacgggaaaccctttaaccggggacgttaacccgggttacgttaacggttacccggg

SEQ ID NO: 25204 - DNA, 316 bp, Homo sapiens
  misc_feature: GYAE6OF02FM7AK.21.22.B11.1.454.CMB.1.raw
  modified_base (294)..(294): a, c, t, g, unknown or other
  misc_feature (294)..(294): n is a, c, g, or t
  modified_base (301)..(316): a, c, t, g, unknown or other
  misc_feature (301)..(316): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggtcagcccaaggctcgccccctggtcactctgttccccaccttcctcctcgtctctactgagcgggctggcaaggcncagtagnnnnnnnnnnnnnnnn

SEQ ID NO: 25205 - DNA, 886 bp, Homo sapiens
  misc_feature: GYAE6OF02I99EV.21.22.B11.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagacgacagctcagggggggggaagctcagcttcagctgtggtagagaagacaggactcaggacaatctccagcatggccgcttccctctcctcctcaccctcctcactcactgcgcgagggtcctcgggcccagtctgtgctgactcacgcccaccctcacgccgtcgtccggggacccccggnaggacgggtccaacctagttccttcgtttggttccgtggaacggacctaacctaccaaactagtacggtaaattaattatgttattcgtggtactcgacgacctaacctcccgaaggaaccgtacccggaccccctaaactcctactaacctaccgaaaggtaaacggtaaacttaactaccggaacggtccccgggtacccttacgggtaacccgggggttccctacggtaacccgttagtttcccgttacgtccggtaccgtaaccgtaacgttccggtaccgtaaccctaaccgttccaacccgttaccccgttacccgtaacgtaaacccgttaacgttccgggtacgggttcccgggttacccggtacccgggttaacggtaacgggttaacgggtacggtaacgggttaccgtaacgtttaaaccttttacggttaccgttacgggtacgtaaccgtaacccggttacggggaaaccgggttaacccgtaacgtaaaccgggttaacgggttacggaacctaacggtaaacgttacccgtttagggtacgggtttccgggggtttaaccggggtttcgggggtttacggtaccggggaacggggtaaaccgtaaccggtaaccgttacccggtaacccggtttaaccggtccggtaacccgg

SEQ ID NO: 25206 - DNA, 690 bp, Homo sapiens
  misc_feature: GYAE6OF02F3YSQ.21.22.B11.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (568)..(568): a, c, t, g, unknown or other
  misc_feature (568)..(568): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccatcctcactcactgcgcagggtcctgggcccagtctgtgctgactcagccacctcagcgtctcgggcccccggnaggacggtcaccatctcttgtctggagcactccaacntcggaataattatgtattctgtatcagcaactcccgaaggacgtccggacccctaaactcctacactccgagaagtaataacgtcgacggccgaccctcggaccgggtccctacgacccgttacttcgtacgtcggtacctaccgtaagttccgtccgggtcctaaccgtccgaccgtcccctcccggtacaacccgtagtccgtacgggtcgggtacccctccgggggtaacccgtagggtaacgttcggacggttccgtacggtaacttaacgtttcggtacgtcgtacacggtaccggtaccgggaccgacttaaacggngttacgggactacggaacttacgtacgggtggttacgggtacggggttttcgggtacgggttaccggggaccggggaacggtaaaccgtaacgggtaccgtacccggttaccgtaacccggg

SEQ ID NO: 25207 - DNA, 871 bp, Homo sapiens
  misc_feature: GYAE6OF02IZ38O.21.22.B11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctcgactcacgccaccctcagcgtccgtcggggacccccgggcgaggngggtaccaccacgttccttcgtttcggttccgttagggacggacctaaacctacccgaaaacctagtaaccggtaaagttaaatttagttagttaactttcgtaggtacttaccgaacggaccctaacctacccgtaaagggaaccgtaccccgggtaacccccctaaccgttcccctaccgtacgtacccggaaaggtaacggtaaaccgttaaacgtccgaaccgggtcccggtcccccgttacgggaccccggggttcccgtaaccggtaaccctttacgtttccccgttacggtaccgggtaccctaaccggtaacggttcccggtacggtaccctaaaccccgttcccgaccgggtaccccctaccgttaaccgacccgtagttcccggtacggggtccgggtccggtttaccccggggaccgggtaacggacgtcgggtacggtaccttaaccggttaccttaacgtttcgttacggacgtactaacggtaccggaacggtaccggaactacgtagggtacggtaactcggaactacgtcgggtacgggtcggtttcgggggttaggttccgggtaccgggtaaggtaacccggggaacccttaaccgggtacccggtacccggtttacccaacgggtacccgg

SEQ ID NO: 25208 - DNA, 702 bp, Homo sapiens
  misc_feature: GYAE6OF02I7V4F.21.22.B11.1.454.CMB.1.raw
  modified_base (220)..(220): a, c, t, g, unknown or other
  misc_feature (220)..(220): n is a, c, g, or t
  modified_base (553)..(553): a, c, t, g, unknown or other
  misc_feature (553)..(553): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctcgggcccagtctgtgctgactcacgcccaccctcacgccgtccgtccggggacccccgggnaggacgggtccaccatctcttgttctggagcaactccaacatacggaattaattatagttattcgtaggttactcagaccaaccgtaccgaaggtaacgtccggaaccccctaaacttccctacacctaccgaaggaacgtaaactaactacgacggcccggtaccctacggaccggggtaccctacggaccgtacttccgtacgtcggtacctacgaacgtcgtcggacctaccgtccgacgtccctacctacgaccctagtccgagggttccgggtacccgtcccggggtacgtacggtacgtacggacggtctacgtaccttacttacgngtcgactacgtccggaacgggaccacgtaacgtggtacggtactacgaactagttcgtagggtacgggtcgggtttgggtaccgggttcgggaccgggtaaccggtaaccgtaacggttccggacccggttaccggtacggtaacccgg

SEQ ID NO: 25209 - DNA, 576 bp, Homo sapiens
  misc_feature: GYAE6OF02HW1T3.21.22.B11.1.454.CMB.1.raw
  modified_base (210)..(210): a, c, t, g, unknown or other
  misc_feature (210)..(210): n is a, c, g, or t
  modified_base (347)..(347): a, c, t, g, unknown or other
  misc_feature (347)..(347): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaagtaattatgtattctgtatcagcaactcccaaggaatcggacccccaaatcctacatccaagagaataatcagcgccctcgacggggtcccngaccgtattcctcgtcggcctaccaagtcctggaccaccgtccacgtccctcccgtagacccatcgaggtcgggcctccgggccgaggatggagtctagactattcngtnactagaccgacgggacacaaacgtgtggatagaacattcgaggacggttccgggttgggttcggtccgggacggtacgggaaccctaaaacgtccggtaacccgttccggtaggtaccg

SEQ ID NO: 25210 - DNA, 738 bp, Homo sapiens
  misc_feature: GYAE6OF02HAQK0.21.22.B11.1.454.CMB.1.raw
  modified_base (210)..(210): a, c, t, g, unknown or other
  misc_feature (210)..(210): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggacggcaactccaacngtacggaataattatgttattcgtaggtactcagaccaactcccgaaggtaactcggaccccctaaactccctacacttaccgagaacggtaaactacgtacgacgaccggtcccgtacggtaccggggtccctacggaaccggttacttcctcgttacggacccttacgaacgttccgtacggacctaccgtaccgtacgtcccctaccgtaggaaccccttaggtacccgtagggttccggggtccctaacccggggttacccggtaagggtactttaccggggaacgttccggttacgaacgttttaccttaacggtcggtaaccgaacccttaaggttacccggaaaccggggtaccccgaagaaacccgttgggtaacgggtactcgaaacgtttacgtcggtacggtaacgggttccggggttagtcggttaccgggaggttacgggaaccctacggttacgacccggtttacaggtacccg

SEQ ID NO: 25211 - DNA, 573 bp, Homo sapiens
  misc_feature: GYAE6OF02JRUW4.21.22.B11.1.454.CMB.1.raw
  modified_base (340)..(340): a, c, t, g, unknown or other
  misc_feature (340)..(340): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
  modified_base (569)..(572): a, c, t, g, unknown or other
  misc_feature (569)..(572): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcactccaagacggaataatcagcggccctcgaggggtccctgaccgattcctcgtggctccaagtctggcaccgtcacgcctccctagaccatcagtcggactcccggtccgaggatgacggtctagactactttacgngttcgctatccgacgggaccacaaccgagtgggactagaactagtctggagtcggttgggtcgttcgggacggtacggactaacgtcgtaccgtcgtagtacgacgcccgaaggtccaccgtccccgtcggtaccacgtctaccgtcccgcccttccgtcctacctccgtctcgtcgtacgtcggctcggacgtacggcgaccgtagtacgtcncgtncgctcnctgcnnnnc

SEQ ID NO: 25212 - DNA, 427 bp, Homo sapiens
  misc_feature: GYAE6OF02IFUWV.21.22.B11.1.454.CMB.1.raw
  modified_base (313)..(313): a, c, t, g, unknown or other
  misc_feature (313)..(313): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
  modified_base (395)..(427): a, c, t, g, unknown or other
  misc_feature (395)..(427): n is a, c, g, or t
tcagtcgtcgctcgcacgaccggtgctcgatttagacgacagctcaggggtccctgaccgattctctggctccaagtctggcacctcagcctccctgaccatcagtggctccggtccgaggatgaggctgactattactgttgcatcgacgggtacgcaacatcgggatgacaatctgaggcggtggttggttcggcggagggtaccgaaacgtggtaccgtcctagggtccagtccccgaaaggcgtaccgtcccccggtcggttccaccgttaccgtgttaccccccggcccttccccttcccggttaccnccgttaccccttacgttcgaaccggcgggggtccttacgggacgaaggccggcctaaggtctagctgcnctgcaagcncatnnnnnnnnnnnnnnnnnnnnnnnnnnnnnnnnn

SEQ ID NO: 25213 - DNA, 640 bp, Homo sapiens
  misc_feature: GYAE6OF02FU8IT.21.22.B11.1.454.CMB.1.raw
  modified_base (300)..(300): a, c, t, g, unknown or other
  misc_feature (300)..(300): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccgggcagagggtcaccatctcttgttctggaggcaacctccaacatcggaatattatgtatctgtatcagcactccagatcgacccaactctnatccagagaataatcacgccgcctcgacggggtccctgaccgtattcctcgtggcctaccgaagtctcggcctaaccctcacgtccctcccgtcgaccctatcgaggttcgggccttcccgggtaccgaggtactcggaacgtcgtacgtaccttaacgttaccgtcggtacgaccaacgttaccgaacggggtaccgacaaaccgtacgtacgggaactacggaacctaacgttccgtaggtacggttcggggtttacggggttacggtttaccggggaccgggttaacgggaacccctaaaccggttcccggtaacccggtttaccgtagggtacccg

SEQ ID NO: 25214 - DNA, 808 bp, Homo sapiens
  misc_feature: GYAE6OF02HCYOG.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcagggggggggaagctcagcttcaactgtggtagagaaagacaggactcaggacaatctccagcatggccggcttccctctcctcctcaccctcctcactcactgcgcagggtcctgggcccagtctgtgctgactcagcccacctcagcgtcgtcggggacccccgggnaggacgggtcaccgattccttcttgttcctggaggcaactccaacatcggaataattatgttattctggtatcagcaactcccgaagacgtcggacccccaaactccctacacgttaccgaaggtaacggtaaacttaaacgccgaacgggcccggtacccctaccgggtaaccgggggttcccctacggtaacccgttacttttaccgtccgttcgggacccttaacccgtaaaggttccgtccgggtaccctaaccgtacccgacgtcccccgttaccgtaccggtaacccttaccgtaccggtacggggttccggggtaccccgttccggggtacccgtaggggaacgttacgggtacggtaccgttaggttaaccgttacgttaaccgtacggttcgaaccttacggtacccggtaacggggaaccgtaccgaaacgttaacggtaggtaacgtaaccgaacttaacggttcgtacgggtacggttcggggtttcggggttacggggttacccgggacggggtaacccggttaaccggtaaaccggtccgggtaacccggttacccggtaacgggtttcccgaacccggg

SEQ ID NO: 25215 - DNA, 638 bp, Homo sapiens
  misc_feature: GYAE6OF02H8PA6.21.22.B11.1.454.CMB.1.raw
  modified_base (330)..(330): a, c, t, g, unknown or other
  misc_feature (330)..(330): n is a, c, g, or t
  modified_base (624)..(624): a, c, t, g, unknown or other
  misc_feature (624)..(624): n is a, c, g, or t
  modified_base (629)..(630): a, c, t, g, unknown or other
  misc_feature (629)..(630): n is a, c, g, or t
  modified_base (633)..(638): a, c, t, g, unknown or other
  misc_feature (633)..(638): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcgagggtccctgaccgattctcgtggctcaagtctggcacctcagcctccctgaccatcaggtgggctcccggtccgaggatggaggctgactagttactgngcatcgacgggacgcaaaccgtgtagggatacggaacaaagtccgtgggacgtcggggtttaggggttcggttttgggacggggacggggtaaccaaacgttcggtaaccccggttaccgttacgggtaccgaacggaccccgaacgggaccgttaccggcccccccgttacggtccgtaccgttcctcccggtttccccggcccccttcccgttccccgtcccggttcccttccgtaaccgttccggtacggtccggggcctcgggaccgaaccgggcgacctaggtacgcangacgnngcnnnnnn

SEQ ID NO: 25216 - DNA, 744 bp, Homo sapiens
  misc_feature: GYAE6OF02GHBY1.21.22.B11.1.454.CMB.1.raw
  modified_base (721)..(721): a, c, t, g, unknown or other
  misc_feature (721)..(721): n is a, c, g, or t
  modified_base (725)..(725): a, c, t, g, unknown or other
  misc_feature (725)..(725): n is a, c, g, or t
  modified_base (730)..(730): a, c, t, g, unknown or other
  misc_feature (730)..(730): n is a, c, g, or t
  modified_base (734)..(734): a, c, t, g, unknown or other
  misc_feature (734)..(734): n is a, c, g, or t
  modified_base (738)..(738): a, c, t, g, unknown or other
  misc_feature (738)..(738): n is a, c, g, or t
  modified_base (740)..(742): a, c, t, g, unknown or other
  misc_feature (740)..(742): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagccggccctcgacggggtcccctagacccgtattcctcgtcggcctaccgaagttctcggaccaccctcacgtcccctcccgtacgaacccattaccgacgggttcggggtcccgttaccccgggtacccgggagggtaacgttgggaacggtcttacggtaacctttaagtttaccgtggtcgactacgtaccgaaccggggaccgaaacgaaagtgggaatacgaactaagtcgtaggtacgggttcgggtttggggtcggttcggggaccgggtaacgggaacctaaccgtacggtaccccggttaccgttacgggtaccgaccggacccggtaacgggtcccgtaccccggtcccccgttaccgggtacctacccgttccgttacccggttccccccgtcccctttaccccgttcccgtttaccgtttccgttaccgtccgggtacgggtcccgggtcgtaccggacggaaccggtccgtaagtacgtacggctcgngtcngtcgnacgntcgncnnncg

SEQ ID NO: 25217 - DNA, 721 bp, Homo sapiens
  misc_feature: GYAE6OF02GS0B3.21.22.B11.1.454.CMB.1.raw
  modified_base (123)..(123): a, c, t, g, unknown or other
  misc_feature (123)..(123): n is a, c, g, or t
  modified_base (215)..(215): a, c, t, g, unknown or other
  misc_feature (215)..(215): n is a, c, g, or t
tcagtcgtcgctcgcacgaccggtgctcgatttagacgacagctcaggggggggggaagctcagcttcagctgtggtagagaagacaggactcaggacaatctccagcatggccggcttcccnctcctcctcaccctcctcactcactgcgcagggtcctgggcccagtctgtgctgactcacgcccaccctcagcgtcgtcgggacccccgggnaggacgggtccaccatctcttgttctggacgcaactccaacagtacggaagtaattatagtattcgtaggtatcagacaactcccgaaggaactccggaccccctaaactccctacactccgaagaaggtaaactaacgtacacggccggtaccctcggaccggggttccctaggaacccggttacttccgtcgtcggtacctaccgaagttccgtacgccctaacctcgaccgttccctaccctacgtacccaacgttcgtacgggtcgggttcccggttacccgggtaccggtaggtacgtacggacggtaccttaggtaccttacgttaaccgtacgtaaacgtaaacgtaaggtacgtacgttaaaggtaggtaaccgttacgtacgttaacgggttgggttccggttacgggaccgggtaaccgggaacctacggtcgtaccggacccgttacgtacgggtacctaccggacccgtaacggtcccgttacccggtcccccg

SEQ ID NO: 25218 - DNA, 744 bp, Homo sapiens
  misc_feature: GYAE6OF02HYV1O.21.22.B11.1.454.CMB.1.raw
  modified_base (212)..(212): a, c, t, g, unknown or other
  misc_feature (212)..(212): n is a, c, g, or t
  modified_base (444)..(444): a, c, t, g, unknown or other
  misc_feature (444)..(444): n is a, c, g, or t
  modified_base (466)..(466): a, c, t, g, unknown or other
  misc_feature (466)..(466): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctctcaccctcctcactcactgcgcagggtcctgggcccagtctgtgctgactcagccaccctcagcgtcgtcggggacccccggnacggagggtcaccatctcttgttctggagcaactccaacagtacggtaagtaattatgtattcgtggtatcgagctaaccgtcccgaaggtaactaccggaccccctaaactcctacactaccgaagtaaggaaataactacgacggacccggtacccgtacgaccgggggtaccctaggaccgtacttccgtcgtcggtacctaccgtaagttccgtcggaccacccgtcnccgtcccctacctcgtaacccntccggaggttcggggtcccttccgggaccggtaggacgtcggacggtcctaacgttacttaaacgtttcgtacggttccgaacgtacgaccggtaaccggggactaaccgtaccgtaagggtcgggaacttacgggtaactaacggttcggtaacggtacgggggtttccgggggtttaggggttacccgggttaccggggggaaccgggtaaccggggttaacccttaaacccggggtttaccggaacccgggttttaccggtaggtaaccccgggg

SEQ ID NO: 25219 - DNA, 322 bp, Homo sapiens
  misc_feature: GYAE6OF02I6MBJ.21.22.B11.1.454.CMB.1.raw
  modified_base (300)..(300): a, c, t, g, unknown or other
  misc_feature (300)..(300): n is a, c, g, or t
  modified_base (306)..(322): a, c, t, g, unknown or other
  misc_feature (306)..(322): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaacgtcgaccgtcctaggtcacgcccaaggctcgcccccgtcgtcactctcgttccccgccctcctcctcgtctctactgacgcggctggcaaggcncatagnnnnnnnnnnnnnnnnn

SEQ ID NO: 25220 - DNA, 637 bp, Homo sapiens
  misc_feature: GYAE6OF02FHOV3.21.22.B11.1.454.CMB.1.raw
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(633): a, c, t, g, unknown or other
  misc_feature (631)..(633): n is a, c, g, or t
  modified_base (635)..(637): a, c, t, g, unknown or other
  misc_feature (635)..(637): n is a, c, g, or t
tcagtcgtcgctcgcacgaccggtgctcgatttagacgacagctcagggtcctgtgcccagtctgtgctgactcagccaccctcagcgtctgggacccccgggcagagggtcaccatctcttgttctggaggcaactccaacatcggaagtaattatgtattctggtatcagcaactcccaggaatcggcccccaaactccctcatccagacggaaataatcagccggccctcgacggggtcccctgaccgtattctcctggcctaccaagtctagggccacctcacgccctcccctgacccatcgagtcgggcctccggtccgaggatgaggctgactnttactgcncatcgacggcgacacagtcgggatagaactaagtctaggtacggtcgggttttgggtcgttcggggaccggggaacgggtaacccgaaacggttcggaacccggttacccgtacgggttaccaccggacccgaacgggcctccggtccccccgttcgggtacctacccgtccgtttccgttaccccctaaccccgttccctaccccgttccgtaccctttacgttaaccgtcggacgtccgggtctccgggaccgacggccgacgtaacgtgacncngncncnnncnnn

SEQ ID NO: 25221 - DNA, 591 bp, Homo sapiens
  misc_feature: GYAE6OF02FYRK7.21.22.B11.1.454.CMB.1.raw
  modified_base (215)..(215): a, c, t, g, unknown or other
  misc_feature (215)..(215): n is a, c, g, or t
  modified_base (280)..(280): a, c, t, g, unknown or other
  misc_feature (280)..(280): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggccccagtctgtgctgactcagcccaccctcagcgtctcgggaccccccgggnagagggtcaccatcctcttgttctggaggcaacctccaacagtacggaagtaattagtgttattntgtatcagcaactcccagaatcggacccccaaactcctacatccaagagaaatatcagcgccctcgacggggtccctagaccgtattctcgtcggcctaccgaagttcgtcggcctacctcacgccctccctagaccctatcaggtcggacctacccgggtcgacggtatcgagtcctagaccttattacgtgtgcagtcgaccggganaccgaangtaggaatacgaactagtgtaggtagggtcgggtttagggtcgttaccgggacggtacggaaccctaaacgcggtaccggttaccgaggtacccg

SEQ ID NO: 25222 - DNA, 962 bp, Homo sapiens
  misc_feature: GYAE6OF02IFINI.21.22.B11.1.454.CMB.1.raw
  modified_base (220)..(220): a, c, t, g, unknown or other
  misc_feature (220)..(220): n is a, c, g, or t
  modified_base (262)..(262): a, c, t, g, unknown or other
  misc_feature (262)..(262): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcacctcactgcgcgaggtcctcgggccagtctgtgctgactcacgccacctcacggtcgtcgtccgggggaccccccggtnaacgggacggttccaccgtacttccgtttcctttggttccgngggaacggaccaaccgttacccaaactaacggtaccggtaaaaggttaaactttagttagttaacgtttcgttacgggtacttacgaagtaacccaaccttaccccggaacggtaacgttcccggaccccctaaaaccgtccttaccaacttaccgaagtaacggtaattaaactaccgaacggcccggtaccctaccgggtaccgggtacccgaccgggttaacctcgtttccgtaccgtggttaccctaccgttaacggttcgtttcccgggaacctaccccgttacacccggttaccccgtacccgttacccgtaacccgtaccgttaccggttaaccgggttccggggacccgggtttacccgggttacccggggtaaccgggtagtacccgggttaacgggttccgtaacgtttaaccgttaacgttacggtaccgtacgtaaccgtacgttaacccggaacgggtaacccgtaaaccgttaaccggtggttaaaccgggtaccgtaacgtaacccgtttacgggacccggtttaacgggttaaccgggggttacgggtttttcccggggggttacggggggtttaaccccgggtaaacgggggggtaacccgtaaaaccccgggttaaacccgggtttaaccccgggttaaccccggttttaacccgggtttaacccgggttaaacccccgggg

SEQ ID NO: 25223 - DNA, 672 bp, Homo sapiens
  misc_feature: GYAE6OF02JDLSI.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagaggtccacatctcttgtctggagcaactccaacatacggaagtaattatgtattctgtatcagcaactcccaggtaactcggacccccaatcctacactaccgaagagtaaataactcgaacggtccggaccctcgaccggggttcccaggaccgtattccgtcgtcggtcctaccgtaagttctcggcctacctccacgtccctccgtacgacctatccgaggtcgggaccttccggacgaggagtcggacggtctacgtaacttagttacctggtacgtcctacggtaccgaaccggggaccgaacctaacggtagtagggtaactacgtaaccgtaagtcggtacgggtaagggttcccgggggtttaggggtaccgggttacccgggtaacggggaaaccgggtaccccgttaaaggtcccggttaaccccgggttcggtaaccgggtaaccccgg

SEQ ID NO: 25224 - DNA, 509 bp, Homo sapiens
  misc_feature: GYAE6OF02GIN7J.21.22.B11.1.454.CMB.1.raw
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (501)..(509): a, c, t, g, unknown or other
  misc_feature (501)..(509): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcatccagaggaataatcagcggccctcgaggggtcccctgaccgattctcgtggctccaagtctggccacctcagcctcctgaccatcagtggctccggtccgaggatgaggctgactattactgtgcatcgacgggacncaacngtgggatgacaatcgngagcggtttgggngtcgggcggaggacaacgtgaccgtctaggcagcccgaaggcctcgccccgtcggtcacgtctcgttcccgccctccgtcgacgccgacgctgacgcggactggaccaggccgacagtagncngcnnnnnnnnn

SEQ ID NO: 25225 - DNA, 697 bp, Homo sapiens
  misc_feature: GYAE6OF02GRELR.21.22.B11.1.454.CMB.1.raw
  modified_base (215)..(215): a, c, t, g, unknown or other
  misc_feature (215)..(215): n is a, c, g, or t
  modified_base (297)..(297): a, c, t, g, unknown or other
  misc_feature (297)..(297): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctccaccctcctcactcactgcgcagggtcctcgggcccagtctgtgctgactcacgccaccctcagcgtcgtcgggacccccggnaggacgggtccaccatccttcttcgttcgtgggacgacctaacctccaacagtacggaattaattatgttattcgtaggtancagaccaacctaccgaggaactccggaccccctaaactcctacactcgaagagaatacacgacgccgaccgtcggtaccgggtcctagtaccgtacttcctacgtcggtacctaccgtagtccgtcggacctaccgtcaccgtccctaccgacgacctagtaccgtagggtccggtccgtacccgggaacgtacggtagtcgggtacggtacttacggttaattacgttcgtagcgtaccgacggttaccggaaccggtaccgaacgtaccgtaagggttccggaataccggaactacggttcggacgggtacgggttccgggttagggttacccgggtacggggaaccggtaacccgggtacctaacgggtcccggtaccggttaccgaggtaacccgg

SEQ ID NO: 25226 - DNA, 831 bp, Homo sapiens
  misc_feature: GYAE6OF02GU3JN.21.22.B11.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtctgggcccagtctgtgctgactcacgccaccctcagcgttcgtccggggacccccgggnaggacgggtccaccgtactcttcgtttagttcgtgggacggtccaacgtacccaacgacgttacggtaaagttaatttatacggtttaattaccgttaggttaacttcgacggtacctaaaccgttccccggaaggtaaaccgttacccgggaacccccctaaaaccgtttccctacctaaccgtaacccgaagggtaacggttaaaactaaaccgttccgaaacggtaccccggtccccgttacgggtacccggggttacccctagggaaccccttacgtttccgtcgtttacggtacccttaccggtaacgttccgtacggccctaacccttccgaccgttccccgttccgaccgtacctagtaccgtacgggtcggtccgttaccggtcggagtacgtaggtacggtactacgtacgttacttacggtagttcgtacgtacgtaccggtaccgggtacgtaacgaacgtacgggtagtaacgttacaacgttacgtacgttacggtaccggggtttcgggttacggggttacccggttaccggggaccgggttaacggaaacccggttaacggttacccggtaccccgggtttacggtacgggttaacccgg

SEQ ID NO: 25227 - DNA, 767 bp, Homo sapiens
  misc_feature: GYAE6OF02IBMPC.21.22.B11.1.454.CMB.1.raw
  modified_base (213)..(213): a, c, t, g, unknown or other
  misc_feature (213)..(213): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
  modified_base (616)..(616): a, c, t, g, unknown or other
  misc_feature (616)..(616): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcgagggtcctgggcccagtctgtcgctgactcagccacctcagcgtcgcggggacccccggnaggaggtccaccatctcgttgttctggacgtcaactccaactagtacggtaagtaattagtgtacttctaggtactcgacacaacctcccgaagacgtaccgaccccaaactcctnactacgagaagtaactacncgagccgccgtacggacggttaccacgtaccgtatcgtcgtcgacctaccgtacgtactcggaccctaccgtacgtaccctcccgtaccctacggaccctaacgtcggtaccggggttccgggacccgtttacccggggaacccggtgggttaaactcggggtaacggtcggtaacggtttaaatttccgttaaccggtggtaccgtaaccgtaccgttacccgggaacccgggtacgaaacgttaacggttaggaacggggttaaanacggttaaaacctcggtacccggtaaggggtacgggggtttaccgggggttttcgggggttaacgggttacccggggggaacccgggggtaaaggtaaacccgtaaacccggttccggggtaaacccctttacggggtaacgtaccccggg

SEQ ID NO: 25228 - DNA, 834 bp, Homo sapiens
  misc_feature: GYAE6OF02FMOVK.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctgggcccagtctgtgctgactcagccaccctcagcgtcgtcgggaccccggcgagagggtcaccatctcttgttcgtggaggcaactaccaacatacggaagttaattatagttattcgttggtatcgacgtacaacctccgaggtaacgtaccggacccccaaactcctacactaccgaaggaacggaaataacgtaccgacggccggtccctaccggtaccgggggttcctacggaaccgtactttaccgttccgtccgggtaccttaccgtaacgttccggtcggtacccgtaccgtacctaccggtccccttacccgtcgaaacccgtacgtaccgtacgggttaccggggcccgttacccggggtaccgggtaacgggtacggtacgggtacgggtaccgttaacggttaacctttaacgtttaccgttacggtacgtacgtaaacccgttacgggtaaacccggggaaccggtaacccgtaaaacggtagggttaaccggtaacgtaacggaaaccgttacgtacggttaggggtaacccggggttcggggggttttaacgggggtttccgggggttaacccgggggtaaccggggtaacccggggtaaacccggttaaaccggttaccggggtaacccccggtttaccggtaacccggggttacccgg

SEQ ID NO: 25229 - DNA, 762 bp, Homo sapiens
  misc_feature: GYAE6OF02HW5WT.21.22.B11.1.454.CMB.1.raw
  modified_base (115)..(115): a, c, t, g, unknown or other
  misc_feature (115)..(115): n is a, c, g, or t
  modified_base (541)..(541): a, c, t, g, unknown or other
  misc_feature (541)..(541): n is a, c, g, or t
  modified_base (606)..(606): a, c, t, g, unknown or other
  misc_feature (606)..(606): n is a, c, g, or t
tcagtcgtcgctcgcacgaccggtgctcgatttagacgacagctcaggggggggaaggcgtcagcttcagctgtgtagagaagacaggactcaggacaatctcagcatggccggnttccctctcctcctccaccctcctcacctcactcgcgctagggtcctcgggccacgtctgtgctgactcagcccacctcagcgtctcggggaccccggctaaggacgggtcaacccgtattccttctttcggtttaccgtaggtacgggaccaaacgtccccaaaatacgttaccgggaaaaaggtttatttaaagtggtttaacttttccggtggtttaacgttacgtaaggacctaaacgttacccccgaaggggtaacttaccgggaccccccctaaaaacttccccttaaccacgtttaccccgaaaggacgtaaaattaccacacggtacccgcccgtagtacgggggtaccctcgaaccgtcgttcttcggtcgtacgtacctaagtcgtcggctaacctccgtatccctcgtaccaacnctacgaggtccggtcgtcccgggtaccgagggtcaggtaccgggtctacggtaaccttacgtttntacggcgaactacgtacggaacgctaacgtaacgtcggaagaaccgtcgaacagtttccggtacggacggttttcgggtcgggggttacgttaaccgggggccggttaaaccggaacggtaaccgttaccgggtaccctaccgggttagaacccgg

SEQ ID NO: 25230 - DNA, 1009 bp, Homo sapiens
  misc_feature: GYAE6OF02HBLME.21.22.B11.1.454.CMB.1.raw
tcagtcgtcgctcgcacgaccggtgctcgatttagacgacagctcaggggggggggaagctcagcttcagctgtggtagagaagacaggactcaggacaatctccagcatggccggccttccctctcctcctccaccctcctcactcactgcgcgacgggtcctcgggcccagtctgtgctgactcacgcccaccctcacgccgtcgtccggggacccccgggcgacggacgggtccaccgtacttccgttcctttggttccgtgggaaccggtcctaaacccgtacccgaaacgtaacggttaccggggtaaaattttaaacgtttaagttacggtttaacttttaccggtttacgggttaaacttaccgtaacggtaacccccgttaaaaccccttaccccggaaaacgggtaaccggttaccccccgggtaacccccccgttaaaaaccccttcccctaacccgtaacccgttacccggaaaggtaaaacgggttaaaacctttaaaaccgaccgtaccgggtaaccccgggtccccgttaaccgggtccgggggttaccccgtaccgggtaacccgtttacgtttccgttacccgttggaccccgtttaaccggtaacggttcccgtaccgggtacccctaccgttccgtaacccggtccccttaccccgtaacgtaaccccgtacgttaccggtacccggggtttcgggacccgtttaccccgggggaggtaacggaccggttagggtcccggtaggttaccttaaaccggtttactaaccggtttcgtccgtacttaaacccggcccggggtaaccggaaccctaacgaaaaccggttacgggtaacggtaacgtaccgtaaacgttcttacgggttaaggggtaccgggtttacggggggtttacggtacccgggggttaacggggtaacgggtaacccgggttaaacccggtaagggtttacccccgggaacgggttttcccgggtaaacccgggtcccgg

SEQ ID NO: 25231 - DNA, 774 bp, Homo sapiens
  misc_feature: GYAE6OF02G1UHF.21.22.B11.1.454.CMB.1.raw
  modified_base (192)..(192): a, c, t, g, unknown or other
  misc_feature (192)..(192): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctccaccctcctcactcactgcgcagggtcctgggcccagtctgtgctgactcagccaccctnagcgtcgtcgggaccccggcaggacgggtacaccactctcttagttcgtaggacggtacaacctcccaaacacgttacggtaaagttaattagtcggtaatttccgtaggttaactccgagtaccaaacctacccggaaggtaactccggacccccaaacgttccctacactaccgaagaggtaaactaacgtcaacggccgtacccgtacggtaccggggtccctacgaccgtattacctcgtcggtacctacgtaacgtccgtacgacctacctccgacctcccgtaccctacggacctacgtcggtacgggtccgggtaccgtaccgggtaccgtaagggtcgttacgggacggtaccttaagttaccggttaacttttaccggtcggtagtacccgtaccgtaccgggtaccgggtacaaaccgaacggttacgggttaacgggacttaaccggaacgttacgttccgggtaggtaaccgggggtttcgggtttacggggtcgggttacccggggaacggggtaaccggttaacccgtacgggttaacccggcccggttttaccggaggtaacccggg

SEQ ID NO: 25232 - DNA, 589 bp, Homo sapiens
  misc_feature: GYAE6OF02FHT0B.21.22.B11.1.454.CMB.1.raw
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (392)..(392): a, c, t, g, unknown or other
  misc_feature (392)..(392): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctccctcctccaccctcctcactcactgcgcagggtcctgggcccagtctgtgctgactcagcccaccctcagcgtctcgggaccccggnagacggtcacatctcttgtcnggagcacncantcgaatatntntatntgtancancacctccaggancgaccccaatcctanactcagagaatancgacgccgcctggacgggtcccagacctattcacgtcggcctaccgagtcgtcgacctacgtcgacgccctcccgtagaaccctntaccgtacggtccgggtccgttacccgggaccgggagtacgtcgggacgtcgttaacgttacctaagtttcctagggtcgaccgtaatccggaaccgggacgactacgtaggtccggagttcgaactagtcgtaggtgggtcgggttgggtccgtgggaaccggagacctaacgtcggtaccgttaccggagacccg

SEQ ID NO: 25233 - DNA, 747 bp, Homo sapiens
  misc_feature: GYAE6OF02GN9WP.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggcagagggtcaccatctcttgttctggaggcaactccaacatcggaagtaattatgtattctggtatcagcaactcccaggaactcggacccccaaatcctcatccaagagaataatcagccgcctcgacggggtccctgaccgtattcctcgtcggcttaccgaagttcctcgggccaccctcgacgtcccttccctacgaccctaagtccgaagggttccggggccttacccggggtaccggaagggtagttcgggaacgggtccttaacgggtaactttaacgtttaccgttgggtaccgtacgtaacgtacccgggaaaccggggaccgtaaccgtaaaaccgtaggttacgggggtaactacgggtaaacctaaacggtttccgttaaggggtaaccgggtttccgggggttttacggggggttaccgggttttacccgggggggaacgggggtaaaacccgggggttaaccccgtaaaaaccggtttccggggtaaccccgggtttaccccggttaaggggttaacccccgg

SEQ ID NO: 25234 - DNA, 837 bp, Homo sapiens
  misc_feature: GYAE6OF02HUTEW.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcaggggggggggaagctcagcttcagctgtggtagagaagacaggactcaggacaatctccagcatggccggctttccctctcctctcaccctcctcactcactgcgcagggtcctgggcccagtctgtgctgactcagcccacctcagcgtcgtacggggacccccggnaggacggtcaccattcttcgttgttcgtgggacggacctaacctaccaaacgtacgtacgggtaaaacgttaatttattaggttaactttacgtaggttaacttacgaagtacctaaaccgttccccgaaagggtaaaccttacccgggaaccccccctaaaaccgttccctaccgtaaccgtaacccgaagggtaaacgggtaaacttaaacgtaccggtaacgggcccccggggtaccccgttaccgggtaacccggggggttacccctacggtaacccggtactttacccgtacggttaccggacccttaaccgtaacggttcgtccgggtaccctacccgtcgtaaccggtccccttccgtacgaaaccctacgttccgtaacgggttcccggggtacccttacccggggtaccggaaggggtactaggggaaccggttctaacgtaacctttaagtcgtacgtcgactacgtaccgggaacgggtaccagtaacgtaggtacggaacttacgaacgttacgttcggtagggtacgggttccggggtttagggttccgggtacgggaccggggtacgtaaacccgtaacgtcgggtaaccccggttgtacggtacccgg

SEQ ID NO: 25235 - DNA, 612 bp, Homo sapiens
  misc_feature: GYAE6OF02GLEPP.21.22.B11.1.454.CMB.1.raw
  modified_base (212)..(212): a, c, t, g, unknown or other
  misc_feature (212)..(212): n is a, c, g, or t
  modified_base (234)..(234): a, c, t, g, unknown or other
  misc_feature (234)..(234): n is a, c, g, or t
  modified_base (366)..(366): a, c, t, g, unknown or other
  misc_feature (366)..(366): n is a, c, g, or t
  modified_base (485)..(485): a, c, t, g, unknown or other
  misc_feature (485)..(485): n is a, c, g, or t
  modified_base (530)..(530): a, c, t, g, unknown or other
  misc_feature (530)..(530): n is a, c, g, or t
  modified_base (553)..(553): a, c, t, g, unknown or other
  misc_feature (553)..(553): n is a, c, g, or t
tcagtcgtcgctcgcacgaccggtgctcgatttagacgacagctcgagggggggggaagctcagcttcagctgtggtagagaagacaggactcaggacaatctccagcagtggccggcttccctctcctcctcaccctcctcactcactgcgcgacggtcctgggcccaggtctgtgctgactcacgccacctcagcgtcgcgggacccggnagaggtcaccatctcgttgtcnggagcaacctaccgaacagtacggaaagtaacttagtagttaacttcgtaggtactacgagtacgaacctaccgaaggtaactaccggaaccccctaaagtcctacaacgtaccgaaggaacgtaaataacncgtacggccgacctcggaacgggtccctagaccgtatcctcgtcgctacagttcgacgaccactcgacgtccctacctagacctactcgtacgtcggcctccggtcgaagcgtcgcgtntacacttacgtctcgtcgacacgtaccgaacggcgaacgtaacgnggtacggatacgacgtagtacgnggtacggtcgggtagtcggtcggacggaacggtaccaacggtcgacccgtagtcgtacg

SEQ ID NO: 25236 - DNA, 597 bp, Homo sapiens
  misc_feature: GYAE6OF02IGSXB.21.22.B11.1.454.CMB.1.raw
  modified_base (212)..(212): a, c, t, g, unknown or other
  misc_feature (212)..(212): n is a, c, g, or t
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (454)..(454): a, c, t, g, unknown or other
  misc_feature (454)..(454): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnaggagggtcaccatctcttgttctggaggcaactccaacatcggaagttaattatgtattctggtatcagcaacctcccaggactcggacccccaaactcctacatccagagaataancagccggccctcgcgggtcccngaccgtnttcnctgctcagtcngcactcncgcctcctgaccatcgaggtcgggcctcccgggtaccgaggtactggacggtctacgtaacttagtttaccgnggttacgacctaacgttccgaaccgggggaccaccgaaacgtaggtacgggatacgaactagtcggtaggtacgggttcgggttgggtcgttaccgggacggtacgggaacctaacggtcggaacccgttccgtaggtacccg

SEQ ID NO: 25237 - DNA, 851 bp, Homo sapiens
  misc_feature: GYAE6OF02JJJRP.21.22.B11.1.454.CMB.1.raw
  modified_base (122)..(122): a, c, t, g, unknown or other
  misc_feature (122)..(122): n is a, c, g, or t
tcagtcgtcgctcgcacgaccggtgctcgatttagacgacagctcagggggggggaagctcagcttcagctgtggtagagaagacaggactcaggacaatctccagcatggccggcttcccnctcctcctcaccctctcactcactgcgcgtagggtcctgggcccagtctgtgctagactcacgccacctcagccgtcgtacggggacccccggaagtacgggtcaccattcctgttgtcctagggacgacaactaccaatagtacggaataaagttatggtatttaccgtaggttactacaacgtacaaaccttacccggaaggtaactacccggaccccctaaaaacgtcccttacaacttaccgaaggaaaggttaaactaaactccgaacggccggggtaccccttacgggtaaccgggggttacccacggtaaaccgttcttaccttccggttaacgggacccttaacgaaccgtttacgcgtaccgaaccggtccctacggtaccccttcccgttaaccggaccctaagtaccggtaacggtaccggggtcccgttaacccgggtcccggtaacgggtaagttccgggtaacggacccgttaggttaaaacctttacgtttaaccgtaggttcgtaaccgtaaacggtttaccggaaaccggggttaaccaaccgttaaaaccgtacggttaacggggttaaacttaacgggtaaacccgttaacgttagggtaccgggtaacgggtttacggggtttaccgggtttacgggttaccgggtaacgggaaccggttaacccggaaaaccggttcggtaacccggttaaccggtcggttaacccgg

SEQ ID NO: 25238 - DNA, 668 bp, Homo sapiens
  misc_feature: GYAE6OF02G5D13.21.22.B11.1.454.CMB.1.raw
  modified_base (650)..(650): a, c, t, g, unknown or other
  misc_feature (650)..(650): n is a, c, g, or t
  modified_base (655)..(655): a, c, t, g, unknown or other
  misc_feature (655)..(655): n is a, c, g, or t
  modified_base (663)..(664): a, c, t, g, unknown or other
  misc_feature (663)..(664): n is a, c, g, or t
  modified_base (666)..(668): a, c, t, g, unknown or other
  misc_feature (666)..(668): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcgccctcgacgggtccctgaccgtattctctggcctccgaacgtctggaccacctcgacgccctccctgacccatcaggtcgggcctccggtccggagatggaggctaggtacctattacgtcgtgcctagtccgacggggacaccaagagtgggtaatcgtaacacttcgtgggaacggtcgggttgggttacggttccgggagggtaccggtaaccgaaacgttcggaacccggttcccgtacgggtacccgaacggtacccgaaacggtcccgtcccggtcccccgttaccggtccttaaccgttccgttccccggtttcccctaaccccgtttcccctcccgtttaccctcccgttaccgttaccgttcggtaccgtccgggtacttacggggacccgtaacgggccgtacgtaacgtacggtcnacgtncgcgcacnncnnn

SEQ ID NO: 25239 - DNA, 650 bp, Homo sapiens
  misc_feature: GYAE6OF02GDOVO.21.22.B11.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
tcagtcgtcgctcgcacgaccggtgctcgatttagacgacagctcaggggggggaagctcagcttcagctgtggtagagaagacaggactcaggacaatctccagcatcggccggcttccctctcctcctccaccctcctcactcactgcgcagggtcctgggcccagtctgtcgctgactcacgccaccctcagcgtctcgggaccccggnagaggtcaccatctcttgtctggagcaacctcaacngtcgagtattntgtatctgtatcagcaactccgagatcggaccccaatccnactccagagaatatcgacgcgcctcgacggtccctgacgtnttcctgtgccgtacaagtcctcggacnccctacacgtcccacccgtnacctagtcgagtcggaccgtcccggtaccggatacgtggacgtacgtcggtaaccttagtaccgttcgtaggacctagttaccggaacgggtacccgaacgttaaaccgacgtacgggtaactaccgggtaacctaacggttcccggtaagggtaccggttagggggtttccggggtaccggttttaccggggacgggttaaccggggtaaccccgtaaaacgttcccggggtaacccccgttacggtaccggtaaccccggg

SEQ ID NO: 25240 - DNA, 931 bp, Homo sapiens
  misc_feature: GYAE6OF02HYNMA.21.22.B11.1.454.CMB.1.raw
tcagtcgtcgctcgcacgaccggtgctcgatttagacgacagctcagggggggggaagctcagcttcagctgtggtagagaagacaggactcaggacaatcctccagcatggccggcttccctctcctcctcaccctcctcactccactcgcgacgacgggtccgtcgggacctgtctgtgactcgactcacgcccacctcacggcgtccgtacggggacccccgcgtaggacggtccaccgattctcttcgttcgtgggacgacctaacgtcccaaaagtcgtacggtaaaggttacttaagttacgttattacgtacggttactacgaacgtacctaaccgtaccgaagaacgttcccggaacccctaaccgtcctacgaccgtacgaacggtaacgaaaacttacacgtaacggcccggtaccctacgggtaccggtaccgtaccggaccgtacttccgtacgtacgtctaaaccggtcgtacgttacgaccgtaccgtacccgttccgaccgtttacccacgtaacccgttacgtaaccgtaggggttacccgggtaccgggttacccgggaaaccggttcgggtaaaccggttaccgggtacgggttaacccgttaccggggtttaacccttttaacgggtaccgttttaaccggacgggtttaaacccggttaaccgggttaaacgggaccccggggttaacgaaaacccggtaaccgtttaacggggtaaacggttaaccgttaacggaacccggtttaaacgggttccgggttaacggtttaaccgggtttacgggggtttacgggtttaccggggggttaccgggggtaaacccgggttttaacccggaaaacccgggtttacccgggttaaaccccgggttaacccggttaccccggggtttaaaccgggtaacccccggg

SEQ ID NO: 25241 - DNA, 769 bp, Homo sapiens
  misc_feature: GYAE6OF02GT7SB.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggaccccgggcaggagggtcaccatctcttgttctggacgcaactaccaacatacggaagtaacttagtgttattcgttggttatacagcctaaacctcccgaagggaactccgggaccccccaaaacgttccctacactaccgaacggaaggtaaattaacgtcgacggcccgggtaccctcggtaccgggggtccctacggacccgtactttcctcgtacggctaccgtaagttccgtggaccctacctcgaccgcccttcccgcgaaccctatcgtacgggtccgggtcccgttacccggggtaccggacgggtacgttacgggacgtaccttacgggtaacctttaacgttacgttcggccgtaacgtaccgttacccggggaaccgggtaccgaacgttaaacgacggggttacgggtaacgtacgggtaaacctacgttccggttaaggggtaaccgggttcgggggtttacggggttacgggtacgggggaaacccgggtaccgggtaaaccgttaaacccgggttcggtaaccccgggttaccgtacggggtaaccccgg

SEQ ID NO: 25242 - DNA, 682 bp, Homo sapiens
  misc_feature: GYAE6OF02ILLIO.21.22.B11.1.454.CMB.1.raw
  modified_base (613)..(613): a, c, t, g, unknown or other
  misc_feature (613)..(613): n is a, c, g, or t
  modified_base (629)..(629): a, c, t, g, unknown or other
  misc_feature (629)..(629): n is a, c, g, or t
  modified_base (667)..(667): a, c, t, g, unknown or other
  misc_feature (667)..(667): n is a, c, g, or t
  modified_base (673)..(673): a, c, t, g, unknown or other
  misc_feature (673)..(673): n is a, c, g, or t
tcagtcgtcgctcgcacgaccggtgctcgatttagacgacagctcagggtcctgggcccagtctgtgctgactcagccaccctcagcgtctgggaccccggcagagggtcaccatctcttgtctggaggcaactccaacatcggaagtaattatgtattctggtatcagcaactcccaggaatcggcccccaaacgtcctccatccgagaggaataactcagcggccctgacggggtccctggaccgtattctacgtgggtcctaccgaaagttctcggtacctaccgttcgaaccgtccctaccgtacgaaccgtactaccgtaacggtcgggtacccgtcccgggtaccggaaggtacgtaggaacggtctacgaaccttagttaccgtgtaccgtactacggtacggaaccgggtaccgacaaacgtacggtacgggtaacctaggaacctaacgttcggagtaacgggttcgggtttacggggtacggtttaccgggacgggtaacggaacccgtaaacgtcggtacccgtcgtacggacgaccgtaccgaacgtcgtcccgtcccgtacgtcaacttccgtactcccgcccttcgtacctcgttaccncctgacgtcgccggtncggacgtacgccgatacgtcgctagcgttacgagctanacgtcntccgatccg

SEQ ID NO: 25243 - DNA, 695 bp, Homo sapiens
  misc_feature: GYAE6OF02H6QPN.21.22.B11.1.454.CMB.1.raw
  modified_base (217)..(217): a, c, t, g, unknown or other
  misc_feature (217)..(217): n is a, c, g, or t
  modified_base (294)..(294): a, c, t, g, unknown or other
  misc_feature (294)..(294): n is a, c, g, or t
  modified_base (563)..(563): a, c, t, g, unknown or other
  misc_feature (563)..(563): n is a, c, g, or t
  modified_base (607)..(607): a, c, t, g, unknown or other
  misc_feature (607)..(607): n is a, c, g, or t
  modified_base (610)..(610): a, c, t, g, unknown or other
  misc_feature (610)..(610): n is a, c, g, or t
  modified_base (619)..(619): a, c, t, g, unknown or other
  misc_feature (619)..(619): n is a, c, g, or t
  modified_base (674)..(674): a, c, t, g, unknown or other
  misc_feature (674)..(674): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcgagggtcctcgggcccagtctgtgctgactcacgcccacctcagcgtcgtccggggacccccggnaggacgggtcacctatcttctgttcaggacgacaactccaacgacgtacggaattattatgtacttgtaggtactanacgtctaacgtacccgaaggaacgtcccgaacccctaaacgtcctaagtactaccggaagtaaacggtaatacgtcgaccgggtcccgtacccgtacggtaccgggggtaccctcggtaaacccgttagtttcccgttacggtacggtaccctacccggtaacggttaccgtccgggaccctaacccttaggaccccgttacccttccgtaccgaaccctaacgttcggacgggttcccgtaccggtcccgggacgtaggtagtcgggngtacctagtacgtttagtcgcgtacgcaagtccggaagcctaanagngtgacgtanactagtggtacggcggttcgggttgtccgggtacggaacggtacaacttaccggnggttaccctcgggataacccg

SEQ ID NO: 25244 - DNA, 864 bp, Homo sapiens
  misc_feature: GYAE6OF02JIQK3.21.22.B11.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagacgacagctcagggggggggaagctcagcttcagctgtggtagagaagacaggactcaggacaatctccagcatggccgcttccctctcctctcacctcctcactcactgcgcaggtccgtggcccagtctgtgctgactcagcccaccctcagcgtccgtcggggacccccggcaggacgggtccacctactcgttctttagttccgngggacggccaacctaccaacagtccggaagttaattacgttagttacttcgtaggttaactccgagacctaaacctcccgtaaagggtaactacccgggtacccccccaaaccttcccgtaccacgttacccgaaggaacgggtaaattactaacgccgggtacccggtccccgttaccggtacccgggggttacccctgggtaaaccccgttacgtttccgttaccgttcggtacctaacccgtaaacgttcccgttccgaccctaacccgtcctaaccggttcccccgttaccccgttaccgtaacccgtaaacgtcccgtaaccggggttccggggtacccgtttaccccgggtaccgggtaacggtcggtacgggtcgggtaccgttcggttaaccgtttaagttaccgttgttaccggtacctaccggtaccggaaccgggtaaccggtaaccgaaaccggttacggttacgggtaacgtaccgtaaaccgtacgtttaccggtacgggttcgggttaccgggtttagggggttacccgggttacggggtaaccggggtaccgggaaccggttaaccgtacgggtaacccccgggttagtacccggttaacccgg

SEQ ID NO: 25245 - DNA, 648 bp, Homo sapiens
  misc_feature: GYAE6OF02G4PTP.21.22.B11.1.454.CMB.1.raw
  modified_base (389)..(389): a, c, t, g, unknown or other
  misc_feature (389)..(389): n is a, c, g, or t
  modified_base (511)..(511): a, c, t, g, unknown or other
  misc_feature (511)..(511): n is a, c, g, or t
  modified_base (632)..(632): a, c, t, g, unknown or other
  misc_feature (632)..(632): n is a, c, g, or t
  modified_base (637)..(637): a, c, t, g, unknown or other
  misc_feature (637)..(637): n is a, c, g, or t
  modified_base (642)..(644): a, c, t, g, unknown or other
  misc_feature (642)..(644): n is a, c, g, or t
  modified_base (646)..(648): a, c, t, g, unknown or other
  misc_feature (646)..(648): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaacctcccaggaatcggacccccaaactcctcatccgagaggaataatcagccgccctcgacggggtaccctgacccgtattctcgtggctaccgaaagttcctggacctacctcacgtcccttccccgtcgaacctactcgaggttcggggcctcccgggtcgaggatgaaggctagactattactgtcgcgatcggaacggacgaccaagtagngggtactacgaacgtaactcgtaggacggttcggggtggttacgggttcgggaacggaaccggggaaacctaaaccggtagtaccggtaccgtacggtacgacgacccgaaaggccgtaccnccccggttcgtcgtaacttcctcgttccttccgcccttacccgtcctttccggtaccttaccgtacgtacgtacgggtccggaccgttcggaaccggtacggacggacctaaacggtgacncgtcngcgcnnncnnn

SEQ ID NO: 25246 - DNA, 785 bp, Homo sapiens
  misc_feature: GYAE6OF02IMY6G.21.22.B11.1.454.CMB.1.raw
  modified_base (190)..(190): a, c, t, g, unknown or other
  misc_feature (190)..(190): n is a, c, g, or t
  modified_base (219)..(219): a, c, t, g, unknown or other
  misc_feature (219)..(219): n is a, c, g, or t
  modified_base (633)..(633): a, c, t, g, unknown or other
  misc_feature (633)..(633): n is a, c, g, or t
tcagtcgtcgctcgcacgaccggtgctcgatttagacgacagctcagggggggggaaggcgtcagcttcagctgtggtagagaagacaggactcaggacaatctccagcatggccggcttccctctcctctcaccctcctcactcactgcgcagggtcctcgggcccagtctcgtgctgacctcacgccnccctcagcgtcgtacggggacccccgggnagcgggtcaccgtagtcttcgttggtctgggaacggctaacctaccaaacgtatacgggaaattaaattgtagttaatttcgtcggtaatcgaagtacaacccttacccgaagggaaccttacccggaccccctaaaaacttcctactacctaaccggtaaggaaacgggttaaaataacgttacgtaacggccccggggtaacctaccggggttacggggtacccctttaacggaaaccggtttacttaccgttccggttaacgggcccctttaacggaaaccggtttcgaaccgggttccaacccgttacgccctacccttccggaccttaaccgaacgttcgtaacgggtcggggtaccctccgggttaccggaacggtgtaggaaccggtcgtactagtaacgtttacgngtaccgtaagtccctagggtacggggactaacgaaagtttcgacggattaacgaactacgttaacggtgttaaccggggtggtttacgggtacggtaccgggtaggaaccgtacccgtaaaggttccgaaccggtttaccgtggtaacccgg

SEQ ID NO: 25247 - DNA, 665 bp, Homo sapiens
  misc_feature: GYAE6OF02JQVY6.21.22.B11.1.454.CMB.1.raw
  modified_base (215)..(215): a, c, t, g, unknown or other
  misc_feature (215)..(215): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
  modified_base (538)..(538): a, c, t, g, unknown or other
  misc_feature (538)..(538): n is a, c, g, or t
tcagtcgtcgctcgcacgaccggtgctcgatttagacgacagctcagggggggggaaggcgtcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccgggnacggagggtccaccagtcctcttggttctgggagctaactccaacatcggaataatatgtattctggtatcagcaactccaggactcgaccccaactccncatccagngaatatcacgcggtaccctcgacggggtccctaggaccgtatttcctacgtggtcctccgtaaacgtcgtcggccacccgttcaacggtccctccctacgaccacgtcgtaggtcgggccttcccgggtcgaaggtctacggtacgcgttacgaccgttatttacgcggtttacgactacgttacccggaccggggtaaccgtacaaacgggttnttacggggaacttcggaaaacttcgtacgtagggtaacggttcggggttttacggggttccggttaacggggtcgggaaaccgggtacctaaacggttccggtaacccggttcccggtaggtacccg

SEQ ID NO: 25248 - DNA, 876 bp, Homo sapiens
  misc_feature: GYAE6OF02G349E.21.22.B11.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagacgacagctcagggggggggaagctcagcttcagctgtggtagagaagacaggactcaggacaatctcagcatggccggcttccctctcctcctcaccctcctcactcactgcgcgagggtcctgggcccagtctgtgctgactcacgcccaccctcaggcgtccgtcggggaccccccggnacggacgggtccaacctattccttcgtttgttccgtgggacggacctaacgtacccaacacgtacggtaagtaattagtagttactttcgtaggtaatacgacgtacctaaccgtacccgaagtaacgtcccggaccccctaaaccgttcctaccaacgtaccgtaacgggaaaggtaaactaacgtaccgtacgggtacccccggtaccccgttaccgggtaacccggggttccccgttaacgggtaaccccgttactttcccggtttcggtaccggttacccgttaacccggtaaacggtttcccgggttacccgggtacccctaacccggtccgtaacccgttccccgttccccgttaacccgaaacccttacgttacccggtacgggggttcccggggtaccgtacccggggtaccgaaagggtccgtacgggtaacggtacttacggttaacctttgtttaacgcggtactccgtaacgtacccgggtacgggaaccgtaccgtaacgtcggtaacgggtacgtaacgtaccgtaacgttcggtaacgggtgggtttacggggtttacggggtcggttaacccgggggtacgggtaaacccggaaccggttaaaccgtccggggttaccccgtttaccgggtacggtaacccgg

SEQ ID NO: 25249 - DNA, 649 bp, Homo sapiens
  misc_feature: GYAE6OF02GIAWN.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnaggacgggtcaccatctcttgttctggagcaactccaacatacggaagtaattatgttattcgtggtatcagcctaacctcccgaaggtaactccggacccccaaactccctacactccgaaggaggtaaataacgtcgacgtccggccctcgacggggttccctagaccgtattctcgtggacctcgaagtctcggcctacctcgacgtccctcccgtacgacctacgtacggtacggtcggggtccctacccggggtaccgagggtacttacgggacggtccttacgtaactttacgttaccgtggtaccgactaacggtcccgaacgggggtacacgtaaacgtggtacggatacgaactagtcgtacgggcgggttacggggttggtacggtacgggaggtaccggaactaacgtcggaccgttcgagtaccg

SEQ ID NO: 25250 - DNA, 769 bp, Homo sapiens
  misc_feature: GYAE6OF02HV34B.21.22.B11.1.454.CMB.1.raw
  modified_base (211)..(211): a, c, t, g, unknown or other
  misc_feature (211)..(211): n is a, c, g, or t
  modified_base (270)..(270): a, c, t, g, unknown or other
  misc_feature (270)..(270): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctgggcccagtctgtgctgactcagccacctccagcgtctcggggaccccggnagagggtcaccatctcttgtctggaggcactccaacatacggaatattatgttacttcnggtatcgagactaactacccgaggtaaactccggaacccccaaaacttccgtacctacgtacccaaggaacggtaaataaacgtccacggtcccgtccctaccggtacggggtaccctcgaaccgtacttcgttcgtacggcctccgtaacgttaccgttcggacccgtaacccgtcaacccggtccccgtacccgttaccggaacttacggtaccgttaacgggtcggggtacccgttcccggggaaccggtacgggtactacggggtaaaccggttcgtacggtaccttttaaaggttcgttaccgggtaagtccggtaacgtacccgggtaaccggggtaccaacccgaaagttccgggtaggtaaccgttaaccgaacgtaacgtccgttaagggacggggttttccggggtaggtttccgggggtaaccggtcccgggggtaaaggtacccggaaccggttaacccggtccggtaccggttaccgtaacccggg

SEQ ID NO: 25251 - DNA, 612 bp, Homo sapiens
  misc_feature: GYAE6OF02GX6EK.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatcttcttgttctggagcaactccaacagtcggaagttaattatgtattctggtatcagctaactccgaggaactcggaccccaactcctacactccagaggtaataactcgacgccggccctcgacggggtccctgaccgtcttcgtctcggacctccgtaagtcgtagccacctcacgtccctacctcgaccagttcgagggtcgggccttcccgggacgaggtactcgggacgtccgtagaaccttagttacgtgcgtacagttccggaaccggggtcacaacgtgtacgggtaatcgaactagtcggtgtacggggtcggtttcgggtacggttccgggaagggtaacggacccgtaaggtccggtacccggtggtaccggtacccg

SEQ ID NO: 25252 - DNA, 837 bp, Homo sapiens
  misc_feature: GYAE6OF02HY6BK.21.22.B11.1.454.CMB.1.raw
  modified_base (186)..(186): a, c, t, g, unknown or other
  misc_feature (186)..(186): n is a, c, g, or t
  modified_base (222)..(222): a, c, t, g, unknown or other
  misc_feature (222)..(222): n is a, c, g, or t
  modified_base (254)..(254): a, c, t, g, unknown or other
  misc_feature (254)..(254): n is a, c, g, or t
tcagtcgtcgctcgcacgaccggtgctcgatttagacgacagctcagggggggggaagctcagcttcagctgtggtagagaagacaggactcaggacaatctccagcagtggccggcttccctctcctcctcaccctcctcactcactgcgcgagggtcctgggcccagtctgtgctcgactcacncccaccctcagccggtcgtcccggggacccccgggnaacggagggtccaccattcttctttcggtcgnggagtaccaactcccaacacgtacgggtaaagttaattagttgttaattcgtaggttattcgacgtaccaaccgtacccgtaaggtaaaccgcccggtaaccccctaaacgttcccacctaacgtaccgacggtaaacggtaaataaccgtacggaccggtccccggtacccgttccggggaaccgggtttcccgtaccgggaccgtttcgtttacccgacgttccgtacctaccggtatttcccgtacggacctacccgtcctaccgttacccgtcccgtaccgtaccgaccgttacgaccggttccggaccggtcccggtaccggaacgggtacgtagggtaccggtacgtaccgttacgtttaccgtttacgtacgttacggtacctaacggtaacccgggtttacccgggaaccggttaaccgaacgggttacgggtacggaaacttacggtaacctacggtacttaaccggggtggggtttaccggggtttcggggtaccgggttaacgggggtccggaaacgggtaaccccggtaacgggttacccggtaaccggttacggtttacgggaaccccgg

SEQ ID NO: 25253 - DNA, 671 bp, Homo sapiens
  misc_feature: GYAE6OF02HO3V3.21.22.B11.1.454.CMB.1.raw
  modified_base (171)..(171): a, c, t, g, unknown or other
  misc_feature (171)..(171): n is a, c, g, or t
  modified_base (270)..(270): a, c, t, g, unknown or other
  misc_feature (270)..(270): n is a, c, g, or t
  modified_base (646)..(646): a, c, t, g, unknown or other
  misc_feature (646)..(646): n is a, c, g, or t
  modified_base (654)..(654): a, c, t, g, unknown or other
  misc_feature (654)..(654): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (669)..(669): a, c, t, g, unknown or other
  misc_feature (669)..(669): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcngcaactccaggaatcggccccaaactcctcatccagagaataatcagcggccctgcgggtccctgacccgattctcgtgcctccaagtctggcaccctnagcccctcctagaccatcacggtcggcctcccggtcggaggtactggacgtctacgtaacttatttaccgtgtcgacgacgtcggaaccgggacgcgtaaacgagttcgggatgaaacctatcgtggacggttcggggttagggtcgttaccggggacggtaagggaaacccgtaacgtccggtaaccggttaccgtaacgggtccgaccggtacccgtaacggtcccgtaccgtccccggttacgtcgtaaccgtttccgtccgttcccccgacccgttcccttacccggttccgtaccgtttaccctaaccggtcgggtaccgtacccggggtcttaacccggcgtaaccgggcccgtaataaccgggtcgtancgtctacncgcgcgcgcncnctncg

SEQ ID NO: 25254 - DNA, 599 bp, Homo sapiens
  misc_feature: GYAE6OF02FQ1DI.21.22.B11.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtcctgtgctgactcagccaccctcagcgtctgggacccccgggcagagggtcaccatctcttgttctggacggcaactccaacatacggaataatatgtattctgtatcagcaactccgagaatcggaccccaaatccanactccagaacggaataatcagcggccctcgacggggtcctacgaccgtattctcgtacggcctaccaagtcctacgggcctaccgtcacgccctccctagaccactcgagtcggcgtaccggccgaggatcggagtctagacttaattcgtgtcgacactcggtaacgggacacgtaacgagtagggaacttagacaacgttcgtaaggtcgggtagggtttacgggtcgggttaccggaggggtaacgggaccctaaaacggttcggacccgttaccggtaggtacccgg

SEQ ID NO: 25255 - DNA, 680 bp, Homo sapiens
  misc_feature: GYAE6OF02IN96K.21.22.B11.1.454.CMB.1.raw
  modified_base (659)..(659): a, c, t, g, unknown or other
  misc_feature (659)..(659): n is a, c, g, or t
  modified_base (665)..(665): a, c, t, g, unknown or other
  misc_feature (665)..(665): n is a, c, g, or t
  modified_base (673)..(673): a, c, t, g, unknown or other
  misc_feature (673)..(673): n is a, c, g, or t
  modified_base (679)..(679): a, c, t, g, unknown or other
  misc_feature (679)..(679): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggccccaaactcctcatccagaggaataatcagccgccctcgacggggtccctgaccgattcctcgtggctccaagtctggccacctcgacgccctccctgacccatcaggtcggccttccgggtccgaggatggacggtctggaaccttattacgtggtacgctagttccgaacgggaccgactaaacgtaggtagggtatacggaactaatccgtaggtacggttcggggtttgggttacggttccggggacgggtaacgggaaccctaaaccggtcggtaacccggtaccgtacgggtccgaaccggtacccgaacggtccgtacccggcccccgtttcgggtacccttacccgttccgttacccgttcccccgtcccgttccccgttcccgttacccggttcctccgttaacgtcggacgggtcccggtcgtacgggaccgtacggccgacgtacgtacggtcacgtcgngacgtnacgtacgntcgctnc

SEQ ID NO: 25256 - DNA, 711 bp, Homo sapiens
  misc_feature: GYAE6OF02GE7AW.21.22.B11.1.454.CMB.1.raw
  modified_base (151)..(151): a, c, t, g, unknown or other
  misc_feature (151)..(151): n is a, c, g, or t
  modified_base (216)..(216): a, c, t, g, unknown or other
  misc_feature (216)..(216): n is a, c, g, or t
  modified_base (381)..(381): a, c, t, g, unknown or other
  misc_feature (381)..(381): n is a, c, g, or t
  modified_base (431)..(431): a, c, t, g, unknown or other
  misc_feature (431)..(431): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgcncagggtcctgggcccagtctgtcgctgactcagcccacctcacgcgtcgtccgggacccccgggnaggacgggtccaccgattctcttgttcgtggacgacaaccgccaaactacgtacggtaaagttaattagtagttaacttctaggttactgaacgacctaacctaccgaaggaacgtaccggaccccctaaaacttcctacactaccgaaggaacgtaactaaacnccgacgaccggcccgtacggaccgggttaccctacggacctattccgtcncggactcgaacgttccgtacgctaccgtactacgtccctaccgcgtaaccacgtcggacggttacgggtccgtacccggtcgggaacggttatacgggagttaccgtagtaacgttacttacgtgttacaagtacgtaccggaacggtacgaacctaagcggtacgggaactaggttaaccagttccggaaggttcggggttaggggtttaccgggtcgggtacgggacgggaaccggtaaacgtacccggtaacgtccccggtacgacggtaaacccgg

SEQ ID NO: 25257 - DNA, 746 bp, Homo sapiens
  misc_feature: GYAE6OF02GW0RR.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgaggtcctgggcccagtctgtgctgactcacgccacctcagcgtcgtcgggaccccggnagacgggtcacatctcttgttctggacgcaactcaacacgtacggaagtaattatgtattcgtagtactcgacgacaacctccgaaggtaacgtccggaaccccctaaacttccctactacgtaccaaggtaagaactaacgtcgacggcccgtacccgtacggaaccggggttccctaacgggtaaccttagtttccctcggtaccggtacccttaacggtaacggttaccgtcggtaccctaccggtaccaaccgtccccgttacccgacggtaacccctagttcccggaacgggttccgggtaccgtcccgggttaccggaacgggttactacggggacgtaccgtacgtaaccgttattaccgtgtacgactacgtaccgtacgggaccactaacgggtagttacggaactcgaaccgttacgtacggtaggtaaccggggtttggtttacggggtaccgttacgggggaaccggtaacggtaacccgttaacgggtacccggttaaccccgttacggtaacccgggtaccg

SEQ ID NO: 25258 - DNA, 875 bp, Homo sapiens
  misc_feature: GYAE6OF02GG6UA.21.22.B11.1.454.CMB.1.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctnagcgtcgtccggggacccccgggnaggacgggtccaccgtatccttcgttcgttcgttgggacggccaaaccgttcccaaacgtacgtaccgggtaaaagttaaacttttattaggttacttttaccgttagggttaacttcgaacggacctaaaacccttccccggtaaagggaaaccttcccgggaacccccctaaaaccgttcccttaccaacttacccgaaaggaaccggtaaaattaacgtaccgaacggtcccggaccctacggtaaccgggggttcccctaggtaaccgttacttaccgtccggttggccctaactacggtcctcggacctacccttcgctaccccgttcgacgtaacccgtatccgtagggttccgggcccgttaacccgggttcggaaaggggtacttaccgggacgggtctaaaccggttaccttaacttttccgggtgtaccggttacaaaccgggttccgggtaacccgggtaaccaaccggttaaacgttaaggtaccggggtacttaaacgggtaccttaacgttccggtacgggtacccggggtttacgggggtttacgggttaccgggtttaccccggggggaagggttaaaccccgggaacctttaaaaccgggggtccccgtaaccgggttttacccgggaaccgggttacccggg

SEQ ID NO: 25259 - DNA, 586 bp, Homo sapiens
  misc_feature: GYAE6OF02H112A.21.22.B11.1.454.CMB.1.raw
  modified_base (211)..(211): a, c, t, g, unknown or other
  misc_feature (211)..(211): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (457)..(457): a, c, t, g, unknown or other
  misc_feature (457)..(457): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctctcaccctcctcactcactgcgcagggtcctgggcccagtctgtgctgactcagcccaccctcagcgtctcggggacccccggnagagggtcaccatctcttgttcnggagcaactccaanatcggaagtattatgtattctggtatcagctaactcccagaactcggaccccaaactcctcactccagaggaataatcacgtcgcctacgacggggtccctgaccgtattctcgtggctaccaagtcgtcgccacctcgacgtcccgtccctcgacctactcgcggtcgggccttcccgggtcgagggatggaggtctgacttatacgngtgacacgtacgtacgggacgacaactggtcgggtaatcggaactagtcgtaggtacggtcgggtttgggtacggttccgggaggtaacgggtacccaaaggtccggtaacccggtcgtacggtacccg

SEQ ID NO: 25260 - DNA, 678 bp, Homo sapiens
  misc_feature: GYAE6OF02HX1ZH.21.22.B11.1.454.CMB.1.raw
  modified_base (209)..(209): a, c, t, g, unknown or other
  misc_feature (209)..(209): n is a, c, g, or t
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
  modified_base (472)..(472): a, c, t, g, unknown or other
  misc_feature (472)..(472): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtcgcgggaccccgggnaggagggtcaccatctcttgtctggagcaactccaacgatcggaagtattatgtattctggtatcagcaactccgaggatcgcccctaaactcacatcgagagaatatcacgcgccctgacgggtcccngaccattctcgtacggcctacgaagttcncggacctaccctcaccgtccctccgtacgtacccattcaccggttgggccctacccgggttcgaagggtattcggcgggtacctagggtaaccttacgtttaacnccgggttagccccttaagtcccgggaaaccgggttacccgaacccgaaacgtcgggttaggggaaacttacggaaacctaagttccggtttcgggaaacggtttccgggggtttaggggtccggggttttaccgggacggggttaacgggggaaccctaaaaggttcccgggtaaaccccggtttcccggtaacggggttaacccg

SEQ ID NO: 25261 - DNA, 678 bp, Homo sapiens
  misc_feature: GYAE6OF02HIF9P.21.22.B11.1.454.CMB.1.raw
  modified_base (212)..(212): a, c, t, g, unknown or other
  misc_feature (212)..(212): n is a, c, g, or t
  modified_base (489)..(489): a, c, t, g, unknown or other
  misc_feature (489)..(489): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccccggnaggacgggtcaccatcttcgttgttcgtgggaggtaccaaccttccaaacagtacggaaagttaattagtgttattcgtaggtatcagaccaactcccgaaggaactccggacccccaaacttccctacactaccgaggaagaaataactcgacgccgccctcggacggggtccctacgaccgtacttcctcgtcgcctacctaagtcgtcggcctacctcgacgccctaccctagaccctatccgagggtcgggaccgttcccgggtaccgaggtntgggacggtctaggtaactttacgttaccgtgttcgacgtactaccgggaaccggaccgacgtaaactagggtaggaactacgtaactacgttcggtagtacgggggttccgggttttacggggacggttacggggacgggttaaccggaaccgttaaccggacggtacccgttacggtacggtacccg

SEQ ID NO: 25262 - DNA, 655 bp, Homo sapiens
  misc_feature: GYAE6OF02GTD0L.21.22.B11.1.454.CMB.1.raw
  modified_base (212)..(212): a, c, t, g, unknown or other
  misc_feature (212)..(212): n is a, c, g, or t
  modified_base (312)..(312): a, c, t, g, unknown or other
  misc_feature (312)..(312): n is a, c, g, or t
  modified_base (528)..(528): a, c, t, g, unknown or other
  misc_feature (528)..(528): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggacccccggnagagggtcaccatctcttgtctggaggcaactccaacagtcggaagtaattatgtattcgtagtatcagcaacctcccaggaatcggacccctaactccncataccagagtaataactcgacgccgtcctcgacgggtccctgaccgtacttctcgtgtcctacgtaagtccgtagcctaaccgtcgaccgtccctccctacgaaccctcgtaccgaggttcggggccttcccggggtaccgaagggtaccgtagggacggtctaacggttaccttaagtttcccgtagtcgtacacgttaccggacggtaaccgntaaaccgtgaggtatacgtaactacgtcgtacggtgggtccgggtttacggggtaccggttacggggaaccgggtaaccggtaacccgtaaccggtcccgggtaaccgttccggtaacggtacccgg

SEQ ID NO: 25263 - DNA, 826 bp, Homo sapiens
  misc_feature: GYAE6OF02HR3N8.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctcgggcccagtctgtgctgactcagcccacctcagccgtcgtcgggacccccggnacggaggtccaccatctcttgttcgtggacgccaactccaacagtacggtaaagttaattacgtgttacttcgtaggttactcgacgacctaacccgttacccgaagggtaacgtcccggtaaccccccctaaaacgttcccttaccgtaacctaccgtaaagggtaaacggtaaaaccttaacgtcgaaccgggtccccgtacccggtaccggtaaccgggggttccctaacgggtacccgtactttcggtccgtacggtacctaaccggtacgtcgtaccggacccttacccgtccgacccgttcccgttacccgtactaaccgtacttaccgggacgggttccggtacccggtttcccggacggaaggttcggtaacggtacggttcctaaacggttactttaaacggttccgttaggacctacggtaaaccgttcccggaaaccggggtacctaacgaacgttaagggtcggtaaacgtacgaacttacgggttacggtaacggtgggggtttcccggttagggggttaccgggttaccggggaagggttaaaccggtacccgttaacgggttaccgggtaacccgtaccggggttaggtacccccggg

SEQ ID NO: 25264 - DNA, 944 bp, Homo sapiens
  misc_feature: GYAE6OF02H8FNK.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggtcttccctctcctcctccaccctcctcactcactgcgcgagggtccgtcgggcccagtctgtgctcgactcacgccctacctcacggcggttccggtcccgggggacccccgggagacgggtacggggtaccaccgtacttccgttctttggttcgtaggacggtacctaaactcccaaaacgtacgtcggtaaaagttaagtttacgttaagttacgtttacgtaggtacttacgaacgacctaaccgtaccggaaaggtacccgtacccggtaacccccctaaaccgttccaaccgttacctaaccgaaacgggtaaacgtaaacgtaacgtaccggaacccggtccggtaccccggtaacgggtaccggggttaccctaaccggtacggtacgtttccgttcggttaccggtaccgttaaccggttacgttccggtaccgacccgttacccgacgtcccgtacccgttacccgttacgaacccttacgtccggttacgggccgggttaccggtcccgggttaaaccgggaggtaacggttaccgggaccggtttacggttaccgtttaaccgtttaaggtacccgtttcgggtaacgtacccggttaacggtcccggggaaaacccgggtttacgaaaccggtttaaacgggtaacgggttacgggtaaacgtaacggttaaccgtaccgggttcggttaaacggggttccggggttacgggggttttaacggggggttaccgaacccggggggttaaacggtccgggaaaaccggttccggttaaccccgggtttaacgtccccggggtaattaaccccccgggg

SEQ ID NO: 25265 - DNA, 755 bp, Homo sapiens
  misc_feature: GYAE6OF02HVJZE.21.22.B11.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcacctcactgcgcagggtcctgggcccagtctgtgctgactcagccaccctcagcgtccgtcgggaccccccgggnaggagggtcaccattctcttgttctggacggtacaacctccaacgatacggtaagtaattaatgtattactggtatcagacaacctacccaggtaactacggacccccaaacttccgtacaactacccgaaggaacggaaactaagtaccaacggtcccggacccctccggtacggggttaccctacgtacccgtaattcgtcttacggtcctctaaacgtccgtacggaccacccttacgaccgttaccctaccccgtagtaaccccaacgtaccgtacgggttcgggaccgttccccggggtacgaacgggtagttaccggaaggtaccgtacggtaacttaacggttaccttggttacgaccctaacgtacccggaaccggggaaccgaaccgtaaaaccgttacggttagggtaaacgtcgaaacgtactttaaggtacggttacggggtaccgggtttgggggttaccggtacggggtaacgggaacgggaaccgttaaaccggccggtaacccgttacggttacgtaacccgg

SEQ ID NO: 25266 - DNA, 859 bp, Homo sapiens
  misc_feature: GYAE6OF02FWYAW.21.22.B11.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctccaccctcctcactcactgcgcagggtcctgggcccagtctgtgctgactcacgccaccctnacgcgtcgtcggggacccccgggnaggacgggtcaccatctcgttgttctggaggacaacctccaacacgtacggaataattatgttattcgtaggtatcagactaacctcccgaaggtaactccggaaccccccaaacgttccctacaactaccgaaaggaggtaaactaacgtccgaacgggcccggaccctagggaccggggttcccctacggaacccgttacttcccgttccggtcgggtacccttaccgtaacgtttccgtaccgggcctaacccgttccgaaccggtcccctttaccccgacggtaacccctacggttacccggacggggttccggggcccgttttaccccggggggtaaccggtacggggtacggttacgggtaacccgggtactttaacggaaaccttttacggtttaccggtagggttccggtaaacccgtacgttacccggggaaaccggggtaccaaccggtaaaccgtcgggtttaaaccgggtataaaccgggaacttaccggttacggtaaccgggggtacggggtttcgggggggtttaaccgggttccgggtttaaccgggggacccgggggttaaacgggaaccccttaaaaccgggttccggtaaacccccggggtttccgttaaaggggaccccggg

SEQ ID NO: 25267 - DNA, 314 bp, Homo sapiens
  misc_feature: GYAE6OF02HBODQ.21.22.B11.1.454.CMB.1.raw
  modified_base (307)..(314): a, c, t, g, unknown or other
  misc_feature (307)..(314): n is a, c, g, or t
tcagtcgtcgctcgcacgaccggtgctcgatttagacgacagctcaggggtcccgtgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggtcacgcccaaggctcgccccctcggtccactctcgttccccaccctccttcctcgtctcactcgacgcgggctggccaaggcgcatgnnnnnnnn

SEQ ID NO: 25268 - DNA, 739 bp, Homo sapiens
  misc_feature: GYAE6OF02FW62G.21.22.B11.1.454.CMB.1.raw
  modified_base (213)..(213): a, c, t, g, unknown or other
  misc_feature (213)..(213): n is a, c, g, or t
  modified_base (541)..(541): a, c, t, g, unknown or other
  misc_feature (541)..(541): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcgggaccccggnagaggtcaccatctcttgtcgtggagcaacctacaacagtacggaagtaattatgtattcgtaggtactacagtactacctacccgaaggtaactccggaaccccctaactcctacactaccgaaggaacgtaaactaactccgacggtccgtacccgtacggaccggggttccctacggtaaccgtacgtttccgttccggtacggtacccgttaccgtaaacggttcgtacgggtaccctacccgtaccgaccgttcccctacccgtacgtacccgtaactccggtacgggtaccgggtcccggtacccgggaaccggttaacggngtacggtacggtaccgttaactaaccgttacgtttacgtcggtactaccgtacgaccgggtaaaccgggcaaccgtaaggtacgtagggtactacgatacgtacggagggttcgggttacgggtggggttaccggtcggggaaccggtaccggaacttaaacccggtccggtaacccgtacggtaaccggtacccggg

SEQ ID NO: 25269 - DNA, 763 bp, Homo sapiens
  misc_feature: GYAE6OF02F5GID.21.22.B11.1.454.CMB.1.raw
  modified_base (214)..(214): a, c, t, g, unknown or other
  misc_feature (214)..(214): n is a, c, g, or t
  modified_base (650)..(650): a, c, t, g, unknown or other
  misc_feature (650)..(650): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggacccccggnaggacgggtcaccagttccttcgttgttcgtgggacggcctaaacctaccaaactagtacgggtaaaagttaactttattagttaactttcgtaggttaactacgaacgacctaacccgttccccgaagggtaacgtccccggaaccccccaaaacttcccgtacctactacccgaaggtaacggtaaataactcgaacggccggtccctacgggtaccggggttccctacggtaccgtacttccgtcgtcggaccttacgaacgtctcggacctacctctaaccgtccccttaccacggacctacgtccgagggttccggccgtacccggggtacggaagtacggtggaacggttcctaacggttaactttacgttaccggtggtacgacttaaccggccgggtaacgggacctacgtaaacgtgtcgggttaanacgtaacgacttacggtagggtacgggttcggggtttcgggtacggggttaccgggacgggttaaccggaacccgttaacggtccggtaacccggttccgtaacgggtacccg

SEQ ID NO: 25270 - DNA, 741 bp, Homo sapiens
  misc_feature: GYAE6OF02JT8K3.21.22.B11.1.454.CMB.1.raw
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
  modified_base (373)..(373): a, c, t, g, unknown or other
  misc_feature (373)..(373): n is a, c, g, or t
  modified_base (711)..(711): a, c, t, g, unknown or other
  misc_feature (711)..(711): n is a, c, g, or t
  modified_base (718)..(718): a, c, t, g, unknown or other
  misc_feature (718)..(718): n is a, c, g, or t
  modified_base (732)..(732): a, c, t, g, unknown or other
  misc_feature (732)..(732): n is a, c, g, or t
  modified_base (738)..(738): a, c, t, g, unknown or other
  misc_feature (738)..(738): n is a, c, g, or t
tcagtcgtcgctcgcacgaccggtgctcgatttagacgacagctcagggtcctgggcccagtctgtgctgactcagccaccctccagcgtctgggaccccgggcagagggtcaccatctcttgttctggaggcaactccaacatcggaagtaattatgtattctggtatcagctaactcccaggaactggaccccccaaaacttccctccatcccagaaggaataaatcaagtcggccctacagggggttccctaggacccgtattctcgtggcctaccgaatctggcacctcacgcctcccngtaccatcacggttggcctccggggtaccgnggtaatcggagtcgtagtacctattacgtgtacggtacncgtacgaaccgggtacacgaacctagagggtactacgaactaacgtcgtggaacggttcgggtttaacggggtgggtttaccgggaggggtaaccggggacctaaaccgtcgggaacccggttcccgtacgggtacccgaggaccccgtaacgggacctcccgggtacccccttcggggtacccctaacgttccggtccgtttacccccgaccctttacccgtcccggttcccttaccgttcccgtttaacggtcccgggtaaagggtcccccggggtactttacccggggggacccaggggtcccgttaaccggtacggttaaccggtcttaccggntacggtntccgcttagctaanccggtnacg

SEQ ID NO: 25271 - DNA, 827 bp, Homo sapiens
  misc_feature: GYAE6OF02GKGZO.21.22.B11.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtccgtcggcccagtctgtgctgactcacgccctaccctcacgcgtccggtaccggggacccccgggnagggacggtccacctatccttacgttgttcgtgggacgtaccaacctaccgaactagtacggtaaagttaatttatagttattcgtaggtactacaacgtacctaacccggtccgtaaaggtaacccgtacccggaaaccccctaaaccttacccctactaaccgtaccgtaacggaaacggtaaaacttaaccgtaccgaccgggaccccggtacccgttaccgggaccggggttaccccgtaccggtaaccgttacttcccgtacgtccgggtacctaccgtaacgttccggtaccggacctacccgtaccgtaccgtaccccgtaccctaccgtacctaccgtacgtacggggtccggtacccggttacccggtacgggaacggtacggtacgggtaccggtacgttacggttaactttacgtacgttcgcgtactaccggtaccggaaccgggaccgtaaccgtaaacggtacgggtaggtaacgtaagaaccgttacgtacggtacggtacggggttcgggttacgggtacgggttaccgggaacgggtaaccggtaaccgtaaccggtccgggtaccgttaggtacccggtaacccgg

SEQ ID NO: 25272 - DNA, 704 bp, Homo sapiens
  misc_feature: GYAE6OF02GN9KS.21.22.B11.1.454.CMB.1.raw
  modified_base (439)..(439): a, c, t, g, unknown or other
  misc_feature (439)..(439): n is a, c, g, or t
  modified_base (500)..(500): a, c, t, g, unknown or other
  misc_feature (500)..(500): n is a, c, g, or t
  modified_base (533)..(533): a, c, t, g, unknown or other
  misc_feature (533)..(533): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctgggcccagtctgtgctgactcacgccaccctcagcgtcgtcgggacccccgggcaggacgggtccaccatctcttgttctggaggtccaacgtccaacacgtacggtaagtaattatgtattctggtatcagcaacctcccgaaggtaactccggaccccctaaactccctacactaccgagaggtaaataactccgaaggtccgtcccgtacggtaccggggtcccgtacgaaccgtacttcgttcgcggtacctaccgtacgtcgtacgccctaccncgtaccgtccctccacgacctcgtacgtacgggtcggtccgtacccgggtacggaggtacngggtccgggtacttacggtaccttacttaccgnggttcgaccgtacgttaccgggacccggtacggaaccgtacgtacggtggtatacgaaacctacgtacggttgggaacgggtttaccggggtttcggggttaaggttcccggggaacggggtaaccggtaaccgtaaccgtccgggtaacccggttccgtaacggtcccgg

SEQ ID NO: 25273 - DNA, 600 bp, Homo sapiens
  misc_feature: GYAE6OF02HCMAD.21.22.B11.1.454.CMB.1.raw
  modified_base (376)..(376): a, c, t, g, unknown or other
  misc_feature (376)..(376): n is a, c, g, or t
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
  modified_base (587)..(589): a, c, t, g, unknown or other
  misc_feature (587)..(589): n is a, c, g, or t
  modified_base (591)..(592): a, c, t, g, unknown or other
  misc_feature (591)..(592): n is a, c, g, or t
  modified_base (594)..(600): a, c, t, g, unknown or other
  misc_feature (594)..(600): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccagaatcggaccccaactcctcatccagaggaataatcagccgcctcgacgggtcctgaccgattctcgtggcctaccgaagttccgtcggacctaccgtcgaccgtcccttacccgtcgacctacgttcgagggtccggggtcctccccgggtacgacggtagtcggacggtactacgtaacttagttacgtggtnactacgtacggaccggacacaacgtagtgggaatcgaactacgtcgtggacggttcggggttaggtcggtcggacgggaacgacctaacgtcgaccgttacgtagacgactaccgagtccgtccgcccgttagtaccacttccgtcgtaccccgcccttccgtaccgttctactacgacgtggacgttcggctaggcgacgcncgtangtnnnanncnnnnnnn

SEQ ID NO: 25274 - DNA, 718 bp, Homo sapiens
  misc_feature: GYAE6OF02GK845.21.22.B11.1.454.CMB.1.raw
  modified_base (62)..(62): a, c, t, g, unknown or other
  misc_feature (62)..(62): n is a, c, g, or t
  modified_base (126)..(126): a, c, t, g, unknown or other
  misc_feature (126)..(126): n is a, c, g, or t
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (468)..(468): a, c, t, g, unknown or other
  misc_feature (468)..(468): n is a, c, g, or t
tcagtcgtcgctcgcacgaccggtgctcgatttagacgacagctcgaggggggggggggaanctcagcttcagctgtggtagagaagacaggactcaggacaatctccagcatggccggcttcccnctcctcctcacctcctcactcactgcgcgagggtcctgggcccagtctgtgctgactcagccacctnacgcgtcgtcgggaccccggnagcggtcacntcgtcttgttacgaggacgcctaactccaactagtacggaagttaattactnttacttntggtactcgagactaaaccgtccgaaggtaagtacccggtaccccctaaagtccctacactccaaggtaagaaatagtccaggtcccggccctcgggaaccgggttccacgtacgtacttccgtcgtacgcctaccgtaagtccgtacgaccctaccgtccgtacgtccctcccgtagtaacccnccggttacgaacgggttcggggccctttaccgggggtacggtaacggaggttcggacgggtaccttacgtaaccgttcgtttacgtcggtaccgacgtaaccggtaccggaaccgggtaccgattaaccggaggttacgggtaacgtacgaacgtactacgggttacggcggggtttccgggttaggggtcgttaccggggaccggtaacggtaacccggtagacccggtccgttacggtacgtacccgg

SEQ ID NO: 25275 - DNA, 702 bp, Homo sapiens
  misc_feature: GYAE6OF02IVHSU.21.22.B11.1.454.CMB.1.raw
  modified_base (153)..(153): a, c, t, g, unknown or other
  misc_feature (153)..(153): n is a, c, g, or t
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
tcagtcgtcgctcgcacgaccggtgctcgatttagacgacagctcgagggggggggaagctcagcttcagctgtggtagagaagacaggactcaggacaatctccagcatggccggcttccctctcctctcaccctcctcactcactgcgcgngggtcctggcccagtctgtgctgactcagcccacctnacgcgtcgtccgggacccccggnaaggtacgggtaccacctatcttcgttcggttctgggacgctaacnccaanagtacggtaattaattntgttattcgtagtatcgagacctaacgtaccgaaggacgtccggaaccccaacttccgtctaacgtccaaaggacgtaaataactgaccggtccgtaccctcgggaacggttcccctagggaaccttacttacctcgggtcgtaccgtaccgtaagtttcccggaacgccctaaaccgtcgtaacctccccgtaccgtacgaccctaacgtccggtaagggttcccggtcggtaccccgaggacgtaagttccggaggtccttaaggtacttacgttacgcgttagacccgtagtacccgagtacgaactcgaaaggtcggataacgaacgtgtaccgtaagtcggggttagggttcggtcggggtaaccggcgggaaacgtaccctaaacgggtccgtaacccggttacggcctaaccgg

SEQ ID NO: 25276 - DNA, 701 bp, Homo sapiens
  misc_feature: GYAE6OF02J0ZZI.21.22.B11.1.454.CMB.1.raw
  modified_base (117)..(117): a, c, t, g, unknown or other
  misc_feature (117)..(117): n is a, c, g, or t
  modified_base (526)..(526): a, c, t, g, unknown or other
  misc_feature (526)..(526): n is a, c, g, or t
  modified_base (680)..(680): a, c, t, g, unknown or other
  misc_feature (680)..(680): n is a, c, g, or t
  modified_base (690)..(690): a, c, t, g, unknown or other
  misc_feature (690)..(690): n is a, c, g, or t
  modified_base (700)..(700): a, c, t, g, unknown or other
  misc_feature (700)..(700): n is a, c, g, or t
tcagtcgtcgctcgcacgaccggtgctcgatttagacgacagctcagggtcctgggcccagtctgtgctgactcagccaccctcagcgtctgggacccccgggcagagggtcaccanctcttgttctggaggcaactccaacatcggaagtaattatgtattctggtatcagcaactcccaggaatcggcccccaaactcctcatccagaggaaataactcagcgccctcgacgggtccctgaccgtattctcgtcggctccaagtctcggccacctcgacgcctccgtgtacccattccgacggtgggtacccgttccggaccgaggacttcggacggtcgtactacttactttaccgtcggtcgtacactaccggtaaccgggtaacgccctaaagtacggtacggggtattacgggtaaaccaacgttccgtagggtagggttccggggtttagggttcgggttcgggaccggggtaaccggtaaccgtaaccgtcggtaaccccgttaccggtacggtaccncgggtaccgtaacggtccgtacccgtccccggttaccggtccgtaccttccgtcccggtacccgtcccgttacctccgtcccttaccgttcgtacccgttacggcggtcggtccgcggtaccgtacgggactaccgtaggtacgcggctacgtnacgtcgtcgntcgtcgcgtnc

SEQ ID NO: 25277 - DNA, 873 bp, Homo sapiens
  misc_feature: GYAE6OF02IVBNM.21.22.B11.1.454.CMB.1.raw
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgacgggtcctcgggcccagtctgtgctgactcacgcccaccctcacgcgtcgtcgggacccccggnacgacggtcaccnctctcttgtctggaggtacaactccaacagtacggtaagtaattagtgtattcgtaggtatacgagaccaaccgtacctaaggtacctaccggaacccccaaacttccctactactaccgaaggtaagtaaaacttaacgtacgaccgggtccccgtacccgtacggaacccggggttcctaccggtaaccgttacgtttccttaccggcggttaccctacccgtaagttccgtacggtaccctacccgtcggtaacccgtccccgtttaccctaccgggaaacccttacggtaccccgtacgggggttcccgggaccccggtttaccccgggggtaccgtaaaggggtccgttacgggtaccgttacgttacgttaaacctttacgtttacgtcgggtacgtacccgttacggtaacccgggaccggggtaaccgtaacgtaccgtaaacgggtttcgggtaactaacgttaaacccgtaggtttacccggtagggtaacccgggggtttcggggttttaccggggggtttaacccggggtaacccggggttaacgggggtaaaaccccggtaaacccggtttaaaccggtttacccccggggtaaccggggttttacccggttaacccgggtaaccccggg

SEQ ID NO: 25278 - DNA, 706 bp, Homo sapiens
  misc_feature: GYAE6OF02HH61L.21.22.B11.1.454.CMB.1.raw
  modified_base (367)..(367): a, c, t, g, unknown or other
  misc_feature (367)..(367): n is a, c, g, or t
  modified_base (684)..(684): a, c, t, g, unknown or other
  misc_feature (684)..(684): n is a, c, g, or t
  modified_base (692)..(692): a, c, t, g, unknown or other
  misc_feature (692)..(692): n is a, c, g, or t
  modified_base (698)..(698): a, c, t, g, unknown or other
  misc_feature (698)..(698): n is a, c, g, or t
  modified_base (701)..(705): a, c, t, g, unknown or other
  misc_feature (701)..(705): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcactccagagaatatcaggccggccctcgacgggtccctgaccgtattctcgtggcctaccgtaagtctggcctacctcgacgcccctccctgaccctatccgaaggtcggggcccttccggggtccggaggtactgggacggtctacgacttattacgtggtnacgactacgacggggaacctacaacgtagggtgggatacgaacgtattaccggtagacgggttcggggttgggttaggttccggggacgggaaccgggtaacccgaaacggtccgggtacccggttaccgtacgggtacctaacggcccgtaacgggtcctacccggcccccggttcggtacccgttaccgttcccgttacccgtttcccccacccccgttcccgttcccgttcccgtttcccgttaccgtaccgttacgggacccggttccgggtaccggtacggacccggtacgggaccgtacgtaacgtacggncgtagtcncgtacncgnnnnnc

SEQ ID NO: 25279 - DNA, 811 bp, Homo sapiens
  misc_feature: GYAE6OF02GFXOK.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagtcgtcgtccgggaccccgggnaggacgggtccacctattcctacttgttcgtgggacgactacctaccaactgtacggtaagttaattagtagttacttcgttagtactacgacgtacaacctccgaagtaacgtccggaccccctaactcctactactaccgaaggtagtaactaactcgtacggcccgtaccgtacggtacccggggtcccgtacgaccggttacttccgtaccggtcggtaccttacccgaacgtttccgtacgggtacccttacccgtaccgtaccggtccccttcccgtaccgtacccgtaacgttacgacgggttccgggcccgttacccggggtaccggaaggtacgtacgggtacgtaccgttacggttaaccttacgtttaacgtacggttacgtaccgtacgtaccggtaaccgggtacctaaccgaacggttacggtacgggtaactacggttaaccgtaccgtaccggttacgggtaaccggggttttcggggttaccgggggtttacggtaccccgggggtaacggggttaacccggaaacccggttaaacggtcccggggttaaaccccggttccgggttaaccggtacccggg

SEQ ID NO: 25280 - DNA, 748 bp, Homo sapiens
  misc_feature: GYAE6OF02HSCRY.21.22.B11.1.454.CMB.1.raw
  modified_base (172)..(172): a, c, t, g, unknown or other
  misc_feature (172)..(172): n is a, c, g, or t
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (426)..(426): a, c, t, g, unknown or other
  misc_feature (426)..(426): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgngctgactcacgcccaccctnacgtcgtcgtcggggacccccggnaggacgggtccaccattccttcgttagttcagggacgacaccgtaccaacgtagtacggtaaacttaattactagtacgttctggtactcgacgtacaaccgtcccgaaggtacgtacccggtaacccccaaacgttccctacacgtaccgtagaaaggtaaacttaagcgacggcccgtaccgtacggtaccggtcccgtcgaaccgtnttccgtcgtaccgtactaccgtaacgtcgtacgggacctacctacgacccgttcccctacgtaccgaaccttactaccggtaaggttccgggtaccgttacccgggtaccggtaacggtcgtacgggtacgtcgttacgttaacttaaacgttcgtacgttcgaccgtacggtacgaaccggtacggtaacaacgtaaggtacggtaactacgtaaccgtattacgggtacgtaacggggttcggttacggggtccggttaccggaacggggaaccgtaaccgaacggttcccgtaaccggtacccggttaacggtaccggg

SEQ ID NO: 25281 - DNA, 686 bp, Homo sapiens
  misc_feature: GYAE6OF02I8EPX.21.22.B11.1.454.CMB.1.raw
  modified_base (247)..(247): a, c, t, g, unknown or other
  misc_feature (247)..(247): n is a, c, g, or t
  modified_base (331)..(331): a, c, t, g, unknown or other
  misc_feature (331)..(331): n is a, c, g, or t
tcagtcgtcgctcgcacgaccggtgctcgatttagacgacagctcagggggggggaagcgtcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggagagggtcaccatctcttgtctggagccaactccaangtacggaagtaattatgtattacgtgtatcacgcaactcccgaaggaactacggaccccaactcctacactacagagtaactancacgccgcctcgacggtccctgaccgtacttcctcgtggcctaccgtaacggttcgtcgcctacctccgaactccccgtccgtaccgaacctcgtcgacggtcgggtcctccgggtacccggaagcgttaggacggtctaccggttaacttacggtttaccgtacggttacgacgttaaccggtacccgggtaaccgggacgtacccgaaaggtacggtacggggaattaccgggaaactacgttacggtaagggtaccggggttacgggtttcgggggttaccggtaggggtacccgggggtaaccggaaccgttaaccggtcgggaaccccggtttacggtaacggtacccgg

SEQ ID NO: 25282 - DNA, 902 bp, Homo sapiens
  misc_feature: GYAE6OF02JKVIK.21.22.B11.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctgggccctagtctgtgctcgactcgacgccacctcgagcgtcgtccggggaccccggnacggtacgggtccacctagttccttactttcggttccgtgggtacggacctaacctaccaaacgtacggttaccggtaaagtttaacttagttacggttaactttccggttagggttacttaccgaacggtaaccctaaacccctacccggaaacggggtaaccctcccgggaaaccccccctaaaccgtcccctaccgtaaccgtacccggaagggtaaacggtaaaacttaacgtaccgaccggtacccccggtaacccgtaccgggtacccgggggttaccctaacgggtaacccgtttacgtttaccgttacggtccggttaacccgtaccggttaaacgttccggttacccgggaaccctttaccgaccccgtaccggttcccccgtttaccccgtaaccgtacccgtaaacggttccggtaacccgggtttaccggggaccccggtttacccggggtacccgggtaacggttaaccgggttacggtaaccgggtacgtttaccggttaccgtttaaaccgtttcgtaccggtacgtaccgttacggtaccgtaccgggaacctaccgacggtacgtaggtaactacgtaacgtacgtcggtagggtcggttacgggttggtccggtaccggtacggaaccgggtaacaccggttaccgtacccggtacgtaccggtacg

SEQ ID NO: 25283 - DNA, 906 bp, Homo sapiens
  misc_feature: GYAE6OF02I6VCB.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcagggggggggaagctcagcttcagctgtggtagagaagacaggactcaggacaatctccagcatggccggcttcctctcctcctcaccctcctcactcactgcgcagggtcctcgggcccagtctgtgctgactcagccaccctcagcgtcgtcggggaccccccggnagacgggtcaccgatctcttgttctggacggcaacctccaacactacggaagttaacttagtagttattcgtaggtactacgagacgaacctacccgaaggtaacgtccgggtaacccccctaaaaccttccgtaacctacctacccgaaggaaacggtaaactaaacgttaccgacggtacccgggtccccttcgggaccgggggttaccctacggtaacccgtcgttaccttcggtacggtaccgtacccgtaaacgttccgtccggacctaccctcgtaaccgtcccttcccgtaccggaacctacgtaaccggcggttaccggggtcccgttacccggggtacccgggtaagggtaccgttacgggacgggttccgttaacggtaaccgttttaaacgttccggttacgggttaccggtaacccgttaaccgggttaccgggaaaccccgggggttaacccgtacccgtaaaaacgggttaccgggttcggggaaaaccttaccgggttaaactaaaccgggttttccgtaacgggggttaacccggggtttaaccggggggtttttcgggggggtttacgggttttaacccggggggaaccgggggtaaaaccgggggtaaaccccttaaacccgggttaacccgggttaaccccgggtttacccggggttaacccgggttacccggg

SEQ ID NO: 25284 - DNA, 711 bp, Homo sapiens
  misc_feature: GYAE6OF02G9DFR.21.22.B11.1.454.CMB.1.raw
  modified_base (103)..(103): a, c, t, g, unknown or other
  misc_feature (103)..(103): n is a, c, g, or t
  modified_base (172)..(172): a, c, t, g, unknown or other
  misc_feature (172)..(172): n is a, c, g, or t
  modified_base (235)..(235): a, c, t, g, unknown or other
  misc_feature (235)..(235): n is a, c, g, or t
  modified_base (440)..(440): a, c, t, g, unknown or other
  misc_feature (440)..(440): n is a, c, g, or t
tcagtcgtcgctcgcacgaccggtgctcgatttagacgacagctcagggggggggaaggctcagcttcagctgtggtagagaagacaggactcaggacaatcnccagcatggccggcttccctctcctcctccaccctcctcactcacgtgcgcgcgggtccgtcggacccngtcctggtcgtctagtactcgacgccccacccgtcacgtccgtccgtccggggacccccgggngtaacggagggtcacctatccttcgtttcgttcgacgggaacggtccaaacgtcctaaacgagttacggaaagttaattagtcttagtttcgtagttactcgacgacgaactccgaagtacgtcgaccccaactccgactacacgacgaagtaataacgtcaacggccgtaccgtcgacgggttcccgacgtaaccgtcgttacncggtgtaccctacgtaacgttcgcgtaccgacctccgacgtccctacccgtcgtaccacgttacgtacggtccggtaccggtccggttccgacgggtagtcggtaacggtcctagttacgtaccttgtacgtacgtactaccgtcgggaaccgtcgaaccgtaagaccgtaggacctagtaaccgtatacgtacgacggttcggttacgggtcggtaccggtacgggaaccgggtaaccacggtaaccggtccggtaccgacgttaaccgg

SEQ ID NO: 25285 - DNA, 581 bp, Homo sapiens
  misc_feature: GYAE6OF02GR5S4.21.22.B11.1.454.CMB.1.raw
  modified_base (210)..(210): a, c, t, g, unknown or other
  misc_feature (210)..(210): n is a, c, g, or t
  modified_base (366)..(366): a, c, t, g, unknown or other
  misc_feature (366)..(366): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
  modified_base (493)..(493): a, c, t, g, unknown or other
  misc_feature (493)..(493): n is a, c, g, or t
  modified_base (511)..(511): a, c, t, g, unknown or other
  misc_feature (511)..(511): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctgggacccccgggnagagggtcaccatctcttgttctggagggcaacctccgaacactcggaagtaattatgtattctaggtactcaggcaactcccaggatcggaccccaaactcctcatccagacggaataagtcagcgcctcgacgggtccctcgacgacttactcnggtcctcaagtctgggaccacctcacgccctaccctgaccntacgaggtcgggccttcccggtaccgnggactggacggcctgacctaagttcctggtcgactacgtccggaacggccggacaacgntagggatcgggacattcnggtaacgccgggttagggtcggttccggacggggtaggaaccctaaggtccgaccggttccagggttccg

SEQ ID NO: 25286 - DNA, 666 bp, Homo sapiens
  misc_feature: GYAE6OF02H2ZQ4.21.22.B11.1.454.CMB.1.raw
  modified_base (207)..(207): a, c, t, g, unknown or other
  misc_feature (207)..(207): n is a, c, g, or t
  modified_base (268)..(268): a, c, t, g, unknown or other
  misc_feature (268)..(268): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
  modified_base (454)..(454): a, c, t, g, unknown or other
  misc_feature (454)..(454): n is a, c, g, or t
tcagtcgtcgctcgcacgaccggtgctcgatttagacgacagctcagggggggaagctcagcttcagctgtggtagagaagacaggactcaggacaatctccagcatggccggcttccccctctcctcaccctcctcactcactgcgcagggtcctgggccagtctgtgctgactcagccacctcagcgtcgtcgggacccccgggnaggagggtcaccatctcttgttcgtggacgcaactccgaacatcggaagtaacttgtagtnttcgtggtatcagcaacctccaggaactccggaccccaactcctcagtcaagagaatatcgacgccggaccgtcggaacgggttccctgaccgtacttctcgtcggcctcgaacgttcgtacggcctacgtaccnccgtaccctccgtcgaacctntcgtaacggtcggtaccttccgggtaacgnggtaacgtggaacggttcgtacgtactttagtttacgtcgacgtaccgtaggtaacccggacggtacccgaggtaacctagggtacgggaaacttggaaaccttggtacgtacgtacgggggttcggttaccgggggttcgttaacggggaccgggttacgggtaaaccgtacgtacccggaccgggttttccgtaccggtagtaccccggg

SEQ ID NO: 25287 - DNA, 188 bp, Homo sapiens
  misc_feature: GYAE6OF02JH0OJ.21.22.B11.1.454.CMB.1.raw
  modified_base (163)..(188): a, c, t, g, unknown or other
  misc_feature (163)..(188): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctccctcctcaccctcctcactcactgcgcagggtccgtnnnnnnnnnnnnnnnnnnnnnnnnnn

SEQ ID NO: 25288 - DNA, 589 bp, Homo sapiens
  misc_feature: GYAE6OF02FYA34.21.22.B11.1.454.CMB.1.raw
  modified_base (210)..(210): a, c, t, g, unknown or other
  misc_feature (210)..(210): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaacctcccaaggaactcggacccccaaactcctacatccaagagaataactcaggccggccctcgacggggtccctagacccgtattcctcgtcggcctaccgagtccgtggcctaccncgacgcctcccgtnaccgtatcgaggtcggcctccgggtcgagacgtggagtctgaccttattacgtgtgactagtaccgacgggtacacgaacgacgtgggatacgactatcgtaggacggtccggggttgggttcggttaccgggacgggacggaaccgaacgttacggacccgttacgtacggtaccg

SEQ ID NO: 25289 - DNA, 771 bp, Homo sapiens
  misc_feature: GYAE6OF02FVMV8.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctctcaccctcctcactcactgcgcagggtcctgggcccagtctgtgctgactcagccacctcagcgtctcggggacccccggnagacgggtcaccatctcttgttcgtggacggcaacctccaacatacggaagtattatgtattctggtatcagcaacctccgaggaactcggaccccctaaacgtcctacactccgaagacggtaaacttaactcgaacggccggtaccctacggtaccggggtccctaggtaccgtacttccgtcgtcggtcctaccgaagtccgtacgcctaccgtccgaccgtcccgtcccgtagaccctacgtccgtagggtcccgggtccgttacccggggtccgaacgggtacgttacgggtaaccggtccgtttaacggtaacgttttaacgtttaaccggttcgggttaccgtaaccggttaccggtacccggaacccgggggtaaccctaacccggtaaccgtaggggtacgggtaacgtaccggtaacgttaccgtttcgggtaacgggttacggggttaccgggggttttacgggggttacgggtacccgggggtacggggtaacccgggtaccccgtaaacggttacccggacccgggtttacccgggacgttaaccccgg

SEQ ID NO: 25290 - DNA, 666 bp, Homo sapiens
  misc_feature: GYAE6OF02HEKNT.21.22.B11.1.454.CMB.1.raw
  modified_base (345)..(345): a, c, t, g, unknown or other
  misc_feature (345)..(345): n is a, c, g, or t
  modified_base (375)..(375): a, c, t, g, unknown or other
  misc_feature (375)..(375): n is a, c, g, or t
  modified_base (651)..(651): a, c, t, g, unknown or other
  misc_feature (651)..(651): n is a, c, g, or t
  modified_base (654)..(654): a, c, t, g, unknown or other
  misc_feature (654)..(654): n is a, c, g, or t
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
  modified_base (664)..(665): a, c, t, g, unknown or other
  misc_feature (664)..(665): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaactcggacccccaaactcctcatccagagaataatcagccgcctcgacggggtccctgaccgattctcgtggctaccaagtctggcacctcacgcctccctgacctatccgagtcgggccttccgggtaccgaggatcggaggctagacttattacgtggngcctaatccggaacgggacgtaccaaacgnggtagggactaggaactaatcgtagggacggttcggggtttaggggtcggttaccgggacgggacgggaaccctaaaggtccggtaacccgggttactacgggtaccgaacggtacccgaaggtcccgtacccggcccccggttacgtacccgtaccgttccgttcccgttccccgtacccttcccgttcccgttccgttcctacccgttactacgggacggtcccggggtaccgtcgggacgtaccgggccgtacgtaggtacgcgtgacgtcgngcncgcgcncncnnc

SEQ ID NO: 25291 - DNA, 746 bp, Homo sapiens
  misc_feature: GYAE6OF02F5MQZ.21.22.B11.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
tcagtcgtcgctcgcacgaccggtgctcgatttagacgacagctcgagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagtaggtccaccatcctnttgtctggagtcaactccaacgataccggaagtaattagtcttaattctggatcaggccaacctaccaggaactcggaccccctaactacctcaactccgaagtacggaaattaactacgaacgtccggacccttcgacggggtccctaggaaccgtattcctacgtcggaccttacgaaacgttctcgggacctacccgttacgaactccccgtcccgtagaacccggtaattccggaacgggttttgggacccctttacccggggaccgtagggaagttcggaacgttcgttacggaaccttaacgttttcgttaacggacgtaacctaacgttaccgggaaaccgggggtaacctaacccgttaaacggtacgttacgggggtattaaaccggaacttaaacggttgaaaccggggtagggttacggggttttaccgggtggttttaacccggggaacggggttaacggtacccaaaaccgtttacgggtcccggttacgttaacccggaaccgg

SEQ ID NO: 25292 - DNA, 768 bp, Homo sapiens
  misc_feature: GYAE6OF02IO7H2.21.22.B11.1.454.CMB.1.raw
  modified_base (60)..(60): a, c, t, g, unknown or other
  misc_feature (60)..(60): n is a, c, g, or t
  modified_base (220)..(220): a, c, t, g, unknown or other
  misc_feature (220)..(220): n is a, c, g, or t
  modified_base (685)..(685): a, c, t, g, unknown or other
  misc_feature (685)..(685): n is a, c, g, or t
tcagtcgtcgctcgcacgaccggtgctcgatttagacgacagctcagggggggggggaanctcagcttcagctgtggtagagaagacaggactcaggacaatctccagcatggccggcttccctctcctcctcaccctcctcactcactgcgcagggtcctgggcccagtctgtgctgactcagccaccctcgagccgttccgtcggggaccccccgggnaggacgggtcaccatctcttagttctggaggccaactccaactatacggtaagttaatttattagttactttcgtaggttactcgagacctaaacctcccgaaggtaactccgggacccccctaaaacgttccctacacctaccgaagggtaacggtaaacttaacgttaccgaacgggtaccccggtaccccgtacgggacccggggggttccccttacggggacccgttacgttccgtttccggtaccgggtcccttaacccggtaaaggttcccggttacggacccgtaccccggttacgtaacccggtccctttaccgaccgttacggaccctacgttaccggaacgggttccggggtacccgttccggggtacccggaggtagttccgggaggtacttacgtaacgttacgttactcggtcaccgtagtccggacgggtaccacgaacgtaggtacggtntacgtactaagtcggtaaggtacggttcgggttggtcggtacgggaccggtacggaacctacgggccgttaccggtcgtacgg

SEQ ID NO: 25293 - DNA, 875 bp, Homo sapiens
  misc_feature: GYAE6OF02HAJYP.21.22.B11.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctagactcacgccctacccctcagtcgtccgtacgggggacccccccgggntaagggagggtccaaccagttcctcgttgttccgtagggacgacctaacctcccaaaacgacgttaccgggtaaagttaaactttaatacggttaatttacgttaggtaactacgagaaccaaccgttacccgaaggtaactccggaaccccccaaaagttcccctacaacttaccgaagtaaacggtaaaataaagtcaacggtcccggaccccgttacgggaaccgggggttcccctaaggtaacccgtacgtttccgtccgtttacgggaccttaaccgtaaacggtcccgtcggtaccccacccgttaccaccgttcccctacccgtacgaacccgtagttaccgacgggttccgggtacccgttacccgggtacccggaaagggttactacggggaaccggtacgttaccggtaacgttttaaccgttacgtacggtccgtagtaaccggtacccgggtaacgggaccgtaacgtaaacgacgggttaacggaacgttacgtaaaccgttactaaccggttgggtaaccggggttacgggggttacgggggtttaccggggtttaaaccgggaaccgggggaaacccgtaaaccggtaaaaccggtttcccggaaaccggtttacccggtaaacgggttaccccg

SEQ ID NO: 25294 - DNA, 728 bp, Homo sapiens
  misc_feature: GYAE6OF02IF4ND.21.22.B11.1.454.CMB.1.raw
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcgtacgggtcctcgggccctaggtcctggtcgcctagactcacgcccaccctcacggtccgtcgccggggacccccgggntaaggcgggtccactacttcgtctttggttcngggacgtccaaactccaaanagtacgggaataattatgtaacttcgtagtctacgacgcctaactaccgagaacgtccgtaaccccaacttctacaactaccgaagtaaggaaactacttacgaccggccggtacccgtacgggttaaccgggtacccgtagtaaccgtacggttcttaccggtcgggtaccctaccgtaaacgttcgcggcccttaaccgcgtaacccgtcccttaaccgcccgacgttaacgaccgtacgggttcgggtcccgtaccggggtaccggtaagcggttaggtaacggcctttacgggtaacttacgttccgaggttactaccgaacggtcgaaccggggtaccaagttaacgacggtaggtacgtacgaacgttacgcgtaaggtcggttacgggtcggggtcgttacggcggacgtaacgagttaaccgccgttggtacgtacg

SEQ ID NO: 25295 - DNA, 757 bp, Homo sapiens
  misc_feature: GYAE6OF02JFGTX.21.22.B11.1.454.CMB.1.raw
  modified_base (220)..(220): a, c, t, g, unknown or other
  misc_feature (220)..(220): n is a, c, g, or t
  modified_base (572)..(572): a, c, t, g, unknown or other
  misc_feature (572)..(572): n is a, c, g, or t
tcagtcgtcgctcgcacgaccggtgctcgatttagacgacagctcaggggggggggaagctcagcttcagctgtggtagagaagacagggactcaggacaatctccagcatggccggcttccctctcctcctcaccctcctcactcactgcgcagggtcctcgggcccagtctgtcgctgactcacgcccaccctgacggcgtccgtcggggaccccggnaggacgggtcaccatctcttgttcgtggacgcaactccaactgtacggtaagttaattatgttattcgtaggtactcgacgactaacctcccgaaggaactccggaaccccctaaacttccctacgacttaccgaacggtaaacggtaaacttaacgtccgacgggtaccccggtaccctaggtaccgggggtccctacggtaccgttacgttaccgtcgttacggaccttaaccggtacgttaccgggtcggaccctaacccggtctacccggtcccctttacccgtacggaccctagtccgggacggttcgggtccgtacccgggttacgagggtacttcggaacggttntacgtaacgtttattaccggtgtcgactaccggttacgaaccggggcctaacgtacgttaagggttaccgaagtccgtaactaacgttcggtacgggttaacgggtcggggtttacgggtacggggtacgggtaaccgggacggttaacccggagttaaccggccggttaccggtacgtaaccgg

SEQ ID NO: 25296 - DNA, 607 bp, Homo sapiens
  misc_feature: GYAE6OF02G8FND.21.22.B11.1.454.CMB.1.raw
  modified_base (317)..(317): a, c, t, g, unknown or other
  misc_feature (317)..(317): n is a, c, g, or t
  modified_base (591)..(591): a, c, t, g, unknown or other
  misc_feature (591)..(591): n is a, c, g, or t
  modified_base (597)..(597): a, c, t, g, unknown or other
  misc_feature (597)..(597): n is a, c, g, or t
  modified_base (606)..(606): a, c, t, g, unknown or other
  misc_feature (606)..(606): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggccccaaactcctcactccagaggaactaaatcagccggccctcgacgggtccctgaccgattcctactggcctaccaagtctggctacctcacgcctccctgaccatcagtggcctccggtcgagganaggaggctgacttattacgtgtcgcactacgacgggacgacaagacgtggactagaactatcgtagacggtggttgggtaggtcgggacgggacggtaaccaaacgtacggaccgtaccgtaggtacaacggaccgaacggtacctccggtaccccgtcgtacctacgtaccgtaccgttaccccgtaccccttcccgttaccctccgttccttaccgtacgtcgtaacggccgggtacgtccggacgacggtaccacgtaacgcgactgcgtncgactnagctgacgnc

SEQ ID NO: 25297 - DNA, 855 bp, Homo sapiens
  misc_feature: GYAE6OF02F7528.21.22.B11.1.454.CMB.1.raw
tcagtcgtcgctcgcacgaccggtgctcgatttagacgacagctcaggggggggggaagctcagcttcagctgtggtagagaagacaggactcaggacaatctccagcatggccggcttccctctcctcctccaccctcctcactcactgcgcgagggtcctcgggcccagtctgtgctgactcacgcccaccctcacgcgtccgtaccgggggaccccccgggcgaggacgggtaccaccgattccttcttcgttcgtgggacggaccaacctaccaacagtacggtaagttaaacttagttagttattcgttaggttactacgaacgtacctaacctaccccggaaggtaaccgtaccccgggtaaccccccctaaaaccttccccgtacctaacctacccgaaagggtaaaggaaacgttaaactaccgaaccgggtcccggtaccccgtaccgggtacccggggttaccctaccgggtaacccgttacgtttccgtaccggttcggacccttaaccgtaacgttccgtaccggtaccctacccgtaccgtacccgtcccctttcccgaacccgaacctcgtacgtcgggttccgggacccgttcccggggacgtaggtagtacggacggtacttaacgtacgttagttactggtccacgtacgtaccgggtaacggacctaacaaggttacggtacgggtaactacgggtaacttacgtacggtacggggtacgggttacgggggttttaggggtacccggtaccggggggtaaccgggaaaccggggttaaccccgtaaaacgggttcccgggttaaccccggtttaccgggtaacgggttaacccccgg

SEQ ID NO: 25298 - DNA, 741 bp, Homo sapiens
  misc_feature: GYAE6OF02GT9D3.21.22.B11.1.454.CMB.1.raw
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
  modified_base (357)..(357): a, c, t, g, unknown or other
  misc_feature (357)..(357): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctnagcgtctcgggacccccgggnaggacgggtcaccatctcttgttctggaggcaactccaacatcggaataattatcgtatctgtatcagcaactcccaggatcggaccccaatccgtnactcagagaataancagccgccctgacggggtccctagaccgtattccnctcggcctcgaacgtctcggcctaccctcgaccgtccctacccgtcgaaccctagtccgtaggggttcccggtccgtacccggggtaccgacgggtacttagggaacggtccgttacggtaacttaccgttaactcggtacgtaccgtaacgttacccgggaaacggggaacccgtacgtaaaaccgtgggttaacggggaaccgttacgaaaccttacgtaccgggttacgggtcgggggtttaacccgggttttggggggttacccggtttaacccgggggacccggggggtaaaaccgggttaaacccccgggtttaaaaccgggtttcccccgggtaaaacccgggttttacccccggggttaaccgggtaacccccggg

SEQ ID NO: 25299 - DNA, 781 bp, Homo sapiens
  misc_feature: GYAE6OF02GS274.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggcagacgggtcaccatcttcttgttcgtggaggccaactccaaacagttaccgggaaagttaacttatagtacttcgtggtactacgacgctaacctccccgaaggtaactccggacccccaaaactcccgtcaacctccgtaaggaaggtaaacttaacgtacgacggaccggtccccttacggaccggggttcccctaggaaccgttacgtttacccgtcgtttaccgggccttaccgtaaacggttccgttcgggacctacccgtaccgaaccgtcccttcccgttacgaacctaccgttacgtaccgggtaccggggtccctacccgggggttaccgaagggtacgtacgggaaggtccgtaacggttacttacgtttaacgtcggtcgaacgtacgtacccggaacggggtacccgaacttaaaccgtagggtcggtaaactacgggtaactacgttaccggtagggacgggttaccggggttgggttaaccgggtacggggtaaccgggtaaggtaaccccggttaaacgtacccgggaccgtttacccgggtaacggtacccgg

SEQ ID NO: 25300 - DNA, 795 bp, Homo sapiens
  misc_feature: GYAE6OF02IUSER.21.22.B11.1.454.CMB.1.raw
  modified_base (58)..(58): a, c, t, g, unknown or other
  misc_feature (58)..(58): n is a, c, g, or t
  modified_base (150)..(150): a, c, t, g, unknown or other
  misc_feature (150)..(150): n is a, c, g, or t
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
tcagtcgtcgctcgcacgaccggtgctcgatttagacgacagctcagggggggggaanctcagcttcagctgtggtagagaagacaggactcaggacaatctccagcatggccggcttccctctcctctcacctcctcactcactgcgcngggtcctcgggcccagtctgtcgtctgactcacgccacctcgacgtcgtcgcggggacccccgganaggtaggtccaccgtntcctcgttcgttcgagggacgacctaacctaccaacgtagtaacggtaagttaaattagttagttaacttcgtaacggtagttacgaacggtacctaaaccgtaccggtaaacggtaactaccccggtaaccccttaaaaaccttcccgtactaaccgttaccggaacgtaaacgggtaaactaaacgtaccggtaacggtcccggtacccggtttaccgaaccgggggttcctaaccggggtaaccctacgttccgtacggtaccgtacgtaccggtaacgtaccgttacggtacctacccggtacgaacccgttccgtacccgttacgaacctaacgtccgtaacggtcggtcgtaccgtacggtagtactcggtacgtacgtacgttaacgtacgttacgtcgtaccgacgtaccgaacggaaccgtactaaccgaacgtaacgggtacgttacggaacgtaacgtaggtacgtacggtggttaccgggtacgttacgggttacgggaccgggtaacgaaccgttaccggtaaccggtccggttaccggtaacgtaaccg

SEQ ID NO: 25301 - DNA, 728 bp, Homo sapiens
  misc_feature: GYAE6OF02IC0C3.21.22.B11.1.454.CMB.1.raw
  modified_base (216)..(216): a, c, t, g, unknown or other
  misc_feature (216)..(216): n is a, c, g, or t
  modified_base (587)..(587): a, c, t, g, unknown or other
  misc_feature (587)..(587): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcgagggtcctcgggcccagtctgtgctcgactcacgccacctcagtcgtcgccggggaccccggnaggtacgggtccaacgtacttcttcgttcgttcgagggaggtaccaaacctccaaacgtacgttacggaaaagttaattaagtacgttaattcgtaggtataccagacaacctaccgaggaaccgtaccggtacccctaaaacttccactactaccgagaaggtaaataacgtacgacgggtccggtacccgtacggacgggtaccccgttcgaaccgtacttctacgtcggtaccaaccgttaaggccttacgggacctaccgtactacccgtacccttccgacgtacccgtatcggtaacggtcggggttaccgtacccgggtaacgcgggtaacgtacggtacggtctaagtaacgttattaccggancggtacagtccgtaacgggaccacgaaacggttgaacgttagacgtatacgtatacggacgggtttaccggggtgggttacgggtacgggaccgggaacgaaccgttaacgtaccggtaacccgttacggtaccggaccgg

SEQ ID NO: 25302 - DNA, 719 bp, Homo sapiens
  misc_feature: GYAE6OF02I6D99.21.22.B11.1.454.CMB.1.raw
  modified_base (150)..(150): a, c, t, g, unknown or other
  misc_feature (150)..(150): n is a, c, g, or t
  modified_base (210)..(210): a, c, t, g, unknown or other
  misc_feature (210)..(210): n is a, c, g, or t
  modified_base (255)..(255): a, c, t, g, unknown or other
  misc_feature (255)..(255): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctctcaccctcctcactcactgcgngaggtcctgggcccagtctgtgctgactcacgccaccctcagcgtcgtcgggaccccggngacgaggtcacctagtcctcttgtcgtggacgaccaactcaacanacggtaaagtaattagtattattctggtatcgagaccgtaacctcccgaaggtaacgttcccggaaccccccgaaacttacccgtatacctaccgaacggtaaacggtaacttaactaccggtacgccggtaccctcgggtaaccgggtccccgtaggacccgtattacccgtgtacggtcctacgtacgtaccgacggtacctacccgtacgtaccgtcccttaccggtaactaccgtacgtaccgggtagttacccggggcccgttaacccgggtaccgggtagtacggtacggttaccggacgttacggtaacctttacgtttaccggtagtcggacctagttaccgggacggtaaccggcgttaaacagggtacgagttacacgtacgttgtaccgagggtttcggtcgggtgtacgggacggagtaaccggaacgtggtccccgtaaggtccgtaccgg

SEQ ID NO: 25303 - DNA, 749 bp, Homo sapiens
  misc_feature: GYAE6OF02JDT65.21.22.B11.1.454.CMB.1.raw
  modified_base (147)..(147): a, c, t, g, unknown or other
  misc_feature (147)..(147): n is a, c, g, or t
  modified_base (248)..(248): a, c, t, g, unknown or other
  misc_feature (248)..(248): n is a, c, g, or t
  modified_base (455)..(455): a, c, t, g, unknown or other
  misc_feature (455)..(455): n is a, c, g, or t
  modified_base (639)..(639): a, c, t, g, unknown or other
  misc_feature (639)..(639): n is a, c, g, or t
tcagtcgtcgctcgcacgaccggtgctcgatttagacgacagctcgaggggggggggaagctcagcttcagctgtggtagagaagacaggactcaggacaatctccagcatggccggcttccctctcctcctcaccctcctcactcnctgcgcagggtcctgggcccagtcgtgtgcctgactcgacgcccacctcacgccgtcgtcggggacccccggaacggacgggtcaccgattcttcttgtcnggaggcaacctccaacagtacgaagttaatagttcgtattcgtaggttactgacgacctaaccaccgtaaggaacgtcccgaaccccctaaactcctaccaacgtccaaggaacgtaaatacgtcgacggcccggtacccgacgttaccggggacccttacgaccggtatttccgtacgtcggacccttagacgtcgtacggtaccnccctagcccgtccgttcccgtaccaccgaacgtacttacgggcggttacccgtcccgggtaaccggaccggaacggttcggaccggttacgtacggttaaccggtttacttttcgtacggttacgaccgttaacgaccggtaaccggggtaacctaacggtaaccgttaacggcggggtttaanacccggtaagttaacgtcggacgggttcgggttaacggggttcgggttaccggttacgggaccggtaacgtaccgtaaaccgtcgggtaaccttcgggtacgtacccggg

SEQ ID NO: 25304 - DNA, 651 bp, Homo sapiens
  misc_feature: GYAE6OF02G4J12.21.22.B11.1.454.CMB.1.raw
  modified_base (251)..(251): a, c, t, g, unknown or other
  misc_feature (251)..(251): n is a, c, g, or t
  modified_base (277)..(277): a, c, t, g, unknown or other
  misc_feature (277)..(277): n is a, c, g, or t
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggaggacgggtcaccatcttcttgttctggagcaactccaanatcggaagttaatatgtattctgtancagcaactccgagactcggacccccaatcctcactcgagagaatancgacgccggccncgacggtccagaccattctcgtcgactcgagtctcgcacctcacgtccctccgtacgtacctagtcgtacggtcggtccgtaccgggacccggaggtactggtacggtcttaacgtacttaacgtttacgtcggttacgcgttaacgtcccgggtaaacggccgtaaaccgtgtaacggttaagggtactaacgaacgtaccgttggtacgggtacgggttccggggtttgggtacccgggttaacgggaccggggtaaaccgggaaccgttaaaccggttacgggtaacccgttaccgggtaaccgtacccgggg

SEQ ID NO: 25305 - DNA, 763 bp, Homo sapiens
  misc_feature: GYAE6OF02GO394.21.22.B11.1.454.CMB.1.raw
  modified_base (121)..(121): a, c, t, g, unknown or other
  misc_feature (121)..(121): n is a, c, g, or t
  modified_base (408)..(408): a, c, t, g, unknown or other
  misc_feature (408)..(408): n is a, c, g, or t
  modified_base (643)..(643): a, c, t, g, unknown or other
  misc_feature (643)..(643): n is a, c, g, or t
tcagtcgtcgctcgcacgaccggtgctcgatttagacgacagctcagggggggggaagctcagcttcagctgtggtagagaagacaggactcaggacaatctccagcatggccgcttcccnctcctctcaccctcctcgactcactgcgcgagggtcctgggcccagtctgtgctagacctcacgccctacccgtacgagccgtcgtccggggacccccgtgagggaccggtcaccgtattccttcgttcggttacgtacgggacgacctaaacctaccgaacgtacgttaccggtaaagttaattagtacgttaacttcgttaggtactacaacggactaaccctaccgaaggtaacgtacccggtacccctaactcctactacgaccgaaggtaacgaaattaacncgtaaccggccggtaccctcgggaccggggttaccctacgggaccgttacttccgtacggttcgaccgtaaccgtacgttccgtacggtacccctaactcccgtaaccgtccccgtaacctacgaaacccgttctaaccggtgggttacccgggcccgttacccgggtaagacgttagacggacgtacgtactacgttactcggtacggacacggtaactacgggaaaccgggtnaacgttaacgcgggtaacggtactagaacgtacggttgtacggtagggttacggtacggggttccggacgggtaaccggtaacggtacctaaccgaggttacccggtatacgggtacccg

SEQ ID NO: 25306 - DNA, 753 bp, Homo sapiens
  misc_feature: GYAE6OF02JP6UD.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttcctctcctcctcacctcctcactcactgcgcagggtcctcgggcccagtctgtgctgactcacgccacctcacgcgtcgtcgggacccccggnacgacgggtcaccgactctctgttctcggaggccaacgtaccaactacgtcggtaagttaacttagtcgttatttcgtaggtactcgagtacaacgtacccgaaggtaactaccggacccctaaactcctacgactaccgaggaaggtaactagacgacgccgtacctcggtacggttccacgtaccggtattccgttcggacggcccttaccgtaaacggtttccgacggtacctaccgtccgaacccgtcccgttacccgtacggtaaccacgttaacgcgggtacccggtacgtcccgggttaacggtaaccgtaggtcggaacgttccggtaacgttaccttaaacgttccgttacgggactaccgacgttaccggaccgggaaccgtacgtaacgtagggtacggtaacgttaacgaacgtttacggacgttaacgggtaccggggtttcgggtttaaggtcccgggttaaccgggtacgggaaccggttaaccgaaccggttaacccggtaacccggtacggttaccggtaacccgg

SEQ ID NO: 25307 - DNA, 669 bp, Homo sapiens
  misc_feature: GYAE6OF02HQNPC.21.22.B11.1.454.CMB.1.raw
  modified_base (212)..(212): a, c, t, g, unknown or other
  misc_feature (212)..(212): n is a, c, g, or t
  modified_base (263)..(263): a, c, t, g, unknown or other
  misc_feature (263)..(263): n is a, c, g, or t
  modified_base (338)..(338): a, c, t, g, unknown or other
  misc_feature (338)..(338): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggacccagtctcgtgctgactcagcccacctcagcgtcgcgggacccccggngagacgggtacacctactcttacgttgttacctggacgaccacgtaccaanacgtacggaagttaatattagtattacgtaggtatacgagacaaccgtccgaaggaactccggaacccctaaacnccgtactactaccgtaaggaagtaaactaacgtcaccggacggtcccacggtacgggtccctacgaccggtacttcgtcgtacgtcaccgtaagtccgtacgcctactacaccgtaccctactaccgactacgtacgtaggtccggtaccgtccgggttaaccgaggtattacgggacgtacgttacggtaacttacgttacgtgttcgactaccgtacggacggtacggacaacggtaggtagactcgaatacgtaccgtaggacggttcgggttggtaggggttccgaaggggtaccgaacacggttaccggaccgttcgtacggtacg

SEQ ID NO: 25308 - DNA, 313 bp, Homo sapiens
  misc_feature: GYAE6OF02FV67P.21.22.B11.1.454.CMB.1.raw
  modified_base (302)..(313): a, c, t, g, unknown or other
  misc_feature (302)..(313): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcacgcccaaggcctgccccctggtcactctcgttccccacctcctcctcgtctcctactgagcgggctggcaaggcgcatgnnnnnnnnnnnn

SEQ ID NO: 25309 - DNA, 830 bp, Homo sapiens
  misc_feature: GYAE6OF02F4ASK.21.22.B11.1.454.CMB.1.raw
  modified_base (175)..(175): a, c, t, g, unknown or other
  misc_feature (175)..(175): n is a, c, g, or t
  modified_base (244)..(244): a, c, t, g, unknown or other
  misc_feature (244)..(244): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgntgactcagccaccctcagcgtcgtcgggacccccggcaggagggtcacatctcttgtcgtggagcaacnccaacatacggaataatatgtattctggtatcagacactccgaagaactcggacccccaaactcctacactaccgaaggagtaaataactccgacggacccggtccctacggtaccgggggttacccctagggtaacccgtacgtttaccgttaccgtacgggtacctttaacccgaaacggtttccgtaaccggtaccctaacccgttacccgtaaccggtcccccgtttaccccgtaagaaccccgtaaggttaccccgtaagggggttcccggggcccgtttaacccccgggggttacggaagggtacgttaacgggtacgggtaacctttacgggtaaacctttaacggttttaccgttgggttaccgaaccttaaccggttacccggggaaaacggggggttacccaaacccggtaaaggaacgtttacgggggaaacttaacgaaaccttaaggttccggaaggggtaacgggttacccggggggttttggggttaaccggttaccgggggtaaccggggaaaccgggtaacccttaaaacgggtcccggtttaacccgggttacccggtaacgggtacg

SEQ ID NO: 25310 - DNA, 720 bp, Homo sapiens
  misc_feature: GYAE6OF02HRR2G.21.22.B11.1.454.CMB.1.raw
  modified_base (699)..(699): a, c, t, g, unknown or other
  misc_feature (699)..(699): n is a, c, g, or t
  modified_base (709)..(709): a, c, t, g, unknown or other
  misc_feature (709)..(709): n is a, c, g, or t
  modified_base (713)..(713): a, c, t, g, unknown or other
  misc_feature (713)..(713): n is a, c, g, or t
  modified_base (718)..(718): a, c, t, g, unknown or other
  misc_feature (718)..(718): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcactccagaggaataatcagcggccctcgacgggtccctgaccgattctcgtggcctccaagtctcggcacctcgacgtccctccctgaccatcgaggtcggccgtccggcggaggatggacgctacgtaaccttatttaaccgtgtacgcctaagtacccggaacggggtaccgacaaacgtaggttacggggaatacggaaacttaaagtccggttagggacggtttcgggggtttggggtacgggtttccggggaacggggtaacgggaaaccctaaaccggttacggtaccccggtttaccggtacggtaccgaaccggtaccccggtaaggtcccgtacccggtcccccgtaccggttacctacccgtttccgtacccgtttcccccgtaccccttccgtttcccgttccgttaccgttcccgttacggtacggaccgggttccggtccggtaccggacgaaccgggtcgtaacgtacgacgtcaggtccncgatcgtcgngtcncgctncg

SEQ ID NO: 25311 - DNA, 600 bp, Homo sapiens
  misc_feature: GYAE6OF02JIVIP.21.22.B11.1.454.CMB.1.raw
  modified_base (153)..(153): a, c, t, g, unknown or other
  misc_feature (153)..(153): n is a, c, g, or t
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (594)..(594): a, c, t, g, unknown or other
  misc_feature (594)..(594): n is a, c, g, or t
tcagtcgtcgctcgcacgaccggtgctcgatttagacgacagctcaggggggggggaagctcagcttcagctgtggtagagaagacagggactcaggacaatctccaagcatggccggcttccctctcctcctcaccctcctcactcactgcncaggtcctgggcccagtctgtgctgactcagccacctnagcgtcnggggaccccggnagaggtcaccatctcttgttctggagcaaactcaaacatcggaagtaattatgtaattcaggtatcagcaactcccaggaactcggaccccaaatccanatccagagaaataatcagggccncccngacggggtccctagacctagttctcgtggctaccaaggtcctcgggactaccctcacgtccctccctagaaccctaatccaaggttcgggacccgtccggtaaccgggagtaactgggaacgtctacgacgttaactttacgtgtacgcgtataccgaacgggaaccgtcaaaccgtagtgggaactagaaacctattacggcggaacgggtaccggacggttaaggacccaaaggggcccgtacgaaacgttggacncgatcg

SEQ ID NO: 25312 - DNA, 952 bp, Homo sapiens
  misc_feature: GYAE6OF02HWC8W.21.22.B11.1.454.CMB.1.raw
  modified_base (177)..(177): a, c, t, g, unknown or other
  misc_feature (177)..(177): n is a, c, g, or t
  modified_base (224)..(224): a, c, t, g, unknown or other
  misc_feature (224)..(224): n is a, c, g, or t
  modified_base (859)..(859): a, c, t, g, unknown or other
  misc_feature (859)..(859): n is a, c, g, or t
tcagtcgtcgctcgcacgaccggtgctcgatttagacgacagctcaggggggggggaagctcagcttcagctgtggtagagaagacaggactcaggacaatctccagcatggccggctttccctctcctcctccaccctcctcactcactgcgcagggtcctgggcccagtctggtnctgactcagtcccaccgtcgagtccggtcgtccgggggacccccggngaacggacggtccacccagttccttcttcgggttacgtaggggacgtaccctaaaccttcccaaaacgtagttaaccgggtaaaaggtttaaactttaacgttaggttaaacgtttttccggtaacggtttaactaccgtaacggtaacccgtaaaccccttacccggtaaaccgggtaaccggttaccccggtaaacccccccgtaaaaacccttccccgttaactaaccggtaaccccgtaaagggttaaccggtaaaaaccgttaacggtaccgtaaccggggtccccgggacccccggtttaaccgggtaaccccggggggtttacccccgtaacggtaccccgggtttaacttttaccccggttccggttaccgggttacccttaacccggttaaagttcccggttaccggaacccctacccgttaccgtaacccgtttccccgtcccgtacccggtaaccctaacggttacggtaccggggtttcccgggcccggtttaccgggtaccgggtacggtttacggacggtaaccggttacgtacgttaaaccgtttagtaccggttcggttacgaccgtaacgtacccggggaaacccggtacacgtaaacgtggacggtaagcgtaaacncgtacggtagggcccggttaaggggttcgttacggggtacggaacggtaccggaaccgtaccggttacgttccggtaccggtacggtaacccg

SEQ ID NO: 25313 - DNA, 765 bp, Homo sapiens
  misc_feature: GYAE6OF02GGLVM.21.22.B11.1.454.CMB.1.raw
tcagtcgtcgctcgcacgaccggtgctcgatttagacgacagctcaggggggggggaagctcagcttcagctgtggtagagaagacaggactcaggacaatctccagcatggccgcttccctctcctcctcaccctcctcactcactgcgcgacgggtcctgggcccagtctgtgctgactcacgcccaccctcagcgtcgtcggggaccccccggcaggacgggtccaccattccttcttgttcgtgggacggacctaaccgtaccaacgtagtaccgggtaaattaaattacgtgtttaattccgttaggtacttccgagaccctaaccgtaccccgaaggaaccgtcccggaaccccctaaaccgtccctacacgtaccgaaggaacgaaataactcgacggcccggtccctacgggtaccgggtccctagacccgttacttccgtcgtcgtacctaccggtaacttcggtacggacctacccgtctaccgtccctacccgtacaccctaagtccgtacgggttaccggtccgttcccggggtaccgtagggacgtagggcccgtagttacgttaacctttacgttcgtcgtacggtacctacgtaccggggaaaccgaccgtaccgaaaacggttggttagggaaccctaggaaccttacggtcgtaggggtcggttacggggtttagggtaccgggttaccgggaacgggtacggtaaaccctaccggtaccgggttacccggtacgtacgggtaacccg

SEQ ID NO: 25314 - DNA, 682 bp, Homo sapiens
  misc_feature: GYAE6OF02I9NFJ.21.22.B11.1.454.CMB.1.raw
  modified_base (212)..(212): a, c, t, g, unknown or other
  misc_feature (212)..(212): n is a, c, g, or t
  modified_base (368)..(368): a, c, t, g, unknown or other
  misc_feature (368)..(368): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagagggtcaccatctcttgttctggagcaactcaacatcggaagtaattagtgttattcgtgtatcagcaactccaggtaactccggacccctaactcctcactccagaacgtaatacgtcacgccgaccctgaccgggtcctcgaccgtattccncgtcgctacgtacgtcgtcggaccacctcgacgtcctcccgtacacctatcgacggtcgggaccgtccgggaccgaaggacgtacggacgtcgtacgtacgttagtttactagggtcgtaccgtacgttacccgggacggggtaaccaaccgtaaccggtaacggttacggggtaactaaccggtaaactacgtacggtaacgggaaccgggtttcggggtttaggggttaaccggttccgggggtaacccgggaaccgggttaaacccaaaccggttccggtaaccccggtttaccggtacggtaaacccggg

SEQ ID NO: 25315 - DNA, 690 bp, Homo sapiens
  misc_feature: GYAE6OF02IVEKN.21.22.B11.1.454.CMB.1.raw
  modified_base (223)..(223): a, c, t, g, unknown or other
  misc_feature (223)..(223): n is a, c, g, or t
  modified_base (306)..(306): a, c, t, g, unknown or other
  misc_feature (306)..(306): n is a, c, g, or t
  modified_base (323)..(323): a, c, t, g, unknown or other
  misc_feature (323)..(323): n is a, c, g, or t
  modified_base (450)..(450): a, c, t, g, unknown or other
  misc_feature (450)..(450): n is a, c, g, or t
tcagtcgtcgctcgcacgaccggtgctcgatttagacgacagctcagggggggggaagctcagcttcagctgtggtagagaagacaggactcaggacaatctccagcatggcccggcttcccctctccctcctccaccctcctcactcactgcgcagggtcctgggcccagtctgtgctgactcacgccctaccctcagtcgtccgtccggggaccccccggnaggacggtccacctattcctcttgttcgtgggacgcaactccaacgagtacggtaagtaattatagttattcgtaggtatcanacgaacctcccgagacnccggaccccaactcctacactacaagacgaataactcacgccgtccgtcgtaccggtccagtacctacgtctacgtgtccgtaccgtagtcgtcgcctacctcacgtccctcgactaaccataccgngggtccgtccgttaccgggtaccggagaacgtacggtcggtaccgtacgttaaccgttacgtacggttccggtaagcgttaaccgtaccgggaccggtaaccggaacctaacgttacggacggtacgaccgtaacgttactccggtagggtccgggttaccgggttggggttacccgttagggaccgggtaaccggttaacccgaacggtttccggacccggttaccgttaaggccccgg

SEQ ID NO: 25316 - DNA, 658 bp, Homo sapiens
  misc_feature: GYAE6OF02JICW7.21.22.B11.1.454.CMB.1.raw
  modified_base (243)..(243): a, c, t, g, unknown or other
  misc_feature (243)..(243): n is a, c, g, or t
  modified_base (631)..(631): a, c, t, g, unknown or other
  misc_feature (631)..(631): n is a, c, g, or t
tcagtcgtcgctcgcacgaccggtgctcgatttagacgacagctcagggtcctggacccagtctgtgctgactcagccaccctcagcgtctgggacccccgggcagagggtcaccatctcttgttctggaggcaactccaacatcggaagtaattatgtattctggtatcagcaactccaggaatggcccccaaatcctcatccagaggaataactcaggccggtcctcgacggggttccccnggaccgtattcctcgtggcctaccaagtctggcctacctcagccctcctgaccctatcgaggtcgggtcctcccggggtaccgaggacgtggaacggtcctaggtaacctttattacgtggtacgctaacgtcggaacggggtacaactaaaacggtcgggatcgaactaactcgtggaacgggttccgggtttgggtacgtcggggaccgggtaggaaccctaacgtcgtaccgtacgtacggtacacgaccgtacggccgtccgtcccgtcggtctacctcgttacccgtccctacccgtccttccgtccgtccttaccgtacgtcggtacggccggtacgtcggaccgaacggtcccgtactaacggtcgacggtctcgtaccgngactcgacgtaccgcgtacgctacgcg

SEQ ID NO: 25317 - DNA, 744 bp, Homo sapiens
  misc_feature: GYAE6OF02FNFYU.21.22.B11.1.454.CMB.1.raw
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (320)..(320): a, c, t, g, unknown or other
  misc_feature (320)..(320): n is a, c, g, or t
  modified_base (707)..(707): a, c, t, g, unknown or other
  misc_feature (707)..(707): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatcggaccccaaatcctcatccagacgaataatcagcggcctcgacgggtcccngaccgattcnctggctcagtctaggcactcacgcctcccgtgaccatcagtggctccggtcgaggatgacgctgactatctgngcagtacgacggacgacgtaaaagtcgggtaatacggtaacaacgttcgtaagtacggtacggggtttagggttacgggttaccggggtacggtaaccggggtaaccgtaaaaccggttaccgggtaaccccgggtttaccggttaaaccggggtttacccgaaacgggtaccccgtaaaacgggttcccgtaccccgggtacccccgttacgggtaacccgttaccgttacccgttacccggttaaccccccgtacccccgtttaccgttaccccggttaccgttacccgttaccgttacccgttacgggtacgggtcccggggttacgttaccgggaaccggtaaccggaccgtaccgttaacggtaaggtcctaggttaaccgngttaacgccgttacgacgtacgtacgctagttccgac

SEQ ID NO: 25318 - DNA, 796 bp, Homo sapiens
  misc_feature: GYAE6OF02JOL30.21.22.B11.1.454.CMB.1.raw
  modified_base (222)..(222): a, c, t, g, unknown or other
  misc_feature (222)..(222): n is a, c, g, or t
  modified_base (673)..(673): a, c, t, g, unknown or other
  misc_feature (673)..(673): n is a, c, g, or t
tcagtcgtcgctcgcacgaccggtgctcgatttagacgacagctcagggggggggaaggcgtcagcttcagctgtggtagagaagacaggactcaggacaatctccagcatggccggcttccctctcctcctccaccctcctcactcactcgcgcagggtcctgggcccagtctgtgcctgactcacgccaccctcagccgtcgtacggggaccccccgggnaggacgggtccaccgacttcctcttggttcctgggtacggcctaaacctaccgaaacgacgttaccgggaaaagttaactttaagtagttaacgttttccttagggttaactcgtaacggtccaaaccgttaccccgaagggtaaacgtccgggtaaccccccctaaaactcccctacaactcccggaagacggtaaactacgtcaacggtccgtaccctacggacgggggtcccttagggaaccgttacttccgtacgttcggtccttaaccgtaacgttccgttcgggaccctaaccgtcctacccggcccttaccgtacgaacctacgttccggaacgggtcgggtacctaccccgggtaggtaccggtagacggtagggtaccgttctaacgtactttacggcgttacacgtaccgtacggtaccggggttaaacgcccgttaaagngggttaaacggacgtaacgaaccgttagtccggtaggtaacgggttccgggttttagggggacgtttccggggaagggttacccgggaaactacgtaccggttacgtcccggttaggacccgg

SEQ ID NO: 25319 - DNA, 615 bp, Homo sapiens
  misc_feature: GYAE6OF02JCAUS.21.22.B11.1.454.CMB.1.raw
  modified_base (192)..(192): a, c, t, g, unknown or other
  misc_feature (192)..(192): n is a, c, g, or t
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (323)..(323): a, c, t, g, unknown or other
  misc_feature (323)..(323): n is a, c, g, or t
tcagtcgtcgctcgcacgaccggtgctcgatttagacgacagctcagggggggggggaagctcagcttcagctgtggtagagaagacaggactcaggacaatctccagcatggccggcttccctctcctcctcaccctcctcactcactgcgcagggtcctgggcccagtctgtgctgactcagccaccctnagcgtctggggacccccggnagagggtcaccatctcttgtctggagcaactccaantcggaagtaattatgtattcgtgtatcagcaacctccagaactcgaccccaaactcctacataccagagaataancagccgcctacgacggggtcctacgaccgtattcctcgtggacctaccgaagtcttacggccacccgtctacgcctcccgtacgaccataccgaggtcggccgtacccggtcggaggtacgtggacggtctagacttaacgttactgtcgactagtacgaaccggggacaaccggaaacaggtagggtaataccggaatagttcgtacggacggttcgggttagggttacggttaccggggaggaaccgggtaaccgtaaacgttccggtacccggttaccgtacggtaccg

SEQ ID NO: 25320 - DNA, 708 bp, Homo sapiens
  misc_feature: GYAE6OF02HRS0X.21.22.B11.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (625)..(625): a, c, t, g, unknown or other
  misc_feature (625)..(625): n is a, c, g, or t
  modified_base (639)..(639): a, c, t, g, unknown or other
  misc_feature (639)..(639): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctctcaccctcctcactcactcgcgtcgacgggtccgtcgggccctacgtccgtgctgacctcacgccctaccctnacgtcgtcgtccggggacccccggngaggtacgggtcaacctctcttcttcggtcgtaggacggccaaccgtaccaagtactacggaagttaatttagtcggttattgtacggtatcacgacctaaccgtccgaaagggtaacctccggaaccccctaacgtcctacgacttaccgaaggaagaattaacaccgacggccgtcccgtacggacggggttacccataccggtactttctacgttcggaccttacgaacgtttcgccgtcaacccgtagtacccggcccttaccctacgtaccgactaccggtaacggtcggtccgggtaccgttacgggacggaacgtggtaccgtacgttcgaacgttacgttaacgtgttaccacgtcgtaacggaccggtaccgaacgtacgaagttcgganacgtacagttacgnggtacgtgggtaggttcggcgggtacggaccggaacgtaacggacgtaccggtacgaccggtctaacgg

SEQ ID NO: 25321 - DNA, 680 bp, Homo sapiens
  misc_feature: GYAE6OF02JF9D4.21.22.B11.1.454.CMB.1.raw
  modified_base (214)..(214): a, c, t, g, unknown or other
  misc_feature (214)..(214): n is a, c, g, or t
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (389)..(389): a, c, t, g, unknown or other
  misc_feature (389)..(389): n is a, c, g, or t
  modified_base (444)..(444): a, c, t, g, unknown or other
  misc_feature (444)..(444): n is a, c, g, or t
  modified_base (568)..(568): a, c, t, g, unknown or other
  misc_feature (568)..(568): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcaggtcctgggcccagtctgtgctgactcacgccaccctcacgcgtcgtacgggaccccccggngaggagggtccacctatccttcttgttcgtggaggcaacctccaacagtacggaacgtaattatagtattcgtggtatnagcaactaccagataccgaccccaactctcanccagacgaatancagccgccgtcgcggctcgactacttctcgtggcctaccgagtccgtggccncctcaccgtccctccgtacgaccctagtcgaggtcggccctccgggtcggaagtntcggagtcctgtaaccttactacggttacgtcgtaaccgacgttaccgggaaccgggaaccgttacgaaaccggttaggtaaacgggagttaaaccgtaacgttaacgtccggtttaacggggngggtttacccggggtttagggggttcgggtttaccccggggaacgggtaaacccgggggaacccttaaaccgggttccccggtaccggttacccggtacgggtaaaccccgg

SEQ ID NO: 25322 - DNA, 672 bp, Homo sapiens
  misc_feature: GYAE6OF02ILCSQ.21.22.B11.1.454.CMB.1.raw
  modified_base (215)..(215): a, c, t, g, unknown or other
  misc_feature (215)..(215): n is a, c, g, or t
  modified_base (281)..(281): a, c, t, g, unknown or other
  misc_feature (281)..(281): n is a, c, g, or t
  modified_base (536)..(536): a, c, t, g, unknown or other
  misc_feature (536)..(536): n is a, c, g, or t
  modified_base (570)..(570): a, c, t, g, unknown or other
  misc_feature (570)..(570): n is a, c, g, or t
  modified_base (592)..(592): a, c, t, g, unknown or other
  misc_feature (592)..(592): n is a, c, g, or t
tcagtcgtcgctcgcacgaccggtgctcgatttagacgacagctcagggggggggggaagctcagcttcagctgtggtagagaagacaggactcaggacaatctccagcatggccggcttccctctcctcctcaccctcctcactcactgcgcagggtcctgggccccagtctgtgctgactcagccaccctcagcgtctcgggaccccccgggnacgagggtccaccatctcttgttctggagcaactccaacatcggaataattatgtattctggtacncagactaacctcccgaaggaactccggacccccaaacttccctactactaccgaagaaggtaaataactcgacggaccggtccccgtacggtaccggggtccctaggacccgtagttcctcgtcggtacctaccgtaaacgtccgtacggtacccacccgttcaaccggtcccttaccccgtagaaccctactccgtagggttccggaccgttccgggtacgagggtactggacgtcgtagtaccttaagttcgngtcgccagttaccgacgggacacgtaacgtaggnggtaactgtaaccacgttacgnggtaacggtcgggtttagggtccggttacggggacggtacgggaacctaaacggtccgtaacccggtccgtaggtacccg

SEQ ID NO: 25323 - DNA, 757 bp, Homo sapiens
  misc_feature: GYAE6OF02HKW44.21.22.B11.1.454.CMB.1.raw
tcagtcgtcgctcgcacgaccggtgctcgatttagacgacagctcgaggggggggggaagctcagcttcagctgtggtagagaagacaggactcaggacaatctccagcatggccggcttccctctcctcctccaccctcctcactcactcgcgcgacgggtcctcgggccctagtctgtgctacgactcacgccctaccctcacgtcggtccggtccgggggacccccggcagggacggtcaacctacttcttcgttacgttcgcgggacggcctaacctaccaacgtacgttaacggtaaagttaatttagttacgttacgttcgttacggttactacgtaacgacctaaccgtaacccgtaacggtaacgtaccccggtaaccccctaacctcctaccaacgtaccgaaggaacgtaaatacgtcgacggtccggccgtacgggtaccggtacctacgtaccgtattcctacgtacggtacctaccgtaacgtcgtaccggacctccgtccgtaccgtccctaccgttaccgacctacgtcggacggttccgggccgtcccgggtacggacggtagtcggtacgtacgtacttagttacgttcggtacgacgtccgtaactaccgggaccggacaaccgtacgaggtcggaattacacgtacttcggtacggtcggggttccgggttggggtaggtacccgggtagggaacccggaacgtaaccggttacccggtacggttacggacgtaccgg

SEQ ID NO: 25324 - DNA, 1046 bp, Homo sapiens
  misc_feature: GYAE6OF02GGX5Y.21.22.B11.1.454.CMB.1.raw
  modified_base (59)..(59): a, c, t, g, unknown or other
  misc_feature (59)..(59): n is a, c, g, or t
  modified_base (184)..(184): a, c, t, g, unknown or other
  misc_feature (184)..(184): n is a, c, g, or t
  modified_base (212)..(212): a, c, t, g, unknown or other
  misc_feature (212)..(212): n is a, c, g, or t
tcagtcgtcgctcgcacgaccggtgctcgatttagacgacagctcaggggggggggaanctcagcttcagctgtggtagagaagacaggactcaggacaatctccagcatggccggcttccctctcctcctcaccctcctcactcactgcgcagggtcctgggcccagtctgtgctgactcacnccaccctcagcgtctcggggaccccggnaggaggtcaccatctcttgtctggacgcaactccaacagtcggaagttaacttgtacgttattcgtaggtaatcgaagtactaacctacccgaaggaacttccgggaaccccccctaaaacttccctagaaccgttaccgaaagaacgggtaaacttaaacgccgaacgggtcccggtacccccgttagggaacccgggggtttacccctagtaacccggttaactttcctaccgggtttacgggaccctttaacccgtaaaagggtttcccgttaaccgggggaccctaaaccccgttttacggaaaccccggtttcccctttacccccgggttaaataacccgtaacgttacccgggttaacgggggtttccggggtaccccggttacccggggttaacccggaaagggtttaacgggttacggggaaccgggttaccctttaacgggttaaaacctttaacgggtttttaacccggtacgggtttaccggtaaaccgtttaaacccgggttaccggggttaaaaccccgggggggacccctaaaacccggtttaaaaccggtttaacggggaaaggggtaaaccttttaccggggaaaaaacccttttaaggttccccgggttttaaaggggtaacggggggtttttaacccccgggggttttggggggggggggtttaaaccccgttttaacccgggggggggaaaccccggggttaaaaccggggggggtttaaaacccccctaaaaaaacgggggttttttccccccgggtaaaacccggggggtttttaaaacccccccggtgggggggttttaaaaaacccccccg

SEQ ID NO: 25325 - DNA, 799 bp, Homo sapiens
  misc_feature: GYAE6OF02JDV6M.21.22.B11.1.454.CMB.1.raw
tcagtcgtcgctcgcacgaccggtgctcgatttagacgacagctcgagggggggggaagctcagcttcagctgtggtagagaagacagggacctcaggacaatcctccagcatggccggcttccctctcctcctcaccctcctcactcactgcgcaggtcctcgggcccagtctgtcgctgactcagccaccctcagcgtccgtcgggaccccggcagacgggtccacacgtcctcttcgttcgtcgggacgactaaccgtccaacacgtcggaagttaattactggttaacttcgtacggtactaccgacgtaccaaccttcccgaaggtaacgtcccgggacccccctaaaacgttcccttaccgtactacccggaaggtaacgggtaaacttaacgtccgaacgggcccggtaccctaccgggtacggggttcccctaggtacccgtactttccgtacggtacggtcccgttaaccgaacggtttaccgtacgggtacccctacccgtccgtacccggtccctttcccccgtaagtaaaccccgtacgttaccggagggtttcccggggaccgtttacccggggtacgtacgggaaagttccgggacgggttaccttaacggttaacttaccgttcgtacgggttcacgggtaccttacgggaccgggtacgtaccaagttaacgggtcggaacgtacggtaaccctaggtcgtaacgggcggttaccgggttagggtccgttacggggacggaaccggtaacctaaccgacggtacccgttaggaacccgttcgg

SEQ ID NO: 25326 - DNA, 326 bp, Homo sapiens
  misc_feature: GYAE6OF02IN3B6.21.22.B11.1.454.CMB.1.raw
  modified_base (155)..(155): a, c, t, g, unknown or other
  misc_feature (155)..(155): n is a, c, g, or t
  modified_base (203)..(203): a, c, t, g, unknown or other
  misc_feature (203)..(203): n is a, c, g, or t
  modified_base (292)..(326): a, c, t, g, unknown or other
  misc_feature (292)..(326): n is a, c, g, or t
tcagtcgtcgctcgcacgaccggtgctcgatttagacgacagctcagggggtccctgaccgattctctggctccaagtctggcacctcagcctccctgaccatcagtgggctccggtccgaggatgaggctgactattactgtgcatcacgggcncaacatgggatgaacaatctgagcggtgtggtcgaggcgaccaatgcncagtcagccaagctgcccccgtgtcactcgtcgttcccacccgtcctccgtcgtctacgttactgagcgggctggacacggcgcagtgnnnnnnnnnnnnnnnnnnnnnnnnnnnnnnnnnnn

SEQ ID NO: 25327 - DNA, 713 bp, Homo sapiens
  misc_feature: GYAE6OF02IQFS3.21.22.B11.1.454.CMB.1.raw
  modified_base (150)..(150): a, c, t, g, unknown or other
  misc_feature (150)..(150): n is a, c, g, or t
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (495)..(495): a, c, t, g, unknown or other
  misc_feature (495)..(495): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcncagggtcctggcccagtctgtgctgactcacgccacctcagcgtctggggaccccggcaggagggtcnccatctcttagttcnggagcaactccaactatacggtaataattatcgtattctgtancanaccaactcccaggaactccggacccccaaactctacactaccaaggacgtaaataactcgagtaccggtcccttacgacggggtcccctgaaccgtattccgttactcggacttccctaaaggtcctcggaacctaccccgtcgtacctcccgtaccctcgaaaccgacttcggaacgggttccgggtacctacccggggttaacgacggggtaancgggttaacgggtaccttacgggtaactttaaccgtttacgtcgtacgtaccctacgtaccgtaccggggaaccgtacaaaccgtagtacgggtaacttacggaacttacgtacggtagtccgggggtttacggggtttaacggttcggttaacccggggagggtaacccgggttaaacccgtaagtcccgggttaacccgttacccggagtaaccgg

SEQ ID NO: 25328 - DNA, 969 bp, Homo sapiens
  misc_feature: GYAE6OF02JL5TO.21.22.B11.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctctcacctcctcactcactgcgcgaggtcctggcccagtctgtcgctgactcagccacctcagcgtcgtcgggaccccggngaggacggtccaccacgttctcgttcgttccgtagggacgggtcctaaaccttcccgaaactacgttaccggggtaaaggttttaaactttaacggttggtttaaactttccgggtaggttaacttaccgaacggtaacctaaaccgttaccccggaaacggggttaaacttaccccggggaaacccccctaaaaccggtttccccttacggtaacctacccgaagggtaaacggtaaacttaaacgtccgaccgggtaccggtaccccgttacgggtaaccggggtccctagggtaacccgtttacgtttccgtacggttaccggcccttaaccgggtaacgttccggtacggacccttaacccgtccgaacccgttaccccgtacccgtacggtaacccctaaggttaccggaccgggttcccgggggtaaccttcccggggtaaccgggaacgggttaactaacgggggtacccggtaacgttcccgtaaacgttttaaccgtttaccgtacggttaccggtaaaccgttacccgggaaaccggttaaccccggggaagttaaccccgtaaaagggacggggtttacggaaccgttaaacccggtaacgtttacggtaaccggttttaacgggggtcggggtttaaccggggggtttagggtaacccgggggtttaccggggaaaccgggggtaaccccgtttaccgggaaaaccggtttaccgggttaccccggttagggttaaccccggtaacccgg

SEQ ID NO: 25329 - DNA, 669 bp, Homo sapiens
  misc_feature: GYAE6OF02F5Q5O.21.22.B11.1.454.CMB.1.raw
  modified_base (102)..(102): a, c, t, g, unknown or other
  misc_feature (102)..(102): n is a, c, g, or t
  modified_base (155)..(155): a, c, t, g, unknown or other
  misc_feature (155)..(155): n is a, c, g, or t
  modified_base (634)..(634): a, c, t, g, unknown or other
  misc_feature (634)..(634): n is a, c, g, or t
  modified_base (638)..(638): a, c, t, g, unknown or other
  misc_feature (638)..(638): n is a, c, g, or t
  modified_base (643)..(643): a, c, t, g, unknown or other
  misc_feature (643)..(643): n is a, c, g, or t
  modified_base (664)..(664): a, c, t, g, unknown or other
  misc_feature (664)..(664): n is a, c, g, or t
tcagtcgtcgctcgcacgaccggtgctcgatttagacgacagctcagggtcctgggcccagtctgtgctgactcagccacctcagcgtctgggaccccgggnagagggtcaccatctcttgttctggagcaactccgaacatcggaagtaattangtattctggtatcagcaactccaggaatcggaccccaaatcctcatccagtaggaataatcacgcggcctacgagggtcccctgaccgtattctcgtaggcctacaagtctcggccacctcgacgtcccttacctagacctagtcaggtcggtcctcccgggtaccgaggactggacggctaggaaccttagttaccgtgtgcctagtcgaaccgggtacacaaaaggttcggaaatcggaaactcgtacgtaggtaacgggttccggggtttggttacggttccgggacgggtaaccggtaacgtaaaccgtcggtaacccggtccggtaacggtacccgtaccgaacccggtacggtcccgtacccggtccccgtacgtaccgccttcgtacccgtcccgtccgtccccgttaaccgttccgtacctacgtaccgttaggaccggtcgtaccgcggacgtacggactcgtaagtcgngtcncggtntacggatcgagcagcaggttnaaccg

SEQ ID NO: 25330 - DNA, 848 bp, Homo sapiens
  misc_feature: GYAE6OF02HW75D.21.22.B11.1.454.CMB.1.raw
  modified_base (461)..(461): a, c, t, g, unknown or other
  misc_feature (461)..(461): n is a, c, g, or t
  modified_base (753)..(753): a, c, t, g, unknown or other
  misc_feature (753)..(753): n is a, c, g, or t
tcagtcgtcgctcgcacgaccggtgctcgatttagacgacagctcagggggggggggaagctcagcttcagctgtggtagagaagacaggactcaggacaatctccagcatggccggcttccctctccctcctcaccctcctcactcactgcgcagggtccgtcgggcccagtctgtgctgactcacgcccaccctcaggcgtccgtccggggaccccccgggacgagggacgggtccaacccgattccttcttgttcgtagggacggccaactaccaacagttacggaaagtttaattagttgttactttcgtaggttactcgtaagacctaaccgtacccgaagggtaacgtacccggtaacccccctaaaaccttccctaacctacgtacccgaagggtaagtaaacttaactacgaccgggtcccggcccgttaccgggaaccgggggtttaccccncgggttaaccggtttactttccgtccggttccggtacctaccccggttaacggttccgttacgggaccctacccgtttacccgaccctccccggtaccccgtaccggtacccacgttaccggtcggggttacccggggcccgtttacccggggtacccggaacgggtaccggtcggaacgggttcctacgggttaacctttagttaccgtcggtaacctaccgttacggtaaccgggtaaccggggtacgaaccgtaaccgtagggttacgggaacttaacggaccttacgnggtacgggtacggtttcgggggttaggttccgggtacggggtacgggaaccggtaacccaaaggttcccggtaccgttaccggtacgtacccggg

SEQ ID NO: 25331 - DNA, 666 bp, Homo sapiens
  misc_feature: GYAE6OF02ISAWF.21.22.B11.1.454.CMB.1.raw
  modified_base (227)..(227): a, c, t, g, unknown or other
  misc_feature (227)..(227): n is a, c, g, or t
  modified_base (275)..(275): a, c, t, g, unknown or other
  misc_feature (275)..(275): n is a, c, g, or t
  modified_base (544)..(544): a, c, t, g, unknown or other
  misc_feature (544)..(544): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctccaccctcctcactcactgcgcacgggtcctgggcccagtctgtgactgtacctcacgcccacccctcagccgtccgtcggggacccccccggganacggagggtccacctatcttcttgttcgtgggacgactaactaccaanacgtacggaaagttaattacgtagttacttcgtagtactacagaccaacctcccgaagtaacgtccggaacccccctaaatccctacactaccgaagtaagtaactaacgacgacgccggtccctacgacgggtcccagtaccgacttccgtacgtcggactaccgtaagtctcggaccctaccttcaaccgtccctacctaccgactagacgtaggtcggtccgtaccggtacggagagtacggctacggttacgtaatttactacgntcgtaactacggtaccggaacgaccgtaacgtacgtaggtaacgataagtaacaggttctaggtggttcgggtaggtcggtaccggaggaacgttacaccgtcggaccttaccggagtaccg

SEQ ID NO: 25332 - DNA, 797 bp, Homo sapiens
  misc_feature: GYAE6OF02JQDOH.21.22.B11.1.454.CMB.1.raw
  modified_base (149)..(149): a, c, t, g, unknown or other
  misc_feature (149)..(149): n is a, c, g, or t
  modified_base (214)..(214): a, c, t, g, unknown or other
  misc_feature (214)..(214): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcncacgggtcctggcccagtcctgtgctgactcagccaccctcagccgtctacggggaccccccggngaggacgggtccaaccgtattcctcgtttcgttcgacgggtacggcctaaactccaaaacgtacgtacgggtaaagttaacttatacgttatttccgtggttaactctaacgactaactacccgaaggtaacgtccggacccctaacgtccctactaaccgtaccgtaagaacggtaaactaacgtcaacggtccggcccgtacggtaccggggtccctacggtaaccgtcttccgttaccgtcggacctaccgtaaccgtcgttacggccctaacgtccgtaaccgtcccgtacctacggtaacctacgttacgaacgggttcgggacccgttacccgggtacggtacggacgttacggacgtaccgtaacgtaaccgtttacgttaccgtggtaaccgtccgtacgtaccgggaaccggtacgtaaccgtaacgtacgggtaaggtaaccgtcgtaaaccgtacgttcgggaacggtaaccgggtttcgggttaggggttaccggtacccggggaacgggttaacccggaaacccgttaaacggttccggtaaccccggtttaccggtacgggtaacccgg

SEQ ID NO: 25333 - DNA, 768 bp, Homo sapiens
  misc_feature: GYAE6OF02HO9DO.21.22.B11.1.454.CMB.1.raw
  modified_base (219)..(219): a, c, t, g, unknown or other
  misc_feature (219)..(219): n is a, c, g, or t
  modified_base (404)..(404): a, c, t, g, unknown or other
  misc_feature (404)..(404): n is a, c, g, or t
  modified_base (445)..(445): a, c, t, g, unknown or other
  misc_feature (445)..(445): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctcggcccagtctgtgctgactcacgccctaccctcacgcgtccgacgggggaccccccggntaaggacgggtaccacccgtattccttcgtttggttacgtagggacgacctaaacctaccctaaacgagtaccggtaaaagttaattttagtgttaatttctaggttatcaacggacctaaacctcccgaaggaactccggaacccccctaaatccctcacttaccgaaggtaacgtaaataacncgaagcccggtcccgtaggaccggggtcccctaggaacctnttcctcgtacggtcctaacctaggtcttacggacctaccctagacccgtcccttccgacgaaccctgttcgagggttcggtccgttacccgggcggaaggtacgcggaggtccctttagaacttttaacggtatttcggacgcgtaaccgcgggaaccggactaacccgaaaggttcgggtacgggttaaactaccgtaaacgtaccttgggttcgaacgggggttttccggggttaggggtttaccgggaacccgggaacggggaaaccgggaaccccttaaaagggttccccggtaaccccgttcggttaaccggaaccgg

SEQ ID NO: 25334 - DNA, 783 bp, Homo sapiens
  misc_feature: GYAE6OF02F99WI.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcagggggggggaagctcagcttcagctgtggtagagaagacaggactcaggacaatctccagcatgccggcttccctctcctcctcaccctcctcactcactgcgcgagggtcctgggcccagtctgtgctgactcacgcccaccctcacgcgtcgtcggggacccccggnaggacgggtccaccattcctcgttgttctgggagtaccaacctccaaactagtcggaaagtaattatgtattctaggtatacagacaacctaccgaagactaccggaccccctaactaccctcactaccaaggtagaaattaacgccgaacggcccggtacccgtacggtacggggttaccctacggtacccgtacttcgtaccgtcggtacccgttaaccgtaacgttccggtacggtacccgtacccgttaccgaccgtcccccttacccggtaaccacccgtacgttaccggtacgggtacgggtccccgtttacccggggaccggtaacgggtacgttaggaccgggtaccgttaggtaacctttaacgtttactcgggttacacctacgggtaccgaacccggggaactacgtaaccgtaacggtacggtacgtaacgaacgttaaccgtcggtaacggtaaccggggttcgggtttaaccgggtcgggtttaccggggaaccgggaaacgggttaccctaaaaccgggtcccggtaacccgggttacggacggttaacccgg

SEQ ID NO: 25335 - DNA, 915 bp, Homo sapiens
  misc_feature: GYAE6OF02GOGI0.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcaggtcctgggcccagtctgtgctgactcacgcccaccctcagcgtcgtccggggacccccgggcaggacgggtcaccatccttcttgttcgtggacggacaacctaccaacatacggaagttaattatgtattcgtaggtactactagacctaacctcccgaaggtaacgtccggtaacccccctaaaacttccctacgtaaccttaccgaaaggtaacggtaaacttaaacgtaccgtacggtcccgggtcccctacgggtacccgggggttaccctaccggtaaccgtactttccgtacgtttacgggaccctttacccgtaaacggtttccggttaccgggtaccctaaccccgttaccgtaacccgtaccccgtttacccccgttacggaaaccccttacgttcccggtaaacggggttccggggtcccgttaccccgggggtaccggttaaagggtaccggttacgggaccgggtacgttacggttaacctttaacgtttaccgtacggttacgtaccgtaacggtacccggggtaaccgggtacccgtaaccgtaaaccgggtcgggttaacggaaagttaccggtaaacgttacggttaccgggtttacggggtaaccggggtttccgggggtttttaccgggggttaccggggtttacccggggggtaaccggggtaaacccgggttaaaccccgttaaaacccgggttcccggggtaaacccccggtttacccggggttaacggttaaccccggg

SEQ ID NO: 25336 - DNA, 829 bp, Homo sapiens
  misc_feature: GYAE6OF02H5CHM.21.22.B11.1.454.CMB.1.raw
  modified_base (175)..(175): a, c, t, g, unknown or other
  misc_feature (175)..(175): n is a, c, g, or t
  modified_base (183)..(183): a, c, t, g, unknown or other
  misc_feature (183)..(183): n is a, c, g, or t
tcagtcgtcgctcgcacgaccggtgctcgatttagacgacagctcgaggggggggggaagctcagcttcagctgtggtagagaagacaggactcaggacaatctccagcatggccggcttccctctcctcctcaccctcctcactcactgcgcagggtcctgggcccagtctgtnctgactcngccacctcagcgtctcgggaccccggcaggagggtcaccatctcttgtctggagcaactccaacagtcggaaataattatagtattcgtaggtatacagacctaaccgtacccgaaggtaacgtaccggaccccctaaaactcctacgtaactaccgaaggtaacggtaaaactaacgtaccgaacggtacccggtaccccgtaccggtaaccgggggtaccccttacggaacccggttactttaccgttccgttacgggtaccctaaccggttaaaccggtttccgtacggtaccccgtaacccgttaccgtaaacccggtccccgtttaccccgtacgtaaccccgttaaacgttaccggtaccggggttcggggttacccgttaccccggggttaacccgggaggtaaccggttacgggacggttacggtaaccggtaacttttaacgtttaacgtacggttacggtaccgtaacgtaccgggtaaaccggggaccgtaaccgaaacgtacgttagggaacgttaacggaacttaacgtcgttaacgggtacgggttacggggttttagggacgggtttacgggacgggttaacggggaaaccctaaaggtacccggtaccggttacccgagggttaaccccg

SEQ ID NO: 25337 - DNA, 790 bp, Homo sapiens
  misc_feature: GYAE6OF02G5G5B.21.22.B11.1.454.CMB.1.raw
  modified_base (411)..(411): a, c, t, g, unknown or other
  misc_feature (411)..(411): n is a, c, g, or t
tcagtcgtcgctcgcacgaccggtgctcgatttagacgacagctcagggggggggaagctcagcttcagctgtggtagagaagacaggactcaggacaatctccagcatcggccggtcttccctctcctcctccaccctcctcactcactgcgcgagggtcctcgggcccagtctgtgctgactcacgcccaccctcacggccgttcggtaccgggggacccccggagaggtacgggtaccacctattccttcgttcgttccgtaggacggactaacctaccaaacgtagtacggtaaattaacttagtcggttacttcgttaggtactcgacgtacctaacctacccggaggtaaccgtcccggaaccccctaaacgttccctacgacttccgaaggtaagtaaactacncgtaacggcccgtaccgtcggtaccgggtaccctacggaccgttactttcgtccgtcggtacctaccgtaggtccgtcgacctaccgtccaccgtccctccgtacgaccctacgtaccgtggggtaccggccggttaccgggacgaacggggtcgtacgggaccggttcgtaacgttaaccgtttaacgttcgtacgggtcaacgtaccggtacggaccgggaacctaacgtaacgtgggtaggaactacgaacttacgtcggtacgggtcggggttttaaccggggttcggggttaaccggtaccggggaaccggggtaaacgggtaacccggttaaaccgcccggggtttaacccgttaccgggtacggtaacccgg

SEQ ID NO: 25338 - DNA, 799 bp, Homo sapiens
  misc_feature: GYAE6OF02HXGEP.21.22.B11.1.454.CMB.1.raw
  modified_base (217)..(217): a, c, t, g, unknown or other
  misc_feature (217)..(217): n is a, c, g, or t
  modified_base (648)..(648): a, c, t, g, unknown or other
  misc_feature (648)..(648): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtcgctgactcacgccgaccctcacgcgtcgtcggggacccccgggnacggacgggtccaccgtatcctcttgttccgtgggacggcctaactaccaactagtaccggtaaagttaactttatagttactttacgtggttactactacgtacctaaaccgttcccgaaggtaacgttccggaaccccctaaaacgttcccgtactaacttaccgaagggtaaacggtaaacttaacgtaccgtaaccgggtccccggtacccgttaccggtaccgggggttacccctacggtaacccgttacgtttccgttccgttacggtaccgttaaccgtaaacggttcccgtacgggaccctaacccgtccgtaaccgtcccctttaccgtcggaaaccctacggttacgtaacgggttcgggaccgttccccggggaacgtaagggtactcgggtacggtacctaggtaacctttagttacgngtacgactaacgttcggaacgggacacgtaactagggtaggaacttacgaagtacgttcggagggtaacgttccggggttaggggtaccggtacccggggacggtaacggtaaccctaacggtcccggtaaccgttccggacggtacccgg

SEQ ID NO: 25339 - DNA, 785 bp, Homo sapiens
  misc_feature: GYAE6OF02IL05R.21.22.B11.1.454.CMB.1.raw
  modified_base (224)..(224): a, c, t, g, unknown or other
  misc_feature (224)..(224): n is a, c, g, or t
  modified_base (604)..(604): a, c, t, g, unknown or other
  misc_feature (604)..(604): n is a, c, g, or t
tcagtcgtcgctcgcacgaccggtgctcgatttagacgacagctcagggggggggggaagctcagcttcagctgtggtagagaagacaggactcaggacaatctccagcatggccggcttccctctcctcctcaccctcctcactcactgcgcgacgggtccgtcgggcccagtctgtgctgactcacgcccaccctcacgtcgtcgtccggggacccccgggngaggacgggtcacctatccttctttggttcgtagggacggacctaacctccaactagtacggtaaagttaaattagttagttatttcgtaggttaactcgaacgtacctaaccgtaccccgaagggtaaccgtacccggaaccccccctaaaaccttccctacctaactaccgaaggtaaacggtaaacttaacgtccgaacgggtccccggtacccgtacggtaccggggttccctaccggtaccgttacttccgtacgtcgtcctacgtaacgtccgtacgccctacccgtacgccgtccctaccgtacgaaccctgttcgacgggtcggtcccgtcgggtacggagtcgtggtacgtctacgttacttacgttacgngtccgtactacggtaccggaccgggaaccagtaacggtgggttaaggaacttacgggaaacttcgggttacggtaggggtacggggtttccggggtttggggttaccgggtacggggaaccggggtaacccgtaaaccgggtaccgtacccgggtaacccggttaccggtacggtacccgg

SEQ ID NO: 25340 - DNA, 723 bp, Homo sapiens
  misc_feature: GYAE6OF02F8QMR.21.22.B11.1.454.CMB.1.raw
  modified_base (698)..(698): a, c, t, g, unknown or other
  misc_feature (698)..(698): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatcggacccccaaatcctacatccagaggaataatcagccgccctcgacggggtccctagaccgtatttccgtctgggccttaccgtaagttccgtcgggaccctaaccgttccaacggtcccccttacccgttaggaacccctattccgaagggttcgggtacccttccccggggtaccgagggtactcggacggtccgttaggtaaccttacgtttactggttacgcctaagttcccggaacgggtacctaacgaaaaggtggggaacttacggaactaacgtcgtaggacggtcgggtttgggtacggttcgggacggtaacggaaccgtaacgtcggtaccgtacgtacggtacgtacgaccgtagccgtcgtccccgtcgttaccgtaccgtcgttccgttaccccgtcccgttcccgttcccgtcgttaccttaccgtaaccgtcggtaccgggtccgggtaccgtcggtaacgaccgggtaccacgttacgtacgcgccgtgcgtacncgtactcgactacgacctcgagtcg

SEQ ID NO: 25341 - DNA, 760 bp, Homo sapiens
  misc_feature: GYAE6OF02JERIZ.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcacctcctcactcactgcgcagggtcctgggcccagtctgtgctgactcagccacctcacgcgtctcggggaccccgggcaggcgggtcaccgatctcttgtcgtggacggcaactccaatacgtaccggaaagttaatttatagttattcgtaggttaactcgtaaggacctaaaccttcccgaacggaacttaccgggtaccccccctaaaaccgttaccccttaccaacctccgtaacgggaaacgggtaaacttaaacgtccgtaacgggtcccggtacccgttaccgtaccggggggttaccccttacgggacccggttactttcccgtccggttaacggtcccgttaaccgtaaacggtttccgtacggggtaccctaacccgttcctaacccggtcccctacccgtacgaccctaagttcgaccgggttgggtacccgtcccgggtacggacgtacgtcgggtacgtcgttaagacctttagttaccgtggtactacgtacgtaccgggtaaccggaggtacccaacggttaggtacggtacgttaccggaatctacggtcgggtaacggcgggttagtacgggtacggagggcccgtaacgagttaccggcacggttgacgg

SEQ ID NO: 25342 - DNA, 606 bp, Homo sapiens
  misc_feature: GYAE6OF02ILQTD.21.22.B11.1.454.CMB.1.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
  modified_base (412)..(412): a, c, t, g, unknown or other
  misc_feature (412)..(412): n is a, c, g, or t
  modified_base (449)..(449): a, c, t, g, unknown or other
  misc_feature (449)..(449): n is a, c, g, or t
  modified_base (475)..(475): a, c, t, g, unknown or other
  misc_feature (475)..(475): n is a, c, g, or t
  modified_base (512)..(512): a, c, t, g, unknown or other
  misc_feature (512)..(512): n is a, c, g, or t
tcagtcgtcgctcgcacgaccggtgctcgatttagacgacagctcgagggggggggaagctcagcttcagctgtggtagagaagacaggactcaggacaatctccagcatggccggcttccctctcctctccaccctcctcacctcactgcgacagggtcctgggcccagtctgtgctgactcacgccctaccctgagcgtcgacgggggacccccggtagacgggtcacctatcctgttacgtcgnggacgccaactccaaangtacggtaaatattaatgtaacttcgtaggtatacgagctacnccgaagtactcgacccaactcacgatcaagagaatancacgcgtccnggacggtccagactgttctcgngccactagtcncggcctacccactcgaccttaccgngtaacctacgtgcgggtcggctacccggagaaggttnagggacggtctacgattaacgtccgngtcacgacgtacggacgactacgtagtaggacgtaanactaacgtagttcggcggtaggttccgggttagggttcggtaccgggtaggaacggtaacccttaggtccggtaaccccttacgggacgtaccg

SEQ ID NO: 25343 - DNA, 725 bp, Homo sapiens
  misc_feature: GYAE6OF02F5I67.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggaccccggcagacgggtcaccatctcttgttctggaggcaacctccaacagtaccggtaaagttaattagtgttaattcgttaggtaactctagacctaactcccaaggaactccggacccccaaacttcctacactaccgaagacggaaataactccgacggccgaccctacggaaccggggtccctaggaccgtacttcctacgtcgctaccgaacgtccgtacggacctaccctcgaccgtcccttacccgtacgaaccctacgtacgtagggttccgggaccttcccgggtaccgaagggtctagggacggtcttaggtaaacctttagttaaccgtggtaccgctaaccggtttccggaaaccggggtactaaccgtaaacgggtagttaccgggaattaaccggaacgtacttcggttaacgggtagggttaccggggttggggttacggttaccgggggaaccggtaacggaacccgtaaacggtaccggacccggtttacccgtaaggtacccg

SEQ ID NO: 25344 - DNA, 789 bp, Homo sapiens
  misc_feature: GYAE6OF02IN1BB.21.22.B11.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctcgggcccagtctgtgctgactcacgccaccctcagcgtccgtccggggacccccggnacggagggtccactacgtctcttcgttcgtgggacgacctaactaccgaactacgtacggtaaagtaatttacgtaggttactttcgtaggtactaccgtagacctaaccctccccgaaaggtactacccggtaccccctaaacttcccgtacctacgtaccgaaggtaacggaaacttaacgtcctaccggacccgggtacccgttacggaccggggtcccgtacgaaccgtacgttcgtccgtacggtacctaccgtaaccgttcgtacgtacccaccgtaccggaccgtcccgttacccgaccgtaaacccgtacgttccggtaacgggttcccggtaccgttacccggggtaccgaaagggtcggtcgaaggtccgttaacgttaccgttaagtttaccgtcgtacgtacgtaccgtaccggaccggtaaccgaacgtaacgacgggtcgaacgtactaccgtacttcggtacgtacgggtttacgggtcggggttacggtacgggtaccggggtaacggtaacccggtaaccgttcgggtaacccggtcccgggtaggtaaccccgg

SEQ ID NO: 25345 - DNA, 732 bp, Homo sapiens
  misc_feature: GYAE6OF02FZ9SB.21.22.B11.1.454.CMB.1.raw
  modified_base (245)..(245): a, c, t, g, unknown or other
  misc_feature (245)..(245): n is a, c, g, or t
  modified_base (712)..(712): a, c, t, g, unknown or other
  misc_feature (712)..(712): n is a, c, g, or t
  modified_base (718)..(718): a, c, t, g, unknown or other
  misc_feature (718)..(718): n is a, c, g, or t
  modified_base (729)..(730): a, c, t, g, unknown or other
  misc_feature (729)..(730): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggatcggaccccaaatcctcatccagagaataatcagccgccctcagggtccctgaccgattcnctggctccaagtctgcacctcagcctcctgaccatcacgtcgggcctccggtccgaggacgtggacggctacgacttagttacgtggtcgacactcggaaccgggacgaccgtaaaaggtcggggaactacggaaacctaagttaccgtaggtaacgggttaccggggtttacgggggttcgggtttacggggacccggggaaacgggtaaccccgtaaaaccgggtacccggtaacccggttacccggttaacgggttaccggaaccggtacccggtaaacgggtcccgtacccggacccccgttacgggtacccgtaccgttccgttacccggtttcccccgtaccccgttaccccgttacccgttcccgtaccctttaccgtacccgttacgggtaccgggtccgggtaccgtacggtacccggtaacgggtccgtacgtacggtacgctacgtagtcgtacgngtacgngtacgctcgcnncg

SEQ ID NO: 25346 - DNA, 761 bp, Homo sapiens
  misc_feature: GYAE6OF02GVLVG.21.22.B11.1.454.CMB.1.raw
  modified_base (214)..(214): a, c, t, g, unknown or other
  misc_feature (214)..(214): n is a, c, g, or t
  modified_base (478)..(478): a, c, t, g, unknown or other
  misc_feature (478)..(478): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagccgcctcgggggaccccccggngtacgagggtccaaccgattccttcttcgttcctgggaggtacctaactccaaactagtaccgggtaaagttaacttagttagttagttcttgggtaatccaagtacaaccgttacccgaaggtaacgtccggaccccctaaaacttcccttacactaccgaaggaacgtaaattaacgcgaacggccggacctcggaacggggtccctaggtaccgtattccgtacgtcggtcgtacctaaggtcccgtacggccttaacccncggttaacccgcccttacccgtcgaacctacgtacgcggttacgggcctaccgggtacgtacgggacgtacgcgggaccttagggtaacttaactttacgtcgggttcaaccgtttacacccgggtagggaaccctaaccgaaagttaccggttggaaattacggtaaactcgtaccgtaacgggtgggttaacccgggtttaggggtcgttacccggggttaacgggaaccggtaaccgttaaaccgtcccgggttaaccggttaccggtagttaacccggg

SEQ ID NO: 25347 - DNA, 664 bp, Homo sapiens
  misc_feature: GYAE6OF02GSUWO.21.22.B11.1.454.CMB.1.raw
  modified_base (308)..(308): a, c, t, g, unknown or other
  misc_feature (308)..(308): n is a, c, g, or t
  modified_base (322)..(323): a, c, t, g, unknown or other
  misc_feature (322)..(323): n is a, c, g, or t
  modified_base (331)..(331): a, c, t, g, unknown or other
  misc_feature (331)..(331): n is a, c, g, or t
  modified_base (499)..(499): a, c, t, g, unknown or other
  misc_feature (499)..(499): n is a, c, g, or t
  modified_base (537)..(537): a, c, t, g, unknown or other
  misc_feature (537)..(537): n is a, c, g, or t
  modified_base (546)..(546): a, c, t, g, unknown or other
  misc_feature (546)..(546): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccccgggcgaggagggtcaccatctcttgttcgtggaggcactaccaacagtcggaagttaatatgtatctgtatcagccactccagatcgaccccaactccncatccgagagatannacgcgccncgcggtcctgaccgtactcgtcgtcgtacctacctaacgtcgtacggcctacccgtaccgtaccgcccccttacccgtacggaacccctagtaccgtaacggggtccgggtcccgttacccgggtacccggaggtcgtaggacgtccgttagaaccttagtttaccgngtacgacctacgtcccgggaagggacccagtaaacggngtagggtanaccgtaataccggttccaggggttcgggttaccggggttacgggtttcgggacccgggtgggtaaaaccgggcccttaaaaccggtcccgggacccgtttaccggtaggtaaccccgg

SEQ ID NO: 25348 - DNA, 400 bp, Homo sapiens
  misc_feature: GYAE6OF02JV0TG.21.22.B11.1.454.CMB.1.raw
  modified_base (159)..(159): a, c, t, g, unknown or other
  misc_feature (159)..(159): n is a, c, g, or t
  modified_base (257)..(257): a, c, t, g, unknown or other
  misc_feature (257)..(257): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
  modified_base (335)..(338): a, c, t, g, unknown or other
  misc_feature (335)..(338): n is a, c, g, or t
  modified_base (340)..(400): a, c, t, g, unknown or other
  misc_feature (340)..(400): n is a, c, g, or t
tcagtcgtcgctcgcacgaccggtgctcgatttagacgacagctcagggggtccctgaccgattctctggctccaagtctggcacctcagcctccctgaccatcaggtgggctccggtccgaggatcgaggctgactattactgtgcatcgacgggacncaacagtgggatgacatctggagtcggtggtgtcggcggaggaccaagtcgaccgtcaggtccagccgagctccgccccgtggtccagtctcgtcccnccttcctcgtcctcgtctctcggacggtcggcgtcgacgaaggcgtaccaagtcgnagctagcancgtagnctagcgnnnngnnnnnnnnnnnnnnnnnnnnnnnnnnnnnnnnnnnnnnnnnnnnnnnnnnnnnnnnnnnnn

SEQ ID NO: 25349 - DNA, 805 bp, Homo sapiens
  misc_feature: GYAE6OF02FWUEF.21.22.B11.1.454.CMB.1.raw
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgttattctggtatcagcactccaggatcggaccccaactcctcatccagagaatagtcacgcggcctcgacgggtccctgacctattctcgtcggctaccgagttcctggccacctccacgccccttacccgacgtaccctacttcgacggttcgggtccttacccgggtcccggtaaggacgttaggaccgggtactacggtaaccgttagttttaaccgtcggttacgaccgttacgtaccgggtaaaccgggacgttaaaccgaaaaaggtcggggtaactacggtaacctaaagttccgagggtaacgggtcggggtttggggttaccggtacggggtaccgggtaacggaacccgtaacgtccggtacccggttaccggtacggtaccgtaaccgtaccggtaaaccggtcccgttaccccggaaccccggtttccgggtacccgtaacccgtttcccggtttccccggttacccccgtcccggtttacccttccccggtttacgttcccgttaccgttacccggtttagggaaccggttaccgggtaccggttcgggtaaaccggaaccgggtaccggttacgtaaacggtccggttaacgcggtacctggtcctaggtcgcgttacgcgtcggtacagtcgg

SEQ ID NO: 25350 - DNA, 853 bp, Homo sapiens
  misc_feature: GYAE6OF02G1KAW.21.22.B11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagacgacagctcaggggggggaagctcagcttcagctgtggtagagaagacaggactcaggacaatctccgagcatcggccggtcttccctctcctcctcaccctcctcactcactgcgcacgggtcctcgggaccagtctgtcgctacgactcgacgcctacctcacgtcgtcgtcgggaccccggnaggacggtacacctatcgttcgttgtccgtggacgtaccaacgtccaaagtacgtacggtaaattaagttacgtcgttaacgttcgtaggtactacgacggtactaaccgtacccgaaggtaacgtcccggtaaccccctaaaacttcctactacctaccgaaaggtaacggtaaactaacgcgtacggacccggtacctacgggtaccggggttcccaacggtaccgtttaacttccgttaccggtacgtaccgttaacgtaacggtcgtacgaccctacgtaccgccgtaccctaccgtacgtacaacggttcgacgggttccggccgttaccgggtacggagtacgtacggacgtcgtacgttaaccgttagttaacgtcggtacgaaccgtaacggttacgggtaaacccggacggtaaaccttacggggtacgtaacggtaaccgttagaacccggttaacgttaccgggtaccggggttaacggggtttaccgggggttttcccggggtttaaaccgggtttacccgggggaaacccgggggttaaaacccgggaacccgttttaaaacccgggttaccccgggggttaaacccttttaccggggggttaaaccgtaacccccggg

SEQ ID NO: 25351 - DNA, 720 bp, Homo sapiens
  misc_feature: GYAE6OF02F2WTZ.21.22.B11.1.454.CMB.1.raw
  modified_base (217)..(217): a, c, t, g, unknown or other
  misc_feature (217)..(217): n is a, c, g, or t
  modified_base (622)..(622): a, c, t, g, unknown or other
  misc_feature (622)..(622): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgcgcagggtcctgggcccagtctgtgctgactcagccaccctcacgtcgtcgtcggggaccccccgggnaggacgggtcaccatctcttagttcgtggacggcaacctccaacagtacggaagttaattatgttattcgttaggtatcgtagaccaacctcccgaaggtaacgtcccggaccccctaaacctccctacgtactaccgaaggaaacggtaaacttaacacgacggcccggtccctacggtaccggggtccctacggtaaccgtacttccgtcggttaccggccgttacccgacggttccgtacggacctaaccctccgtaccggtccccttaccctacgaccctagtccggtagggtccgggtacccgttcccgggtaccgagggtacgtcgggacgtccgttacggtaccttaatttcgtagtaccgtgtaaccgtccggaaccgggtaaccagaaccgtaggnggtaactacggactactcgtagggtcggtacggtttgggtcggttacggggacgggacggtaacccaaggttccggaccggttacgttaccggaaccg

SEQ ID NO: 25352 - DNA, 756 bp, Homo sapiens
  misc_feature: GYAE6OF02GULE6.21.22.B11.1.454.CMB.1.raw
tcagtcgtcgctcgcacgaccggtgctcgatttagacgacagctcagggggggggggaagctcagcttcagctgtggtagagaagacaggactcaggacaatctccagcatggccggcttccctctcctcctcaccctcctcactcactgcgcgacgggtcctcgggcccagtctgtcgctgactcacgcccaccctcagtccgtcgtcggggacccccggcgaggacgggtccaccacttcttcttcggttcgtgggacggaccaacctaccaacgtacgtaccggtaaagttaatttagttagttaacttcgtaggtaactacgaacgacctaacctacccgtaacggaacctacccggaaccccctaaaccttccctactaacctaccgaaggaacggtaaacttaacgtaccgacggcccggtacccgtaccgggtaccgggttcccgtaccgtaccgtacttccgttcgtacggtacctaaccgttacggtcgtaccggaccctaccgtaccgtacccgtcccttccgacccgtaacctacgttaccggtacgggtccgggtacccgtaccggggaccggtacgtacggtacggtaccggtacttaacgttacttacgttacgtgtacgaccgtaacgacggtaccggactaacgtagacggtaggtacagtaaccgtgtacgtggttaccggtgggtttcggcggtacggtacggaaccgtacggtacgcccgttacggtacgtacgtcg

SEQ ID NO: 25353 - DNA, 677 bp, Homo sapiens
  misc_feature: GYAE6OF02JBIB4.21.22.B11.1.454.CMB.1.raw
  modified_base (329)..(329): a, c, t, g, unknown or other
  misc_feature (329)..(329): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccccgggcagacgggtcaccatctcttgtctggagcaactccaacatcggaataattatgtattctggtatcagcaactccgagactcggacccccaactcctcatccaagaaggtaaataacncgacgccgccctacgacggggttcccctagaccgtacttccgtccgtacggtcctaccaacgttctcggccctacctcgaacgtccctccttacgaacctataccgacggtcggggtccctacccgggtaccgaggacttcggacggtcttacgtaaccgtttacttacggtcgtaccgtacgtaacttacccggaaccgggggacctacgaaacgtggtagggaacctaggaaactacgttgtacgggtacggttccggggtttggggtaccggttacccggggaacgggtaaccgggtaacccgtaaacccgggttggaaccccggttaccggtaacgggtacccg

SEQ ID NO: 25354 - DNA, 399 bp, Homo sapiens
  misc_feature: GYAE6OF02HWBI5.21.22.B11.1.454.CMB.1.raw
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
  modified_base (333)..(335): a, c, t, g, unknown or other
  misc_feature (333)..(335): n is a, c, g, or t
  modified_base (337)..(399): a, c, t, g, unknown or other
  misc_feature (337)..(399): n is a, c, g, or t
tcagtcgtcgctcgcacgaccggtgctcgatttagacgacagctcagggggtccctgaccgattctctggctccaagtctggcacctcagcctccctgaccatcagtgggctccggtcgaggatgaggctgactattactgtgcatcgacgggacgcaacatgggatgacaatctgagcgggtttggtgttcggcgggagggaccaaactgaccgtcgtaggtcacgcccaaggcctcggccccctggtcactctcgttccccacctccttcctcgtctctacgtgacggccggtgtcggaccgaacgggccgactaacgtagcngcncgatnnnannnnnnnnnnnnnnnnnnnnnnnnnnnnnnnnnnnnnnnnnnnnnnnnnnnnnnnnnnnnnnn

SEQ ID NO: 25355 - DNA, 820 bp, Homo sapiens
  misc_feature: GYAE6OF02JKPMB.21.22.B11.1.454.CMB.1.raw
  modified_base (544)..(544): a, c, t, g, unknown or other
  misc_feature (544)..(544): n is a, c, g, or t
tcagtcgtcgctcgcacgaccggtgctcgatttagacgacagctcagggggggggaaggcgtcagcttcagctgtggtagagaagacaggactcaggacaatctccagcatggccggcttccctctcctcctcaccctcctccacctcactcgcgcacgggtccgtcgggcccagtctgtgcgtgactcacgccaccctcagcgtcggtccgggacccccgggcgacggacgggtccacctactccttcgttagttccgtgggacggtaccgaaacctccgaaactacgtaccggtaaagttaaatttacttaggttaactttacgttaggttaacttaccgacgtacctaaccgtaccccgaaggtaacgtcccggtaacccccctaaaaccgtcccttaccgaactacccgaacgggtaagaaacttaagtaccacgggtacccggtccctacgggaccgggtaccctacggaaccgttactccgtcgtcggtcctaacgtacgtcgtcggaccaccgtcgactcccgtacctacgaccctntacgtcgggtacgggccgttacccgggtacggtagggacttacgggtacgggaccttaggtaaccttacggtttaccgtagggtacgactaacgtccccgggtaaggggacccgaactaacgttaacgggcggggtaacttaccgaaaccgtttagtaccggtagggtaccggggtttaggggttcccggggttacggggttacggggaacccgggaaaggggttaacccccaaaaggtttccccgggaacccgggttttaaccgtaggtaccccg

SEQ ID NO: 25356 - DNA, 701 bp, Homo sapiens
  misc_feature: GYAE6OF02HJNR4.21.22.B11.1.454.CMB.1.raw
  modified_base (218)..(218): a, c, t, g, unknown or other
  misc_feature (218)..(218): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
tcagtcgtcgctcgcacgaccggtgctcgatttagacgacagctcgagggggggggaagctcagcttcagctgtggtagagaagacaggactcaggacaatctccagcatggccggctttcccctctcctcctcaccctcctcactcactgcgcgagggtcctcgggcccagtctgtgctgactcagcccacctcagccgtcgacgggacccccggtnaggaggtccacctatccttcttgttccgtagggacgctaaactcccaaagagtacggaagttaattatgttaacttctaggtatcagaccactacccgagactcggacctaccaacctcctacactaccaagacgtaaanatcgacgccgtccnggacggtcccgtactacgtacttccgttacgcgtccgtacgtaacgttcgaccggacctaccttccgaaccgcccgttcccgttacaccgttacacggtacggtcgggtcccgtacccgggtacggaacggtcgtaggtcggtcttacggtaactttaccgtagtcggtcgtacgtacgtaccggaacggtaccaacgtaacgtagtacgggtacgtacgtaacgtacggttacggtaaggtcgggttcgggttttaacgggcgggttaccggggtacgggtaaccggaaaccggttaaccgtaccggtaccggttaccgtaaccgggg

SEQ ID NO: 25357 - DNA, 684 bp, Homo sapiens
  misc_feature: GYAE6OF02FRQ64.21.22.B11.1.454.CMB.1.raw
  modified_base (150)..(150): a, c, t, g, unknown or other
  misc_feature (150)..(150): n is a, c, g, or t
  modified_base (215)..(215): a, c, t, g, unknown or other
  misc_feature (215)..(215): n is a, c, g, or t
  modified_base (376)..(376): a, c, t, g, unknown or other
  misc_feature (376)..(376): n is a, c, g, or t
  modified_base (535)..(535): a, c, t, g, unknown or other
  misc_feature (535)..(535): n is a, c, g, or t
  modified_base (549)..(549): a, c, t, g, unknown or other
  misc_feature (549)..(549): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcncgagggtcctgggcccagtctgtgctgactcagccaccctcagcgtaccgtcggggacccccggnacggacggtaccaccattccgttcgttcgttcgtgggacggtacctaaacctaccgaaacgtagttaccggaaagttaattacgtgttacgttacgttaggtactacgacgtacctaaccgtacccgaaggaactccgggaacccccctaaacgtccctanaacctaccgaaggacgtaaataacgtcgaacggccggtccctacggtacggggtccctacggaaccgttacttcgtccgttcggtcctaacgtacgtccgtagcctaccgtcgacgtccctcgtacgacctagtcgtacgtcggcctccgggtacaggntacggcgtcgttanaccttagtctggcaacgcgtacggacggactacgaacgtgtacggtaataccgtaatacgtcggtaggtcggtcggggttaaggtccggtacgggacggtacgtaacgtaaccggtccgaccgttagtacgggac

SEQ ID NO: 25358 - DNA, 733 bp, Homo sapiens
  misc_feature: GYAE6OF02FJ2RU.21.22.B11.1.454.CMB.1.raw
  modified_base (58)..(58): a, c, t, g, unknown or other
  misc_feature (58)..(58): n is a, c, g, or t
  modified_base (194)..(194): a, c, t, g, unknown or other
  misc_feature (194)..(194): n is a, c, g, or t
  modified_base (216)..(216): a, c, t, g, unknown or other
  misc_feature (216)..(216): n is a, c, g, or t
tcagtcgtcgctcgcacgaccggtgctcgatttagacgacagctcagggggggggaanctcagcttcagctgtggtagagaagacagggactcaggacaatctccagcatggccggcttccctctcctcctcaccctcctcactcactgcgcacgggtcctgggcccagtctgtgctgactcagccctaccctnagcgtcgtcggggacccccggnacggacgggttccaccacttcgtcttcgttactgggacgcctaacctccaacagtaccgggaaataattattgtacttcgtggtaactcacgacaacctcccaggactcggaccccaatcctacactccagaacgaactatcgacgccggtcctcggaccgggtcctacgaccgtacttctcgcgcctaccgaagtccgtacggtccctaccgtcgaccgtccctcccgtacgacctaccgtcgtaacgggtccggtcccgtacccggggtaccgaaggtacgttccgggacggttactacggttaacccctttagtaccgttccggtaacgttccgtaaccgtacccggggtaaaccggtaaccgaaaccgtttaaccgacgttaaaggggtaccttaaccgaaccgttacggttccgaacggggttcggttaccgggttacggggtaggttacccgggacgggtaaccggaaaccctaaccgggtccggtaacccgttacggtaccggtaacccg

SEQ ID NO: 25359 - DNA, 781 bp, Homo sapiens
  misc_feature: GYAE6OF02JME80.21.22.B11.1.454.CMB.1.raw
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtacgtcggggacccccggnaggcggtcacctntcctcttgtcgnggacgctaactccaaacncgtacggtaagttaattagtagttactttacgtaggtacttcgagaccgtaaccctaccgaacggaacgtacccggtacccccaaaaccttccctacgtaacgtacccgaaggtaaacgggtaactaacgtacccacggccccggtaaccccgtcgggtaccggggttcccgtaccggtaccggttacttccggttacgtaccggtacccgttaccgtaaccggtttccgaccggtcccgtaacccgttaccgacccgttcccgttacccgtacgtaaccctaccgttcgggtacgggtccgggtccgttacccgggtacggagggttagtcgggtacgggtcttacggtaacctttaattaccggtcgtacgtacgtaacggtaccggacgggtaaccgactaacgtggtacggaagtctaaccgtacgttccgggtaggtacgggttggggttcggttacggtaccgggtacgggaccggtaacctaaacgggttccggaacccggttacgacggtacccgg

SEQ ID NO: 25360 - DNA, 799 bp, Homo sapiens
  misc_feature: GYAE6OF02FNPNA.21.22.B11.1.454.CMB.1.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (671)..(671): a, c, t, g, unknown or other
  misc_feature (671)..(671): n is a, c, g, or t
tcagtcgtcgctcgcacgaccggtgctcgatttagacgacagctcagggggggggaagctcagcttcagctgtggtagagaagacaggactcaggacaatctaccagcatggccggcttccctctcctctcaccctcctcactcactgcgcagggtcctcggccagtctgtgctgactcacgcccacctnagtcgtcgtccgggaccccggnaggtacggtccaaccgtattccgttcgttacgttccgtgggacgccctaaccgtaccaacgtagtacggtaaaggtaactttagtcgttagttacgttaggtactcgacgtacctaaacccgtccgtaagggtaccgtacccggtaaccccctaacgttccctaagaacccgttaccggaaaggacgggttaaataaccgtccgtacgggtacccgtaccgtaccgggtaccggtcccgttaacgaccgttacgtttccgtccgttacggtcccttaacggtacgttcgtaccgtctaaccgttccacggttcccctaccgtacgtacccgtagtccgtacgggttccgggacccgttcggacggtacggtgttacggaccgtcttaacgttacgttacgttacgtccgttacgtacgtaccggtaccgtacgggtacgacctaacggtgtaaccggtntaaccccgagttacctaccgggaacggttacgggttccggggtttacggtcccgggtaacggggttcgttaaacccggggaacctttaaccgggtaacccggttcggttacccggtaagtaccccggg

SEQ ID NO: 25361 - DNA, 674 bp, Homo sapiens
  misc_feature: GYAE6OF02JK6AW.21.22.B11.1.454.CMB.1.raw
  modified_base (214)..(214): a, c, t, g, unknown or other
  misc_feature (214)..(214): n is a, c, g, or t
  modified_base (316)..(316): a, c, t, g, unknown or other
  misc_feature (316)..(316): n is a, c, g, or t
  modified_base (371)..(371): a, c, t, g, unknown or other
  misc_feature (371)..(371): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggnaggacgggtccaccattcctcttggttcgtggacggcaactccaacatacggaattattatgtattctggtatcagcaactccagatcggaccccaactccncactccaggagaatactcgacgccgtacctcgacggggtaccacgaccgtattcncgtcggcctacagtcgtcggtcctaccgtcacgtccctccgtacgccaagtccgacggtcgggtaccgtcccggggttaccggaaggtagtgggccggtacgttacgtaacttacttaccggtgtcgactacgtaccgggaccggtacgaccgtaaagtacgggtagggaacttcgaaaccgtagttcgagggtttaaccggggtcggggttttacggggtccgggttaacccgggggacggtaaaccggggtaacccttaaacgggttccccgggtacccggttacccgtaggtaacccggg

SEQ ID NO: 25362 - DNA, 656 bp, Homo sapiens
  misc_feature: GYAE6OF02JMEZD.21.22.B11.1.454.CMB.1.raw
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
tcagtcgtcgctcgcacgaccggtgctcgatttagacgacagctcaggggggggaaggcgtcagcttcagctgtggtagagaagacaaggactcaggacaatctccagcatggccggcttccctctcctcctcaccctcctcactcactgcgcagggtcctgggcccagtctgtgctgactcagccctaccctcacgcgttctacgggggaccccccgggtaggacggggtccacccgattccttccttggttcctgggacggccaactcccaaactgtcggaagtaattatggtaattccgtggttatctagccaacggtcccaacggaactccggacccccaaacgttcctacgactccagtacgtaatatccgacgcgacctcgacgggtcccnggcctntcctcgtgacctcacgtncggtaccnccctagcctcctcccgtacgccactcgacggtacgccgtccggtacggtacggacttggacgcgtacgtacgtacttcgtgtcgtacgactcgaccggggaacgtacgacggtaagtcccgggtatacgggaactacttgtacgggtacggttcgggtttcggggtcggttacccggggagggttacccggaagtacccgtacggacccgttccgttaccggtaccg

SEQ ID NO: 25363 - DNA, 852 bp, Homo sapiens
  misc_feature: GYAE6OF02HPEA5.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctgggcccagtctgtgctgactcacgcccaccctcagcgtcgtcgggacccccgggcaaggacggtccacctacttcctacttgttcgtagggacggaccaaaccgtccaaactacgtaccgggtaaagttaaatttatagttactttccgtaggttactccaacggacctaaacctccccgaaggtaacgtcccgggaaccccccctaaaaccttccctacaacctaccgaaaggtaacggtaaaacttaaacgtcgaaccgggtccccggtaccccgttaccgggtaccggggttaccccctacggaacccgttacgtttcccgttccggttacggtccctaaccgtaaacggtttccgtccggtaccctacccgtaccgtacccgttcccccttcccgtaaccggtaaccctacgttacccggacggggtttcccgggtacccggtttcccggggtaaccggaagggttaaccgtggggtaaccgtccgttacgtaaacgtttcgttacgttccggagtaccgtacgttacccgggaacgggtaccgtaactaaacgtacgggtaggtaacctcggaatacgttgggtaacgggtagggttccggggtttgggttaaccgggttacccgggaacgggtaaccgggttaacctaaacccggttgggtaaccccgttacggttaggaccccgg

SEQ ID NO: 25364 - DNA, 806 bp, Homo sapiens
  misc_feature: GYAE6OF02JZAX5.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcagggggggaagctcagcttcagctgtggtagagaagacagggactcaggacaatctccagcatggccggcttccctctcctcctcaccctcctcactcaactgccgcaggtcctcggccagtctgtgctagactcacgcccacctcaggcgtcgtcgggacccccggtnagagggtccaccgatctcttgttcgtcggaggccaactccgaactagtacggaagttaattagtgttacttcgtaggtatcacgtctaaccgtaccgaaggtactccggtaccccctaactcctactactaccgtaaggtaaggtaaactaacgtaccgacggtacccgtacccgtacggtaccggggtccccttaggacccgttagttccgtacgtcggtacctacggtaacgtccgtacgtacctacccgtaccgtaccgtcccgttaccccgttacgaaacccgttacgtaccgggtaaccggttccgggttaccccgttaacccggggacccggtaagggtaccttaggggaacccgttaccggttaccgttaaccgttacgtttacccggtagggttaaccccgttataaccccgggttcccgggaaccggggtaacctaccaaccggtttaaggacggtaccgtacgtaacgtaccttacggttaacggacggggttttaaccggtttggggaacccgggtttccgggaaacgggttaacggaacccttaaccggttaccgggacccgtttaccggtacggtaccg

SEQ ID NO: 25365 - DNA, 775 bp, Homo sapiens
  misc_feature: GYAE6OF02ITH7K.21.22.B11.1.454.CMB.1.raw
  modified_base (188)..(188): a, c, t, g, unknown or other
  misc_feature (188)..(188): n is a, c, g, or t
  modified_base (213)..(213): a, c, t, g, unknown or other
  misc_feature (213)..(213): n is a, c, g, or t
  modified_base (247)..(247): a, c, t, g, unknown or other
  misc_feature (247)..(247): n is a, c, g, or t
  modified_base (619)..(619): a, c, t, g, unknown or other
  misc_feature (619)..(619): n is a, c, g, or t
tcagtcgtcgctcgcacgaccggtgctcgatttagacgacagctcaggggggggggaagctcagcttcagctgtggtagagaagacgaggactcaggacaatctcagcatggccggcttccctctcctcctcaccctcctcactcactgcgcgaggtctgggccagtctgtgctgactcagccacctnaggcgtccgtacggggacccccggnaggacggtaccaccgattccgttcgttgttccgngggtacgacctaactccggtaacacgtaccggtaaagttaacttaagtacggttaactttacggtaggttaactacgaacggacctaaaccgttacccggtaaggaaaccgtaccccgggaccccctaaaaaccgttccctaccgtaactacccgaaaggaaacccgggtaaataaacgttaccgacggcccggtacccgtagggtaaccggggtttcccaggtacccgttacttacgtcgtaacggtccgtaacgtaacgtgttacggacctacggcctacgcctacccgtcggaaccctgtaccggtacggtcgggtcctaccgggtaccgaggtacgagggtccgtattccgtaacgttacgtttaacncgggtttacaacctacggacggtaaaccgggcgtaaccgtaaccgcgggttaaggaaccttacggaacgtacggtacctggggaccgttcggggttaagggtcgttaaccgggacggtaacggaacccttacggtcggtacccgtgtaaggtcccg

SEQ ID NO: 25366 - DNA, 788 bp, Homo sapiens
  misc_feature: GYAE6OF02HBY9W.21.22.B11.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgcgcgagggtcctgggcccagtctgtgctgactcagccaccctnagccgtcgtcggggacccccggnaggacggtccaccatctcgttgttcgtggacggacaacctccgaacagttacggaaagttaattagtgttaacgttcgttagggtacttcgaacggacctaaacccgttacccgaacggtaacgtccggaaccccccctaaaacggttcccctacactacccgtaaggaaggtaaactaacgtcgaaccgggtcccggtacccgtaccgggtcgggggttacccctaggtaaacccggttactttccgtacggttaccggtacctacccgttaaaggtcccgttacgggtaccctacccgttccgaaccgtcccctaccgaccggtaccaacgtccgtacggtaccgggtcccgttacccgggacggtaaggtacgtaggtacggttaccgtaggttaacctttacgttcgttagtacgccgttaacgtccggaaccgggactacgaagtaccggtggtaacgtacgtaacgtaacgtcggtaagggcgggttacggggttcggtacggggttaccgggaaccgggtacggtaaccggtacgtaccgggtacccgtacgggtacggtacccgg

SEQ ID NO: 25367 - DNA, 657 bp, Homo sapiens
  misc_feature: GYAE6OF02GLZH8.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccggnagaggtcaccgatctcttgtctggagcaactcaacatcgagtattatgtattctggtatcagcactccaggaactcggaccccaaacgtcctacactccagaggataaactcagcgacctcgacgggtcctgaccgtattcctactggctcgaagtctgccactcacgtccctcccgtacaccgtactcgtaggtcggaccgttccgggtacccgaggtactacgggtaggccttaggaccgtttaagtaccgtgggtttacgactaacggttaccggaaccgggggtaaccgacccttaaaaccggtacggtaggggtaaacctcggtaaaccgtagttcccggtaggaaacgggtttccggggtttagggggtcgtttcccggggtaaggggaaccgggtaccgtaaacggttcccgggtaaccttcccggttaaggtaccccggg

SEQ ID NO: 25368 - DNA, 861 bp, Homo sapiens
  misc_feature: GYAE6OF02HLYNM.21.22.B11.1.454.CMB.1.raw
  modified_base (215)..(215): a, c, t, g, unknown or other
  misc_feature (215)..(215): n is a, c, g, or t
  modified_base (718)..(718): a, c, t, g, unknown or other
  misc_feature (718)..(718): n is a, c, g, or t
  modified_base (854)..(854): a, c, t, g, unknown or other
  misc_feature (854)..(854): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcgagggtcctgggcccagtctgtgctgactcagcccacctcaggcgtcgtcggggacccccggnaggacgggtccaccgtatccttcgttgttccgtagggacggacctaaccgtacctaaacgacgttaccgggaaaaggtttaatttaagttacggttaacgttttaccgttaggggttaaccttacgaacgggtaccctaaaccccgttaccccggaaacggggtaaaaccggttacccccggggaaacccccccccttaaaaaccgttccccctttaacccggtaaaccgttaccccggaaagggtaaaacggggttaaaattaaaccggtaccgtaaccgggtccccgggtacccccgttacggggtaacccgggggttccccttacgggaacccggttactttcccgtaccgttacgggtccctaccgtaacgttccgtcggtaccaaccccgttcgacccggtccctacccgtacgaaccctagtccgtaacggggttccggacccgtttccgggtaccggaggtcgtacgggacgtctaacggtctttacgttaccggntacgtaccgtaggtaccgaacggggacacgtaagtggttacggaattaacggactagttccgtagggtaacggttcggggttcggtacggtccggggagtaaccgggtaacctacggtacccggtacggttaccgnggtaccg

SEQ ID NO: 25369 - DNA, 653 bp, Homo sapiens
  misc_feature: GYAE6OF02IV1R5.21.22.B11.1.454.CMB.1.raw
  modified_base (640)..(640): a, c, t, g, unknown or other
  misc_feature (640)..(640): n is a, c, g, or t
  modified_base (644)..(646): a, c, t, g, unknown or other
  misc_feature (644)..(646): n is a, c, g, or t
  modified_base (648)..(649): a, c, t, g, unknown or other
  misc_feature (648)..(649): n is a, c, g, or t
  modified_base (651)..(653): a, c, t, g, unknown or other
  misc_feature (651)..(653): n is a, c, g, or t
tcagtcgtcgctcgcacgaccggtgctcgatttagacgacagctcagggtcctgggcccagtctgtgctgactcagccaccctcagcgtcgtcgggaccccgggcagagggtcaccatctcttgttctggaggcaactccaacatcggaagtaattatgtattctggtatcagcaacctcccaggaatcggaccccaaatcctcatccagagaataatcagcggccctcgacgggtccctaggaccgtattctcgtggtcctccaagtcgtcggccaccctcaccgcccttcccacgaaccctactccgtaagggtccggggtcccgttcccgggtaccggagggtacgttgggacgtcttacggaactttattacgttgtcactacgtacgacgggcgacaaacgagtacgggatacggaactactcggtaggtacggggtcggggttgggttacgggtccggggaggggaaccggtaaccgtaaacgtacggtaccggtacggtacggacgtaccggaccgtaccgtccgcccggtaccccgtcgtcgtaccgtccgttcccgtccccgtcccttcccgttcctccgttccctaccgtcggtacgccggtcgggccgcgaccgaccgcgcacgtgcantgcnnncnncnnn

SEQ ID NO: 25370 - DNA, 862 bp, Homo sapiens
  misc_feature: GYAE6OF02HGRX9.21.22.B11.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcacctcactgcgcagggtcctgggcccagtctgtgctgactcagccctaccctcacgcgtaccgtcggggaccccccggnaggacgggtccaccgtatccttcgtttcgttcgtaggggacgacccgaacctccaacaacgttacggaaagttaagttacttagttacttcgtaggttaacctcgtaacgacctaaccgtacccgtaagggtaaccgtcccggaacccccctaaaacgtccctaacgtacctaccgaaggtaaacgtaaactaaacggtccgaacggtaccccggtcccgttaccgggtaaccggggttacccctacggtaaccccgggttatttaccccggttcgtaccggtaccgttaaacccggtaacggtttacccggtacgggtaaccccgtcccttaccggtaacccgttcccccgttaccccgtacggtaccctaacgttccgggtaccggggtcccgggtacccggttacccggggttaaccggaacgtacggtacgggacggttaccgttacgtaaccttaacgttacgtggtacgtacgtaccgtacggaaccgggttacaccgtaacgttgggtaacggtacgttaccgaagttaccgtacggtcgggtaagggttccgggtttagggtccggttaccggggacggtaaccggttaaccgtaacggttcccgggttaaccggaccgttacgggtaacccgg

SEQ ID NO: 25371 - DNA, 692 bp, Homo sapiens
  misc_feature: GYAE6OF02GHRP8.21.22.B11.1.454.CMB.1.raw
  modified_base (212)..(212): a, c, t, g, unknown or other
  misc_feature (212)..(212): n is a, c, g, or t
  modified_base (363)..(363): a, c, t, g, unknown or other
  misc_feature (363)..(363): n is a, c, g, or t
tcagtcgtcgctcgcacgaccggtgctcgatttagacgacagctcagggggggggaagctcagcttcagctgtggtagagaaggacaggactcaggacaatctccagcatggccggcttccctctcctcctcaccctcctcactcactgcgcacgggtcctgggcccagtctgtgctgactcagccaccctcagcgtcctgggacccccggnagagggtcaccatctcttgtctggacgcaactcaacatcggaagttaattatgtattctggtatcagcaactcccaggaactcggaccccctaaactcctactactccaagaagtaactaatcagccgccctcgacggggtccctgacctnttcgtctcggtcctccgaacgttcgtcggaccacctacgaccgtacccttcccgtacgaccctaactcggtaacggtcggggacccttacccggggtaccgaagggtactacgggtacggtcttaggtaacccttaagttaccggttaggtcgactaacgttaccggaacccgggacgtaacccgaacgtaggttacgggaactaggaacctaagttccgaggtaaccgggttcggggttttacgggggtacggtttccggggaaccgggttaacgggaacccgttaaaacggcccgggtttaacccgttaccggttaaggtaccccgg

SEQ ID NO: 25372 - DNA, 675 bp, Homo sapiens
  misc_feature: GYAE6OF02F7AL7.21.22.B11.1.454.CMB.1.raw
  modified_base (59)..(59): a, c, t, g, unknown or other
  misc_feature (59)..(59): n is a, c, g, or t
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
  modified_base (433)..(433): a, c, t, g, unknown or other
  misc_feature (433)..(433): n is a, c, g, or t
  modified_base (573)..(573): a, c, t, g, unknown or other
  misc_feature (573)..(573): n is a, c, g, or t
tcagtcgtcgctcgcacgaccggtgctcgatttagacgacagctcaggggggggggaanctcagcttcagctgtggtagagaagacaggactcaggacaatctccagcatggccggcttccctctcctcctccaccctcctcactcactgcgcacgggtcctgggcccagtctgtgctgactcacgcccaccctnagcgtcgtccggggacccccggaggcgggtcaccntccttcttgttactggacgtacaacctcaaactgtacggtaagttaattatgtattcgtggtactacacacaacctaccgagaactccggaccccaactcctacactcgaagaaggtaatactcgacgtccggtacccgtcggtaccggggtcccacgaccgttacttcgtcgtcggtcttaccgaacgtcgtaccggtaccncctaccgtcgccctcccacgacctacgtcgtacgggtccgtccggtaccggtaccggaggtacgacggtcggtaccttaggtaccttaagttccgtggtaccgacgtaccgtaccgggaccgggaacacgaaaccgtggnggtaacgacgtaatacgtaggtacgggtacgggttcgggtgggttaccggtacgggaccgggtacggaaccgtaccggtaccgtccgtacggtacgacccgg

SEQ ID NO: 25373 - DNA, 718 bp, Homo sapiens
  misc_feature: GYAE6OF02HCBW7.21.22.B11.1.454.CMB.1.raw
  modified_base (143)..(143): a, c, t, g, unknown or other
  misc_feature (143)..(143): n is a, c, g, or t
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (692)..(692): a, c, t, g, unknown or other
  misc_feature (692)..(692): n is a, c, g, or t
  modified_base (718)..(718): a, c, t, g, unknown or other
  misc_feature (718)..(718): n is a, c, g, or t
tcagtcgtcgctcgcacgaccggtgctcgatttagacgacagctcaggggtcctgggcccagtctgtgctgactcagccaccctcagcgtctcgggaccccgggcagagggtcaccatctcttgtctggaggcaactccaacntcggaagtaattatgtattctggtatcagcaactccaggatcggaccccaatccnatccagagaatangagcgcctcgacgggtcccngaccgtnttctcgtggcctaccgaagtctcggcacctacgactcccgtccctggacctagtcgacggtcgggcccttcccggggtaccggaggacgtacgggacggtcgtacggtacctttaagtttccgtagggtcacgtacttaccgggaaccgggtaccggtaactaaacgtacggtcggggtactaacggaacctaagtttaccggtaggttacggggtaccggggtttgggggtttaccgggttaccggggacgggtaaccggggtaaacctaaccggtacggtacccggtaccgttacggtaccggtcgaaccgtcggtcccgtacccgtccccggttacgtccttaccgtccttacccgtccctacccttccgttaccgtacctccgtacctacggtcgtacggtccggtcggtacggtactaccggggtctacggtacgtcggcgtcgacgtnacgtcgtcggaccttagcgatacgtn

SEQ ID NO: 25374 - DNA, 701 bp, Homo sapiens
  misc_feature: GYAE6OF02I0ECB.21.22.B11.1.454.CMB.1.raw
  modified_base (616)..(616): a, c, t, g, unknown or other
  misc_feature (616)..(616): n is a, c, g, or t
  modified_base (683)..(683): a, c, t, g, unknown or other
  misc_feature (683)..(683): n is a, c, g, or t
  modified_base (687)..(687): a, c, t, g, unknown or other
  misc_feature (687)..(687): n is a, c, g, or t
  modified_base (697)..(697): a, c, t, g, unknown or other
  misc_feature (697)..(697): n is a, c, g, or t
  modified_base (700)..(700): a, c, t, g, unknown or other
  misc_feature (700)..(700): n is a, c, g, or t
tcagtcgtcgctcgcacgaccggtgctcgatttagacgacagctcagggtcctgggcccagtctgtgctgactcagccaccctcagcgtctgggaccccggggcagagggtcaccatctcttgttctggaggcaactccaacatcggaagtaattatgtattctggtatcagctaacctcccaggaactcggacccccaaactcctcacgtccagaagggaataatcacggccggccctcgtacggggtccctggacccgtaattctcgtcggctacctaacggtctgggccacctcacgcccctccctagcccaatcgagtacgggcctcccggtcggtagacgttggacggtacctagtacgtaacctttacgtgtcgactacgtccggaaccgggccgaactaactaagggtacgaacgtcgaactaacgtttaggtcgtaaaggggtccgggtttgggtcgggttaccgggacgggggaaacgtaacccgtaaggtaccgttaccggtaccggttacggtaccgacgtaccgaacggtcgtccccgttccgttacggtcctaccctcgttcccgtaccctccccgttacgtcctacccgttctaccggtacnccgggttaccgggccgttacggtaccggagttaccgacggtactacgtaccggctaacgcttgacgngcgntacgcgtacnggng

SEQ ID NO: 25375 - DNA, 770 bp, Homo sapiens
  misc_feature: GYAE6OF02GVJ3X.21.22.B11.1.454.CMB.1.raw
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (334)..(334): a, c, t, g, unknown or other
  misc_feature (334)..(334): n is a, c, g, or t
  modified_base (750)..(750): a, c, t, g, unknown or other
  misc_feature (750)..(750): n is a, c, g, or t
  modified_base (760)..(761): a, c, t, g, unknown or other
  misc_feature (760)..(761): n is a, c, g, or t
  modified_base (764)..(764): a, c, t, g, unknown or other
  misc_feature (764)..(764): n is a, c, g, or t
  modified_base (767)..(767): a, c, t, g, unknown or other
  misc_feature (767)..(767): n is a, c, g, or t
  modified_base (769)..(769): a, c, t, g, unknown or other
  misc_feature (769)..(769): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccgaggaatcggacccccaaactcctcatccagagataatcagcgccctcgacgggtcccngaccgattcncgtcggcctaccgaagtctggccacctcacgcccttcccagtacccagtccgacggtcggggaccttccgggtaccggaggtacgnggacggtctacgtacttatttacgtgtcgctacgtccggaacgggaccgaacgtaaaagtggggaatcggaactaacgtcgttagggacgggtttcggggtttggggtacggtttccggggacgggtaaacgggtacccgtaaaccggttaccggtaacccggtttcccgggttaaccgggttaccggaacccggtaccggtaaacccgggtcccgttccccggtccccccggtaccgggttacccgttaccccgtttacccgttcccgttaccccccttacccccgtttccccgtttcccgtttaccccggttacccttttacccgttacccggttaccgggtacccgggtcccggggtccgggttaccgggtacccgaacgggtccgtacccgtaagtccggcgtcgtcgacgngtctacgtcnncgncgngng

SEQ ID NO: 25376 - DNA, 746 bp, Homo sapiens
  misc_feature: GYAE6OF02HSHO1.21.22.B11.1.454.CMB.1.raw
  modified_base (102)..(102): a, c, t, g, unknown or other
  misc_feature (102)..(102): n is a, c, g, or t
  modified_base (138)..(138): a, c, t, g, unknown or other
  misc_feature (138)..(138): n is a, c, g, or t
  modified_base (721)..(721): a, c, t, g, unknown or other
  misc_feature (721)..(721): n is a, c, g, or t
  modified_base (727)..(727): a, c, t, g, unknown or other
  misc_feature (727)..(727): n is a, c, g, or t
  modified_base (742)..(742): a, c, t, g, unknown or other
  misc_feature (742)..(742): n is a, c, g, or t
tcagtcgtcgctcgcacgaccggtgctcgatttagacgacagctcagggtcctgggcccagtctgtgctgactcagccaccctcagcgtctggaccccgggnagaggtcaccatctcttgtctgaggcaactccaacntccggtaagtaattatgtattcgtggtatcagccaacttcccgaggaattccggacccctaaacgtcctcatcccaagacggaattaatcgaaggccggaccctacgcgggtccctagaaccgtgttacctcgttcggcctaccgaagttccgtaggcccaacccgttcgaccgtccgttccccgtcgaaccgtaacgtccgtacgggttacgggcccgtttccccggtaacgggaacggttacttcgggaaacgggttccttacggtaacccggtttaactttaacccggtggttacgacgtaacgtcccggtaaccggggactaccggtaaacgaggtttcgggacttaccggaactaaacgttcggtacggtaaggggtccggtttaagggtcccgttagggacggtaacgggaaccgtacgtacggtaccgtacgtgtccgacggtaccgacgtcgtcccaccggtcgtacctcgttccgttcccgtacccgaccttccgttaccccgtcgttaccgttacctacgttccgggaccgtcgggtccgttacggaccgggacgttcgaccgtagcgtaacnccgtanatcgatcgctagctnctag

SEQ ID NO: 25377 - DNA, 820 bp, Homo sapiens
  misc_feature: GYAE6OF02G1Y7J.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctcgggcccagtctgtgctgactcagccaccctcagcgtctcgggaccccggcagaggtcaccatctcttgttcgtggacgcaacctccaacatacggtaagttaattagtgttacttcgtggtactcacgacctaacctacccgaaggaacgtcccggaaccccctaaaccttcctacctacgtacccgaagggtaacggtaaaacttaacgtacgaacggtccccgggtaccccgttaccgggtacccgggggttacccctacgggtaacccgttacgtttccgttaccgtacggtacccgttaaccggtaacggttccgtaccgggtaccctacccgttccgaccgtcccccgtttaccccgtaacgtaccccttaaggtcccggtaacgggttcccgggtacccgttccccggggtaccggaacgggtacgtacgggacggtccgttacgttaaccttaacgttaccgtggtacgtaccgttaaccggtacccgggtaacccgggaacgtaaccgtaacggttaacggtacgggaataccgtaaggtacttgggtacgggtacgggttcggggttttgggtcgggttaccggggaacgggtaaccggttaacccgtaaaccggttcccgggtaacccggttaccggttaacggtcccgg

SEQ ID NO: 25378 - DNA, 776 bp, Homo sapiens
  misc_feature: GYAE6OF02H5OPJ.21.22.B11.1.454.CMB.1.raw
  modified_base (234)..(234): a, c, t, g, unknown or other
  misc_feature (234)..(234): n is a, c, g, or t
tcagtcgtcgctcgcacgaccggtgctcgatttagacgacagctcgagggggggggaagctcagcttcagctgtggtagagaagacaggactcaggacaatctccagcatggccgtcttcctctcctctcacctcctcactcactcgcgcgacgggtcctcgggaccctagtctgtcgctacgacctcgacgccctacctcgacgccgttcggtacccgggggaccccccgganaacggggtacggtcccaaacccgtattccgttcgtttaggttccgagggacggacctaacctaccaaagtacgtacggtaaaagttaattacgttagttagttcgaggttactacgacgtacctaaccgtcccgaaggtacctaccccggaaccccctaactccctacaacgtccggaaaggtaacggtaacttaacgccgtaaacggcccggtccgtaccggtacgggttcccacggtaaccgtcttcgtccgtcggtacctaacgtcgttaccgtcgaccctacccgtctacccgtcccttaccgtaccgtaaccgtacgttccgacgggtccgggtacccggtcccgggtacggagtacggtcggtacgtacgtacgtacgttacgttcgtcgacgtaccgtacggtacgaccggtacgaccgtaacgcggtacggtactacgactacgtcggtacgggtcgggttacgggttgggaccgggttacggaacgggtaccggaaccgttaccggtccggtaccggttacggacgtacccgg

SEQ ID NO: 25379 - DNA, 835 bp, Homo sapiens
  misc_feature: GYAE6OF02GUOJ2.21.22.B11.1.454.CMB.1.raw
tcagtcgtcgctcgcacgaccggtgctcgatttagacgacagctcgtagggggggggtaaggctcgagcttcgagctgtggtagaggaagtacaggactcaggacaatctccaggctagtcggggcccggtcttccctcctccgtcctaccacccctaccgtccaccgtccctacgttcgccgtccgtacgggttcccgtccgggtccctacgtccttggtcgcgttgacgtacgacgcccacccgtacgacggccgtcgtaccggggacccccggcaaggtcgggtccaccgtattccttcgtttcgtttcgtcgggacggaccgtaaacctaccaaacgtacgtaaccgggtaaaagtttaatttacgttagttaatttcgttacggtactaccgacgtacctaaaccctccggaaggtaacgtccccggaaccccctaaaccttcctacactaccgaggaagtaaataacgtcgacggtccggcccgttacggtaccgggtccctacgacgttacttaccgtccgtcggtaccttaccgtagtccgtacggtacctacctaccgtccgtccccgttaccgaccgtacctacgtccgtaacggtccgggtaccgtacccggttccgggaaacggcggttacgtcggtaccctttaggtaaccgtttacgttacgtcgtagtaccgtacgtaccgggaccggtacgaaccggtaagtgggttaacgacgtacgtactagtcgttacgggtaacggtttcgggtcgggttcgggtaccggtacgggtaaccgacggttaaccggtcccggttaacggtaccggttagaacccggg

SEQ ID NO: 25380 - DNA, 779 bp, Homo sapiens
  misc_feature: GYAE6OF02GQO0Y.21.22.B11.1.454.CMB.1.raw
  modified_base (214)..(214): a, c, t, g, unknown or other
  misc_feature (214)..(214): n is a, c, g, or t
  modified_base (257)..(257): a, c, t, g, unknown or other
  misc_feature (257)..(257): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctcgggcccagtctgtgctgactcagccaccctcacgcgtcgtcgggacccccgggnaggacgggtcaccatcctcttgttcgtggacgacaactccaancgtacggtaagttaattatgtattcgtaggtatcagcaaccgtccgaaggaacgtccggacccccaaactcctactacgtccgaaggaacggaactaacgtcgaacgccggtaccctcggtaccggggtccctacgaccgtacttccgtacgtcgtacctaccgaacgtcgtcggacctacccgtaccaccggtccccttacccgtacggtaaccctacgttccggaacgggttccgggtacccgttccgggtaccggtaacggtacgttcgggacgtcgttacggttaactttagttccgtagggttccgaccgttaacggttacccgggaacccggggtacgtaacgtaaaccgggtaggtaaccgggtaagttacgtaaccgttacgtaccggttacggggtaacggggtttccgggggttttacggggttacgggttaacccgggggaccgggtaaaccgggtaacccgttaaaccggttacccgggtaaccccggtttaccggtaccggtaacccgg

SEQ ID NO: 25381 - DNA, 560 bp, Homo sapiens
  misc_feature: GYAE6OF02FZ3U2.21.22.B11.1.454.CMB.1.raw
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (550)..(551): a, c, t, g, unknown or other
  misc_feature (550)..(551): n is a, c, g, or t
  modified_base (556)..(560): a, c, t, g, unknown or other
  misc_feature (556)..(560): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcatccagaggaataatcagcggccctcgacgggtccctgaccgattctctggcctccaagtctggccacctcagccctcctgaccatcaggtcggctccggtccgaggatggaggctgactatactgtncatcgacgggacncaacagttcgggatcgaactaatcgtaggaggcgggtttgggtggttccggggaggacgggaccaaacgtcggaccgtccgtaggtccgacgaccaacggcgtccgccccgttcgtcctacgtccgtccgttcccaccccttcctccttcgtcctctacgtcgacggccggctcggtccgacgggccgtacacgtggcngacngnntcgcnnnnn

SEQ ID NO: 25382 - DNA, 729 bp, Homo sapiens
  misc_feature: GYAE6OF02HS2ED.21.22.B11.1.454.CMB.1.raw
  modified_base (142)..(142): a, c, t, g, unknown or other
  misc_feature (142)..(142): n is a, c, g, or t
  modified_base (159)..(159): a, c, t, g, unknown or other
  misc_feature (159)..(159): n is a, c, g, or t
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
tcagtcgtcgctcgcacgaccggtgctcgatttagacgacagctcagggggggggaagctcagcttcagctgtggtagagaaggacaggactcaggacaatctccagcatggccggcttccctctcctcccttttttacccncctcactcactgcgcgngggtaaaccgtcgggcccagtctgtgctgactcagtcccaccctcagcgtcgtcgggacccccggnagacggtcaccatctcttgttctggngctacncaacagtcggtaatattagtgtattcgtgtatcagcacctaccgaagtactacggacccctaactcctactactacgagaaggtaactaatcgacgccggtacctcggtacggtccctcggtaccgtcgttctccgtcggtaccctacgtacgtcgtcggacccgtcctaccgtccgtccccttccacggtaccacgtcgtacgggtcggtaccgtcccgggtaccgaagggtctcgggaccggtgtaaccgttaacgttataccgttagggtcccaccggttaacgtacccgggaacggggtaccctaaccgtaaggttacggtagggtaacgtaacgtaaccgttaggttaccgtagggggtacgggttcggggttttaccgggggttcgggtacccgggggttacgggaacccgggtaaccgtaaacccgggtcccggtttaacccgggtacgggttacgaaccccggg

SEQ ID NO: 25383 - DNA, 691 bp, Homo sapiens
  misc_feature: GYAE6OF02GB5R9.21.22.B11.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
  modified_base (470)..(470): a, c, t, g, unknown or other
  misc_feature (470)..(470): n is a, c, g, or t
  modified_base (548)..(548): a, c, t, g, unknown or other
  misc_feature (548)..(548): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagngggtcaccatctcttgttctggagcaactccaactatacggaattaattntgttattcgtggtatcgancaacctccaaggaactccggacccccaaactccctactactccgaagaacggtaataactacgacgccggacccgtcggtaaccgggtccctacggaccgtactttcctccgtacggtccttaacccgaaggttccgtacgggaccctacccgttccgaaccgtccccctttacccgtacgtaaacccncgtacgtaacggtcggggtcccctaccggggtccggtaggtacgtggacgtcgttacgaacctttagttcctaggtcncgtacgtccggacggtacactaagacggtggaataccggaatacgtcgttaggcgggttaccgggtttagggtcgggtttacccggagggaacccgggttaactaacccgttcgggtaacccgttccggtaaggtacccccgg

SEQ ID NO: 25384 - DNA, 719 bp, Homo sapiens
  misc_feature: GYAE6OF02G887O.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagtaattatgtattctaggtactcagaccaacctcccaaggtaactccgggacccccctaaaacgtccctacaactcccaaggaaggtaaactaaatcaacggccgtcccgtcgacgggtccctcgaccgtacttctcgtgtcctacctaaggtctcggaccacccgttcgaccgtccccgtacccgtacgaaccctacgtccggtaacggggtccgggcccgttcccggggtaccgaagggtacgtgggaacggtccgttacggaaccttttaagtttacctagggttccgtaccggtaacgttcccgggaaccgggggaccctaaccgaaacggttacggtaggggacttaccggaacttacggtacgtagggtaaccgggttggggttacggggttcggttccggggaacgggaccgggttaaccaaccgggttcggaaccccggtttcgtaacgggtcccg

SEQ ID NO: 25385 - DNA, 734 bp, Homo sapiens
  misc_feature: GYAE6OF02ILSPZ.21.22.B11.1.454.CMB.1.raw
  modified_base (216)..(216): a, c, t, g, unknown or other
  misc_feature (216)..(216): n is a, c, g, or t
  modified_base (566)..(566): a, c, t, g, unknown or other
  misc_feature (566)..(566): n is a, c, g, or t
tcagtcgtcgctcgcacgaccggtgctcgatttagacgacagctcagggggggggggaagctcagcttcagctgtggtagagaagacaggactcaggacaatctccagcatggccggcttccctctcctcctccaccctcctcactcactgcgcagggtcctgggcccagtctgtgctgactcacgccaccctcagcgtcgtcggggacccccggnaggagggtccaccattccttctttgttcgtgggagccaactaccaacagtacggaaagttaattattgttattcgtggttatcagaccaaacctcccgaaggaacgtaccggacccccctaaaactcccgtacctactacccgaaggaacggtaaactaatccgacgtcccggtaccctacggtacccggggtcccgtacgtacccgttacttccgtcgtcgtcgtccgtaacgtcgtcgtaccacccgtctaccgtccctacccgtcgaaccctcgtaccgtacggtacgggtccgttcccgggtaccggtacggtagttcggacggtctcgttaacttacgtttacgngttaccgtacgtaccgtaccggtacggaccgtaacgacgtaaggtagggacgtaacgtactacgtacgttcgggtaacggttcggggttacgggttccgggttacggggaccgggtaacgggtaacctaacgggttcccggtaaccggttaccgtaccgggtacccgg

SEQ ID NO: 25386 - DNA, 771 bp, Homo sapiens
  misc_feature: GYAE6OF02IGR0B.21.22.B11.1.454.CMB.1.raw
  modified_base (394)..(394): a, c, t, g, unknown or other
  misc_feature (394)..(394): n is a, c, g, or t
  modified_base (529)..(529): a, c, t, g, unknown or other
  misc_feature (529)..(529): n is a, c, g, or t
  modified_base (663)..(663): a, c, t, g, unknown or other
  misc_feature (663)..(663): n is a, c, g, or t
tcagtcgtcgctcgcacgaccggtgctcgatttagacgacagctcaggggggggggaagctcagcttcagctgtggtagagaagacaggactcaggacaatctcagcatggccgcttccctctcctcctcaccctcctacactcactcgcgcgagggtcctcgggtcccagttccgtgtgcttgacctcgacgcccacccgtcacgcgtccggtccggggacccccgggcaacggacgggttccaacctacttcgttacctttgttccgtaggacggacctactcccaactaacgtaggtaaagttaatttagtacgttattacgtcggtactacgaacgtacctaaccctcccgaaaggtacgtacccgtaaccccctaaaccttccctaacncctaaccaggaacggtaacttaaacgccctaaacggcccgtccccgttagggacccggggttccctacggaccgtacttaccgtctacgggtactaccgacggttactaccggccacctaccgtccgttaacccncccgtacgaacctttacgacgtcgggttccgggacccgttacggggtcccggaagtacgtgggtaccgtacggtacgttaacgttgttactacggttcaacgtaccgtaccggacggggtccaacgttaaccgnggttaacggtacacggtaactactacggtgggtacgttcggggtcgggttaaccggtcggaacgggaccgtaaaccgtacgtacccgggtacttacggacgttaacgg

SEQ ID NO: 25387 - DNA, 650 bp, Homo sapiens
  misc_feature: GYAE6OF02F7PU3.21.22.B11.1.454.CMB.1.raw
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (343)..(343): a, c, t, g, unknown or other
  misc_feature (343)..(343): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
  modified_base (506)..(506): a, c, t, g, unknown or other
  misc_feature (506)..(506): n is a, c, g, or t
  modified_base (533)..(533): a, c, t, g, unknown or other
  misc_feature (533)..(533): n is a, c, g, or t
  modified_base (541)..(541): a, c, t, g, unknown or other
  misc_feature (541)..(541): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctccctccttcaccctcctcactcactgcgcagggtcctgggcccagtctgtgctgactcgacgcccacctcagccgtcgccgggaccccggngagacggtcaccntctcttgttctggacgctaactccaactagtacgaattaacttataggttacttcgtaggtactctagacctaacctacccgaggtaactccggaaccccctaaaccgtccctanaccgtacgtaaggaacggtaaataaactcgacgtcccggtaccctacggaccggggtccctggaccgttacttccgtcgtcggtacctacgaacgttcgcgtactacccgctaccgtcccttaccgaccgtacncgtacgnggtccgggcttacccgggcggngtactaggcgtcgtacgttactacgtntcgtacgntacggtacccgagactaccgagtcggtagtcagtacgtgttacgaggaggttcgggttaggtcggtcggaacgtaacggtaccaacgttcgaccggttagaccggtacg

SEQ ID NO: 25388 - DNA, 767 bp, Homo sapiens
  misc_feature: GYAE6OF02GSYSL.21.22.B11.1.454.CMB.1.raw
  modified_base (228)..(228): a, c, t, g, unknown or other
  misc_feature (228)..(228): n is a, c, g, or t
  modified_base (501)..(501): a, c, t, g, unknown or other
  misc_feature (501)..(501): n is a, c, g, or t
  modified_base (609)..(609): a, c, t, g, unknown or other
  misc_feature (609)..(609): n is a, c, g, or t
  modified_base (699)..(699): a, c, t, g, unknown or other
  misc_feature (699)..(699): n is a, c, g, or t
tcagtcgtcgctcgcacgaccggtgctcgatttagacgacagctcagggggggggaagctcagcttcagctgtgggtagagaagacaggactcaggacaatctccagcatggccggcttccctctcctcctccaccctcctcactcactgcgacgacgggtccgtcgggcccagtcgtgtcgctgactcacgcccaccctcagccgtccgtccggggacccccggganacggacggtaccacctaacgtcttcgtttggttacgtggacggaccaacctacctaacagtaacgggtaaagttaattattagttattcgttggttactacgacgtaccaacctacccgtaagggaaacgtacccggacccctaaacctacctcgtaacacgtaagaacgtaaagtactacgaaccgtccggaccgtccggtaaccgggttcccgtacgggtaacccgtacttccgtacggttcgtacctacgtacgtccgtcgacccgtacnccgtaccgtccctacccgtacgaccacgttaccgagggtcccgggtaccggttccccgggtggaacggttgcggtaacggcctttcgtaacttaacgtttcgcggttnaccggtacgaccgggtacgacgtacccgtaagacggttagggaacttcgaaagttcgtgttagggaccgggttggggttttacccggggnggttaaccgggggacggaacccggtacgtaaccgggtttaccgacccggttagggacccgtaaccggg

SEQ ID NO: 25389 - DNA, 784 bp, Homo sapiens
  misc_feature: GYAE6OF02HPG6U.21.22.B11.1.454.CMB.1.raw
  modified_base (214)..(214): a, c, t, g, unknown or other
  misc_feature (214)..(214): n is a, c, g, or t
  modified_base (596)..(596): a, c, t, g, unknown or other
  misc_feature (596)..(596): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgcccacctcagccgtcgtcggggacccccggngacgagggtccaccactcttcgttagttccgtaggaggtaccaaactaccaaactacgtacgggtaaaacgttaatttagttagttaacttctaggttaacttacgagaccaaacctacccgaaggtaacctccgggaacccccctaaaaccgtcccgtactaacgtacccgaaggaacggtaaaacttaactacgaacggcccgtcccgtaaccgggtacggtcccgtacgaccgtattccgtactcggacctacgaacgtcgtcgacctaccctcgaccgtcccgttacctacgtaaccctacgtacgtacgggttacggtacccggttacccggtacggtacggtacgtaggacggtcgtacgttaactacgtttaacngggtactaccggtacgtaccggaaccgggaccaacgtacgtaaggtcggtaaacgtcgaacgtaactttcggtaaccgggtacgggttccgggtttcggggtaccgggtttaacggggaccgggtaaacgggtaacccggaaaccggttaaccggtaaccccgggtttaccggttaacggtaccccgg

SEQ ID NO: 25390 - DNA, 353 bp, Homo sapiens
  misc_feature: GYAE6OF02G6IAN.21.22.B11.1.454.CMB.1.raw
  modified_base (310)..(353): a, c, t, g, unknown or other
  misc_feature (310)..(353): n is a, c, g, or t
tcagtcgtcgctcgcacgaccggtgctcgattttagacgacagctcagggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaaactgaccgtcctaggtcacgcccaaggctgccccctggtcactctcgtcccaccctcctcctcgtcttctactgacgcgggctggacaaggcgcaagtagatnnnnnnnnnnnnnnnnnnnnnnnnnnnnnnnnnnnnnnnnnnnn

SEQ ID NO: 25391 - DNA, 789 bp, Homo sapiens
  misc_feature: GYAE6OF02F8U4D.21.22.B11.1.454.CMB.1.raw
  modified_base (181)..(181): a, c, t, g, unknown or other
  misc_feature (181)..(181): n is a, c, g, or t
  modified_base (214)..(214): a, c, t, g, unknown or other
  misc_feature (214)..(214): n is a, c, g, or t
  modified_base (686)..(686): a, c, t, g, unknown or other
  misc_feature (686)..(686): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctgggcccagtctgtgctgactnacgccaccctcagcgtcgtcgggacccccgganacggacggtccacctattcctcgttgttctgggacgaccaacctaccgaacagtacggtaagttaacttagtagttacttcgttaggtactccgtaacgtaccaacccgttacccgaaggtaacgtacccgggtaaccccccaaactttccccgtataaaccgtccgaaaggaacggtaaactttaaacgccggtaacggtcccggtaccccgttacgggtaaccggggtttccccaacggttacccgttacgttaccctacgggtacgtaccgtaccgtaacggtccgtacggaccctaccgtccgacgttaccccgtccgaccgtactaccgtcggtacgggtcccggtccgttacccgggacggtaaacgtcggtacgggaccgtaccttacggtacctttaacgttccggttaggcgaaccgtaacgccggtaaacgggacccgtaagtaaccgtaaggacgggtaanaacggtaactacgtgtaccgggtacgggttggggttaccggtacgggttccgggaagggttaaccgaccttacgggaccgtttacccggtcgtaagggtcccg

SEQ ID NO: 25392 - DNA, 830 bp, Homo sapiens
  misc_feature: GYAE6OF02GBKI0.21.22.B11.1.454.CMB.1.raw
  modified_base (60)..(60): a, c, t, g, unknown or other
  misc_feature (60)..(60): n is a, c, g, or t
  modified_base (262)..(262): a, c, t, g, unknown or other
  misc_feature (262)..(262): n is a, c, g, or t
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (752)..(752): a, c, t, g, unknown or other
  misc_feature (752)..(752): n is a, c, g, or t
tcagtcgtcgctcgcacgaccggtgctcgatttagacgacagctcgaggggggggggaanctcagcttcagctgtggtagagaagacaggacctcaggacaagtcctccgagctagtcggccggccttccctacgtccctccgtccaccctcctcgaccttcactcggcgtcggtacggtccctagggccctagtcgtagtcggacctgtacctcgacgcccttacccgtcgaaggtccgtcgtaccgggggaacccccgtnaaggtacgggcctaaccnttcctcgttgtaccgtgggaaccnctaacctcaacgtagtacgtagtaacttagtacttcgtacgtgtactacgacgactaaccgtaccgaggtaactccggtaacccctaaccgtcctaccgtacgaccgtaaggtaaccgaaacgttactaccgtacggtacccgtaccggtacgtaaccggtcccgtacggtaaccgttaccgtttccggtaacggtcccggtactaaccggttaacggtccgttacgccccggttaaccgccgtaccgtacccgttacccgaccggttacccacgggtttaccgtaccgggtaccgggtacctttacccggggaccgtaagtacccgggttaaggcccggtttacgtaacggttaccgttagttacccggtacggttaccgtaccggtaacgtacccgggacgggtaaccgtagaacccggtcggtagggtacctaacggacttacgngttcgggttaccggtacgggtggtaccgtacgggacgggtaacgaccctaaccgtcggaccgttaccggttacaccgg

SEQ ID NO: 25393 - DNA, 739 bp, Homo sapiens
  misc_feature: GYAE6OF02GVJGM.21.22.B11.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcgacgggtccgtcgggcccagtctgtgctgactcacgccaccctcacgcgtccgtccggggacccccgggnaggacgggtacacctatccttcgttgttcgtgggacggacaacctaccaacagtacggtaaagttaattatgttacttcgtggtatcagccaacctacccgaaggtaactcccggaaccccctaaacttcccacgactaccgaagaacggtaaatactcgacggccgccctacggtaccgggtcctacgaccgtcttccgtcgcgtcctacgtacgtccgtacgcctacctccgcgtccctacccgacgacctacgtacgtcgggttccggccgtacccgggacggaggtcgtaggtcggtacttacgggtcttaaacgtttcgtggtcctaaccgttacggaccgggtaaccggaacctaacgtaacggtggggtaaacggtacgtacgtaaaccgtgttacgggtagggtacgggggtttacgggtttcgggggtaccgggttaccggggtaacggggtaacccggaaccggtttacccggtacgggtaccccgttaccgggtagggtaaccccg

SEQ ID NO: 25394 - DNA, 606 bp, Homo sapiens
  misc_feature: GYAE6OF02FQ8CU.21.22.B11.1.454.CMB.1.raw
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (214)..(214): a, c, t, g, unknown or other
  misc_feature (214)..(214): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctnacccgngtctgggacccccgggnaggagggtcaccatctcttgttctggaggcaactccaacagtcggaagtaattatgtattctggtatcagctaactcccaaggaactcggaccccccaaactcctacactccagagaataatcagcgtcccacgtacgggtccctaggtaccgtattcctctggcctcctaacgtctacggccaaccctcgacgccctcctagactattccaaggtcgggaccttcccgggacgaggactggacggtcgtgacttacgttactgtgccatccgacgggactaccgaacacggtaggagtagtacctattccgtaggacgggtcgggtttgggtattccggggacggtaacgggtacctaaacggtaccgggtaccgtaccgtagggtacccg

SEQ ID NO: 25395 - DNA, 853 bp, Homo sapiens
  misc_feature: GYAE6OF02FXAE9.21.22.B11.1.454.CMB.1.raw
  modified_base (123)..(123): a, c, t, g, unknown or other
  misc_feature (123)..(123): n is a, c, g, or t
  modified_base (224)..(224): a, c, t, g, unknown or other
  misc_feature (224)..(224): n is a, c, g, or t
  modified_base (263)..(263): a, c, t, g, unknown or other
  misc_feature (263)..(263): n is a, c, g, or t
tcagtcgtcgctcgcacgaccggtgctcgatttagacgacagctcaggggggggaagctcagctttcagctgtggtagagaacgacaggactcaggacaatctccagcatggccggcttcccnctcctacctcaccctcctcactcactgcgcagggtcctgggcccagtctgtgcgtgactcgacgccctaaccctcagcgttcgtccggggaccccccgggnacggtacgggtccaacctagttccttcgttcggtttcgngggacgaccaacctaccgaatagtacggaagttaactttacgtacgttacttacgttggtagtccagacctaccgtacccgaggaaccgtccggaacccccctaaacgttcccctactacgtaccgaaggaacggtaaactaacttaccgaaccgggtccggtacccgttaacggtaccggggggttcccctacgggtaccgtttaacctttcgttaccgtacgggtcctttaaaccgtacggttccgtacgggacccttacctacccgcgttaccccgtcccgttacgtacccgttaacgccgttaacgggttcccggtacccggttacccgggttacggacggtagttaaccgggcgtacgttacgaacgtttcgttaacggtcgaacgtcgacgttaccggaaccggggacctaacggtaaccgtaaggttacggaagttaaccgtaactaccggtttcggacggttaacgggggtccggggttttttaacgggtcccggggttaccggggtaacccggggtaacggttaaccccggttaaacccgggtacggttaccccccggtttacggtaccggttaaacccgg

SEQ ID NO: 25396 - DNA, 974 bp, Homo sapiens
  misc_feature: GYAE6OF02HRH2M.21.22.B11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctcgggcccagtctgtgctgactcacgacccaccctcacgccgtcgtccggggacccccgggngacggacgggtccaccgtacttcttcgttagttccgtagggacggacctaaccgttacccaaacgtacgtacggtaaaagttaactttagttcgttaactttcgttaggttaactaccgacggtacctaacccgtaccccggtaagggtaaaccgtaccccgggtaacccccctaaaaccgttcccctactaaccgtacccggaaaggtaaacggtaaacttaaccgtaccgtaaccggtccccgggtacccgtaccggtaaccgggggttacccctacggtaacccgtttaacgtttccgtaccggtacggttcccgtaaccggttaacggttccggttaccgggtaccctacccgttacccgaacccggtttcccccgtacccgttaaccggaaaccctttaccggttaccgggtacggggttcccgggttcccgggttaccccgggggtaaggaaccggggttcggtaaccgggttacggttaccgtaacggtttaacccgtttaacggtttaacgtcggggtttccgaaaccggttaccgtaaaccccgggacgggggtaccctaaacggttaacggtaacgggtttacggggaaacttacggtaacgggtacctttacggggtaccgggttacgggggtttaccgggggttacgggtaccgggggtttaaccggggacggggttaaaccggtaaccccgtaaaggggttaccccggtaaccccgggttacggttaccgggtacccggg

SEQ ID NO: 25397 - DNA, 606 bp, Homo sapiens
  misc_feature: GYAE6OF02HRAYE.21.22.B11.1.454.CMB.1.raw
  modified_base (211)..(211): a, c, t, g, unknown or other
  misc_feature (211)..(211): n is a, c, g, or t
  modified_base (326)..(326): a, c, t, g, unknown or other
  misc_feature (326)..(326): n is a, c, g, or t
  modified_base (382)..(382): a, c, t, g, unknown or other
  misc_feature (382)..(382): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagagggtcaccatctcttgtctggacgcactccaacatacggaagtaattatgtattctggtatcagcaactccaaggactccggacccctaaactcctcactccagagaataancacgcgcctacgcgggtccctgacgattcgtcgtcgctaccaagtccgaggtaccnccgtcacgccctcccacgaccacgtacgcggtacgggccgtacccgggtcggacggagtacgggacggtcgtacgtacgttattacgtcgtcgcgtaagtccgacgggacctaacgaacctagggtacggatacgaactactcgtagtacgggtcggtttagggtcggttaccgggtacggaaccggtaaccgaaccgtccggaccggttacgtacggtaccgg

SEQ ID NO: 25398 - DNA, 788 bp, Homo sapiens
  misc_feature: GYAE6OF02GYRVN.21.22.B11.1.454.CMB.1.raw
  modified_base (102)..(102): a, c, t, g, unknown or other
  misc_feature (102)..(102): n is a, c, g, or t
  modified_base (770)..(770): a, c, t, g, unknown or other
  misc_feature (770)..(770): n is a, c, g, or t
  modified_base (776)..(776): a, c, t, g, unknown or other
  misc_feature (776)..(776): n is a, c, g, or t
  modified_base (779)..(779): a, c, t, g, unknown or other
  misc_feature (779)..(779): n is a, c, g, or t
  modified_base (782)..(782): a, c, t, g, unknown or other
  misc_feature (782)..(782): n is a, c, g, or t
  modified_base (785)..(788): a, c, t, g, unknown or other
  misc_feature (785)..(788): n is a, c, g, or t
tcagtcgtcgctcgcacgaccggtgctcgatttagacgacagctcagggtcctgggcccagtctgtgctgactcagccaccctcagcgtctgggaccccggnaggagggtcaccatctcttgttctggaggcaactccaacatcggaagtaattatgtattctggtatcagcaactcccgaaggaacgtcggacccccaaatcctcaactccagaaggtaaataatcacgccggccctcgacgggtccctacggaccgtattcctcgtcggcctcgaaacggttcctcggcctacccgtcgacgtcccctcccgtagacccctatccgtaggtcgggccgttccccggggttaccggaggtacgtcggacgggaccgttacggtaacctttaacgttaccgttcggtcgacctaacgttaccggaacgggtaccgtaaaccgaaccgaagggtttaccggggtaacttaacgggaacgttaaacgttaccggtagggtaacggggttcggggtttacgggggttacgggttccgggggtaaccgggtacggggtaaacccgtaaacggttccgggtaacccggttacccggttaacggtaccggaaccggtacccggaacgggtcccgtacccggtaccccgttacgggttcccgtaaccgttaccgttcccgtccccgttaccccttcccgttacccgtcccgttacccttcgtaccgttacggccggtccgggacgtccggacgacggtcgacctacggtacgcgtancgtacngcngcncgnnnn

SEQ ID NO: 25399 - DNA, 679 bp, Homo sapiens
  misc_feature: GYAE6OF02FNQ2W.21.22.B11.1.454.CMB.1.raw
  modified_base (212)..(212): a, c, t, g, unknown or other
  misc_feature (212)..(212): n is a, c, g, or t
  modified_base (374)..(374): a, c, t, g, unknown or other
  misc_feature (374)..(374): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnaggagggtcaccatctcttgtctggaggcaactccaacatacggaagtaattatgtattctggtatcagctaacctccaggaacgtcggacccccaaatcctacactccaagaaggaataatcgacggcggccctcggaccggggttccctacgaacccgtnttcctcgtggccttaccaagttcgcggtaccacctcgaccgtcccttcctacgaaccctactcgagggttcgggtccttcccggggtaccgagggtacgtggacggtccttaacggtaacgttaacgtttacgcggttaccgtactaaccggtacccgggaaccggggtaaccaccgtaaacgacggttgggactaacggaactacgttacggtacgggtacgggttcggggtttaggggtacgggttccgggaccgggtaacggaacccgtaacggtccgtaacccggttccggtaacggtccg

SEQ ID NO: 25400 - DNA, 747 bp, Homo sapiens
  misc_feature: GYAE6OF02G1FQI.21.22.B11.1.454.CMB.1.raw
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
tcagtcgtcgctcgcacgaccggtgctcgatttagacgacagctcagggggggggggaagctcagcttcagctgtggtagagaagacaggactcaggacaatctccagcatggccggcttccctctcctcctcaccctcctcactcactgcgcagggtcctgggcccagtctgtgctgacctcacgcccaccctcgagtccggttcgtaccggggacccccccgggnaagggacgggtaccacccattccttaccgtttggttcgngggagaccctaaacctccgaaaactagtacgggtaaattaaatttattagttaatttcctaggttaacttcgagacctaacctacccggaacggtaacgtaccggaaccccctaaaactcccttacgaactaccgaaggaaacggtaaacttaacgtacgaaccggacccggtccccttacggtaccgggggttacccctacggaacccggtactttacgtccgttcggtacccttacgaaacgttccgtacggactacccgtacacgtccctaccgtacgactactcgaggtcggaccgttccggtacggacggtaactgggacgtacgtacgttaactacgttaccgtagtacctaggacgttccggaaaccggggaccaagaaccgtaagtggaactacgtaatacgtgaacgggtggtaccgggttggtaccgtcgggacggtaacggaaccaacgttcggaacctcgtacgtacgg

SEQ ID NO: 25401 - DNA, 343 bp, Homo sapiens
  misc_feature: GYAE6OF02HHZLI.21.22.B11.1.454.CMB.1.raw
  modified_base (326)..(343): a, c, t, g, unknown or other
  misc_feature (326)..(343): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcgacgggacgacaacagtgggatgacaatctgaggcggttgggtgttcgggcgggaggaccaaacgtcgaccgtcctaggtccacgcccgaaggcctccgcccccgtcggtcacctctccgttccccaccctcctccctcgtcctctacgtggacgcggctggacgaaggtcacagtcgnnnnnnnnnnnnnnnnnn

SEQ ID NO: 25402 - DNA, 634 bp, Homo sapiens
  misc_feature: GYAE6OF02J1L18.21.22.B11.1.454.CMB.1.raw
  modified_base (161)..(161): a, c, t, g, unknown or other
  misc_feature (161)..(161): n is a, c, g, or t
  modified_base (173)..(173): a, c, t, g, unknown or other
  misc_feature (173)..(173): n is a, c, g, or t
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (308)..(308): a, c, t, g, unknown or other
  misc_feature (308)..(308): n is a, c, g, or t
  modified_base (453)..(453): a, c, t, g, unknown or other
  misc_feature (453)..(453): n is a, c, g, or t
  modified_base (504)..(504): a, c, t, g, unknown or other
  misc_feature (504)..(504): n is a, c, g, or t
  modified_base (521)..(521): a, c, t, g, unknown or other
  misc_feature (521)..(521): n is a, c, g, or t
  modified_base (550)..(550): a, c, t, g, unknown or other
  misc_feature (550)..(550): n is a, c, g, or t
tcagtcgtcgctcgcacgaccggtgctcgatttagacgacagctcgagggggggaagctcagcttcagctgtggtagagaagacaggactcaggacaatctcagcatggccggcttccctctcctcctacaccttcctcacctcactgcgcgtacggtccncggaccaggtcngttcgctgactcacgccctacctcagtccgtcgtaccgggaacccccgtnacgacggttcaacctntccgttcttagtcaggtcgacacgttaccaagcgtacgtaattatacgtgttatcgtaggtaactcganaccgtaacctcgaaacggttctcccggaaccctaaacgttccactactaccgagtagtaaataaccgtcgagttcccggcctaggtacccgggctacgtaccgtacttcggtccttggacctacgacgtcttacggcctaacgcnccgtactccgtcactagcgtaggtcgtaccgcgtaccgagagcgtggtacngttaacctgtatcggtnacgtacgcgtaacggctcctagacgttgntaccgtaagccgtagttacggccggttggtacgtacggtttaccgaccggacgttacggaactcgtttaccgacgtcgaaccgg

SEQ ID NO: 25403 - DNA, 567 bp, Homo sapiens
  misc_feature: GYAE6OF02IBTRQ.21.22.B11.1.454.CMB.1.raw
  modified_base (123)..(123): a, c, t, g, unknown or other
  misc_feature (123)..(123): n is a, c, g, or t
  modified_base (192)..(192): a, c, t, g, unknown or other
  misc_feature (192)..(192): n is a, c, g, or t
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (316)..(316): a, c, t, g, unknown or other
  misc_feature (316)..(316): n is a, c, g, or t
  modified_base (366)..(366): a, c, t, g, unknown or other
  misc_feature (366)..(366): n is a, c, g, or t
  modified_base (408)..(408): a, c, t, g, unknown or other
  misc_feature (408)..(408): n is a, c, g, or t
  modified_base (449)..(449): a, c, t, g, unknown or other
  misc_feature (449)..(449): n is a, c, g, or t
tcagtcgtcgctcgcacgaccggtgctcgatttagacgacagctcagggggggggaagctcagcttcagctgtggtagagaagacaggactcaggacaatctccagcatggccggcttccctntcctcctcaccctcctcactcactgcgcagggtcctcgggcccagtctgtgctgactcacgccaccctnagcgtcncgggacccccggaggaggtcaccatctnttgtcnggagcaactcaantcggaagtatatagtattcgtgtatcagcaactccgagaatcgaccccaactctacatccagagaataancagcgcctagacggtcctagacctatctctgctacgtacgtacgtgaccnctacgacgtccctccgtagaccctagtcgacgtacgggtccnccgggtacgaggacgtcgaggtcctagtacgttacttacgngttacgacctatacggaccgggactacaacgtggaggacgtcaactacgtcgtaggacggttcgggttaggtcggttaggaacggaggtaacctacgttacgaccggttcacggtacg

SEQ ID NO: 25404 - DNA, 748 bp, Homo sapiens
  misc_feature: GYAE6OF02I2CJJ.21.22.B11.1.454.CMB.1.raw
  modified_base (106)..(106): a, c, t, g, unknown or other
  misc_feature (106)..(106): n is a, c, g, or t
  modified_base (230)..(230): a, c, t, g, unknown or other
  misc_feature (230)..(230): n is a, c, g, or t
  modified_base (733)..(733): a, c, t, g, unknown or other
  misc_feature (733)..(733): n is a, c, g, or t
  modified_base (745)..(745): a, c, t, g, unknown or other
  misc_feature (745)..(745): n is a, c, g, or t
tcagtcgtcgctcgcacgaccggtgctcgatttagacgacagctcagggtcctgggcccagtctgtgctgactcagccaccctcagcgtctcggggacccccgggnagagggtcaccatctcttgtctggagcaactccaacatcggaagtaattatgtattcgtgtatcagcaacctcccgaaggaactccggacccccaaactcctcaactccaaggaaggaactaancgaggccgtccctacggtacggggtcccctaggaacccgtactttccgtcgtcggtccttaccgaaggttcgtcggaccctacccgtactaccgccctcccgttacgaacctcgtcggtaggtccggggtcctcccgggtccgaggtactacgggacgtccgttacggaaccttttaaggtttcccgtgtacggaccacgttaccggaaccggggacaccgaaacgttggacgggtactacggtaacaacgttcgacgggtacggggtttccggggtttgggtaccggggttccgggaacggtaacgggaaccgttagtaccggaaccgtccggtacgacgtaccgaccggtacggtccctacccggtcccgttacggtacctaccgttccggttcccgtaccccgtccccgttaccctccggttaccttccttaccggtacgttccgggacgtcccggacggtggaaccgacggtcgaccgtacggtcacgcgatcggactncgtacgcgcgcngcg

SEQ ID NO: 25405 - DNA, 716 bp, Homo sapiens
  misc_feature: GYAE6OF02IULEM.21.22.B11.1.454.CMB.1.raw
  modified_base (59)..(59): a, c, t, g, unknown or other
  misc_feature (59)..(59): n is a, c, g, or t
tcagtcgtcgctcgcacgaccggtgctcgatttagacgacagctcaggggggggggaanctcagcttcagctgtggtagagaagacaggactcaggacaatctccagcatggccggcttccctctcctcctccaccctcctcactcactgcgcagggtcctgggcccagtctgtgctgactcagcccaccctcagcgtcgtcgggaccccccgggcaggagggtccaccatctcttgttctggaggcactccaacatacggaagtaattatgtattctgtatcagacaactcccaggaagtccggaccccctaaacgtccctacactaccgaaggaacgaaataactcaacggtccggaccctcggaccggggtacccttcggaacccgtagttcctcgtaggtaccgtaccaagtccgtcggccctacccgtccacgcccttacccgtacacccgtataccgtagggtccgggtccgtccccgggttaccgggacggtaagttgggaaccgggtcttacgtaaccgttatttaccgtaggttcgaccttacgtacccgggtaaggggacccaccaaacggtaggtacgggtaattcgaaaccgttataccggttacgggcgggtttacgggggtttggggttcgggtcccgggggaacggttaacgggtaacccgtaaccgggtacgtacccccgggttacgtaccggtacccgg

SEQ ID NO: 25406 - DNA, 768 bp, Homo sapiens
  misc_feature: GYAE6OF02HDVTS.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtccgtcgggcccagtctgtgctcgactcagccacctcacgcgtcgtcgggacccccggnaggacggtccactctcttcgttgttcgtgggaacgcctaacctaccgaacacgtacgggtaaacttaagttattggttaactttcgtaagttactacgaacgtactaacccgtaccgaaggtacgtacccggaccccctaaacttcccgtacaccgtaccgaggtaacggaaattaactaccgacggtccgtacccggtacgggtaccggttcccgtaacggtcccgttaacttcgttaccgtcgtaccgttaaccgtacggtcgtcggtaccacgtccgacgtcccgtctaacggacctagtaccggtacgggttcgcccggtacgggtaccgtaggacgtaggtacggtacgttacgtactttaacgttcgtacgtacgtccgtaaccgaagggtaacccggaactaacgggtaaacgttacgggtactaacgtaagtacctacgggttaacgtcggggtttacggggtccgggttaccggtcgggaacggttacccgggaacttaaaccgggtccggttaaaccgttacggtcgggtaaccttacccgggg

SEQ ID NO: 25407 - DNA, 127 bp, Homo sapiens
  misc_feature: GYAE6OF02IYHO0.21.22.B11.1.454.CMB.1.raw
  modified_base (111)..(127): a, c, t, g, unknown or other
  misc_feature (111)..(127): n is a, c, g, or t
tcagtcgtcgctcgcacgaccggtgctcgatttagacgacagctcaggggggggaagctcagcttcagctgtggtagagaagacaggactcaggacaatctccagcatggnnnnnnnnnnnnnnnnn

SEQ ID NO: 25408 - DNA, 857 bp, Homo sapiens
  misc_feature: GYAE6OF02F9YDL.21.22.B11.1.454.CMB.1.raw
  modified_base (208)..(208): a, c, t, g, unknown or other
  misc_feature (208)..(208): n is a, c, g, or t
  modified_base (243)..(243): a, c, t, g, unknown or other
  misc_feature (243)..(243): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcaggtcctgggcccagtctgtgctgactcagccacctcagcgtctgggacccccgggnagagggtcacatctcttgtctggagcaactcaacntcggaagtaattatgttattctaggtatcagtaccaactcccgaaggtaacttccggaccccctaaacgtccctactacgtccgaaggaacggtaaattaacgtaccgaccgggtaccccggtacccccgttacggaacccgggggttacccctacgggtaacccggttaactttcccgttacggttaccgggacccttaaccgtaaacggttcccgtacgggtaccctaacccgtttacccgaacggttccccctttaccccggtagaaacccgtacttacccgggtaaggggtttcccgggggtaccccgtttacccccgggggtaacgaacggggttacgttaccggggaacggttccttacggtaaacccttaacgttttacggtaggttacgaaccgttaggttaaccccggaaccggggggaactaccgtaaaacggtggtttaacgggaactaccggaaacttaacgggttcccgtaaggggtaacggggtttccggggttttacggggtccggggtttaccggggaaccggggttaacggggtaacccccgtaaaaccgggtttccggtaaacccccggggtttaccggtaaggttaacccccggg

SEQ ID NO: 25409 - DNA, 386 bp, Homo sapiens
  misc_feature: GYAE6OF02G8R8A.21.22.B11.1.454.CMB.1.raw
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (331)..(386): a, c, t, g, unknown or other
  misc_feature (331)..(386): n is a, c, g, or t
tcagtcgtcgctcgcacgaccggtgctcgatttagacgacagctcagggggtccctgaccgattctctggctccaagtctggcacctcagcctccctgaccatcagtgggctccggtccgaggatgaggctgactattactgtgcatcgaacgggacgacaacagtgggatagacaatctgagcggttgggtgttcgggcggagggaccaaagtcgaccgtcgtagcacgcccaaggctcgccccctaggtccactctcgtccccacctcctcctcgtctactacgtcggacgccgggactcgggacaacggggcaacaggtacngcangnnnnnnnnnnnnnnnnnnnnnnnnnnnnnnnnnnnnnnnnnnnnnnnnnnnnnnnn

SEQ ID NO: 25410 - DNA, 812 bp, Homo sapiens
  misc_feature: GYAE6OF02JCN1Y.21.22.B11.1.454.CMB.1.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcaggtcctgggcccagtctgtgctgactcagccaccctnacgcgtcgtcgggaccccccggnaggacggtcaccattcttccgttagttcgtcgggaggacctaaccgtaccaactacgtacgggaaagtttaaattacttggtacttacgtggtaacttccgaagaccctaacgtccccgaagggtaacgtcccgggtaacccccccaaaacgttcccctactaactacccgaaggtaacggtaaaacttaacgtccgaacggtaccccgggtaccccgtacggtaaccgggggttccccttacggaacccgttacgttaccctcggttacggtacccttacgaaaccggtttcgtacggaccctaaccgtcgaaccggttcccctacccgttagaaccccttacgtccgtaacgggtccgggtaccggttacccgggaaccgggtaaggtacgtacgggacggttaccgtagtaccgtttaacgtcggtgttaccgcgtacgtaccgggacggtaccgtaaccgaagtagggtcggtaaactacgtaaccgtatttaccggaggggtaccggtttggggttacggggtacggttaccggggaacccggtagggaaacccttaaccggacgggtttaccccgttacggtccggttaaccgg

SEQ ID NO: 25411 - DNA, 731 bp, Homo sapiens
  misc_feature: GYAE6OF02G4LSD.21.22.B11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgacgggtcctgggcccagtctgtgctcgtactcacgcccaccctcgagccgttcgtccgggacccccggnaggacggtcacagttctcttgttcgcggacgaccaactccgaactagtacggaagttaattagtgttacttgtgtatcagaccaactccgaaggtaacgtcccgaacccctaactcctactactaccgaagtaacgtaacttaacgtcaacggtccggtccgtaccggtcggggtaccctacggtaacttcgttacgtcggtcgacctttaccgaacgtttccggacgtacccgtaccgttacccgtacggtaccccttacccgtacgaaccttcggtaacgtcggggtccggtcccgttacccgggaaggtaccggtacgaacggttacggacgttaaccgttacgttactttccggtaggtcccgtataccggtaccggaaccgggtacacgtacgtaagggttcgaaactcgtaaactcgttaacgtagggtcggtttaccgggtgtaaccgggccgggtaaggacgttaaccggacgtaccgggttacccgtcggtaagtccccgg

SEQ ID NO: 25412 - DNA, 811 bp, Homo sapiens
  misc_feature: GYAE6OF02IEYOD.21.22.B11.1.454.CMB.1.raw
  modified_base (182)..(182): a, c, t, g, unknown or other
  misc_feature (182)..(182): n is a, c, g, or t
  modified_base (218)..(218): a, c, t, g, unknown or other
  misc_feature (218)..(218): n is a, c, g, or t
  modified_base (263)..(263): a, c, t, g, unknown or other
  misc_feature (263)..(263): n is a, c, g, or t
  modified_base (351)..(351): a, c, t, g, unknown or other
  misc_feature (351)..(351): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctctcaccctcctcactcactgcgcagggtcctagggcccagtctgtgctcgactnacgcccaccctcagcgtccgtcggggacccccgggnacggacggtccacactcttcttagttctaggcgacactaccaacncgacgtaattaattacgtagttacgtttcgtggttactcagacctaacctaccgaaggtaccgtaccgaacccccgtaacctcctacncctaacgacggaaggtaataacgtacgaccggccggtcccgtaacggtacccggggttacccgtaaccggaccggtttacttaccgttcgtaccggtacttacccgtaacgttccgtacggaccctacccgtaaccgaccgtccccgtacccgtacgtaccctacgttaccggtacgggtccggggttacccggtttccgggaaccgggtacggtaacggtcggtaacgggtctaacggttacgtttaaccgtaggttacggtacgttaccgtaccggtaacgggtaccgggaacgaacgtaaacgggtacgaacgggtaacgttaacaacgggttataccggttacggggtcggggttacgggggttttacggggtccggggttaaccggaccgggggtaacgggttaaaccctaccgggttaacccggtaaccggtttaccgggtacggtaaccccgg

SEQ ID NO: 25413 - DNA, 723 bp, Homo sapiens
  misc_feature: GYAE6OF02GFVVN.21.22.B11.1.454.CMB.1.raw
  modified_base (58)..(58): a, c, t, g, unknown or other
  misc_feature (58)..(58): n is a, c, g, or t
  modified_base (123)..(123): a, c, t, g, unknown or other
  misc_feature (123)..(123): n is a, c, g, or t
  modified_base (177)..(177): a, c, t, g, unknown or other
  misc_feature (177)..(177): n is a, c, g, or t
  modified_base (219)..(219): a, c, t, g, unknown or other
  misc_feature (219)..(219): n is a, c, g, or t
  modified_base (429)..(429): a, c, t, g, unknown or other
  misc_feature (429)..(429): n is a, c, g, or t
  modified_base (630)..(630): a, c, t, g, unknown or other
  misc_feature (630)..(630): n is a, c, g, or t
  modified_base (652)..(652): a, c, t, g, unknown or other
  misc_feature (652)..(652): n is a, c, g, or t
  modified_base (658)..(658): a, c, t, g, unknown or other
  misc_feature (658)..(658): n is a, c, g, or t
tcagtcgtcgctcgcacgaccggtgctcgatttagacgacagctcagggggggggaanctcagcttcagctgtggtagagaagacaggactcaggacaatctccagcatggccggcttccctntcctctcaccctcctcactcactgcgcgacggtccgtcgggcccagttctggtnctgacctcacgcccaccctcagccgtcgccgggacccccggnaaggaccgggttcacctatccgttcgttcgtcgtagggacgtcaaacctcaacgtagtacggtaattaaagttacgttgttaacgtttcgttacgggtaactacgacgtaacccgtaaccccgttaccggaaggtaaccgttaccccggaacccccttaaacgttcccctaacgtaccttaaccggaaggtaacgtaaaactttaaccgngttaacccgggccccgttaaccgttacggaccgggtttcccctaggtaaccgttattccgtcgttacgtaccgtaactacggttccggtacggaccctaacccgtcgaacctccccgtcgtaacgccgtaacgcgtacggttcgaccgtcggacgtgcgagtcgacttgacttgtccgtgctacggtacgtcgacgacganacgtgacgtaagtcgaacgttntacggnggttcggtcgggttagggttcgaccggtagggacctaccgtacgaccggtacgtacgaggtaccg

SEQ ID NO: 25414 - DNA, 828 bp, Homo sapiens
  misc_feature: GYAE6OF02HEJXH.21.22.B11.1.454.CMB.1.raw
  modified_base (223)..(223): a, c, t, g, unknown or other
  misc_feature (223)..(223): n is a, c, g, or t
  modified_base (278)..(278): a, c, t, g, unknown or other
  misc_feature (278)..(278): n is a, c, g, or t
  modified_base (600)..(600): a, c, t, g, unknown or other
  misc_feature (600)..(600): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtccgtcgggcccagtcgtgtcgctcgactcacgccacctcgacgtcgtcgtccggggacccccgggnacggacgggtccacctatccttcgtttcgttcgtggacggacctaacctccaaanacgttaacggtaaagttaatttaagttggttaactttcgtacgggttactacgaacgaccgtaaaccctacccgaaggtaactaccggaacccccctaaacgttccctacactaccgaaggtaaacggtaaattaactaccgacgggcccggtcccctagggtaaccggggttcccacggtaaccgttcttacggtaccgttcggtaccctacgtaacgttcgtaccggaccacccttacgaccgtcccctacccggtacgtaacccgtaactacgggtaacgggttccggggtcccgttaccggggtaacgaacgggttanaccggggttaacgtcgtaaccgtacgtttaacgttacgtcggtaacgactacggttaccgggaacgggacctaaacgtaacgtaccgggttaaggagttaacggattaaccgtcggttacgggtaaccggggttcgggtttttggggaccccgggttacgggggaaccggggtaacggaaaacccctttacggacccgggttaccggtttccgaacggttaaccccgg

SEQ ID NO: 25415 - DNA, 735 bp, Homo sapiens
  misc_feature: GYAE6OF02JB3LV.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcacgggtcctgggcccagtctgtgctgactcagccaccctcagccgtcgtcggggacccccggnaggagggtaccaccatctcttgttacgtggaggccaacctcgaacagtacggaagttaattatgtaattctaggtatcagacaacctcccgaggaacgtccggaccccaactcctcacaccagaacgaataactcgaggccgaccctaggaccggggtcctacgtaccgtacttccgtaccgttggacccttaccgaacggtttccgacgggtcctaacccgtccgaccgtcccctacccgtaccgaccctacttacggacgggtccgggtcccggtacccggggttacccgaagggtacgttacgggacgtacgtccgtaaccgtttacttcgtacggtcgtaccgacgttaccggaaccggggtaccgaaccgtaaacgtggtacgggtaagacgttaacctacggttcgtacggggttaccgggtccgggggttttagggtccgggttaccggggacggtaaccgggtaaccctaaccgggtaccggtacccggtttaccggaccggggttaacccg

SEQ ID NO: 25416 - DNA, 797 bp, Homo sapiens
  misc_feature: GYAE6OF02HYH21.21.22.B11.1.454.CMB.1.raw
  modified_base (189)..(189): a, c, t, g, unknown or other
  misc_feature (189)..(189): n is a, c, g, or t
  modified_base (218)..(218): a, c, t, g, unknown or other
  misc_feature (218)..(218): n is a, c, g, or t
tcagtcgtcgctcgcacgaccggtgctcgatttagacgacagctcagggggggggaagctcagcttcagctgtggtagagaagacaggactcaggacaatctccagcatggccggtcttccctctcctcctcaccctcctcactcactgcgcgagggtcctgggcccagtctgtgctgactcacgcccncctcacgtcgtcgtccggggacccccggnacggacggtacacctattccttcgttgttccgtaggacgtaccaaccgttaccaaacgtacgtaacggtaaagttaagtttagttagttacgtttacgtaggttactacgtacgtacctaaccgttacccgaacggtaaccgtacccggtaacccctaaaccttccgtacctaactaccgaaggtaaacgtaaactaacgtaccgtaaccgggcccggtacccggttaccgggtaccggggttaccctacgggtaaccgttacgtttccgttaccggtacgttacccgttaccgtaacggttccggtacgtacccgtaccgttccgacccgttcccgttacccgacgtaccgtaacggtcggtacgggtccggtaccggttaccgggtacggtacggtacggtcgtaacggttccgtaacgtagtttacgtacgtcgtcgtaccgtacgtaccggacggtaaccgacgtaacgtcggtagtaagtacgtacgtacgttggtacggtacgggttcggggtttacggtcgggtacggtacgggaccgtacgtaccgtacggtaccgtccgtacggtaccgg

SEQ ID NO: 25417 - DNA, 837 bp, Homo sapiens
  misc_feature: GYAE6OF02IT6HO.21.22.B11.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (309)..(309): a, c, t, g, unknown or other
  misc_feature (309)..(309): n is a, c, g, or t
  modified_base (637)..(637): a, c, t, g, unknown or other
  misc_feature (637)..(637): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgcgacagggtcctgggcccagtctgtcgtctgacctcacgccaccctcagtccgtccgtcgggacccccgggnacggacgggtccaaccnttccttcttgttcgtggacggacaacgttccaacagtacggaaattaacttatgttaacttgtgttaactnaacgtctaacccacgtacgaacgtccgaacccctaaacgtcctacacgtaccgagtaacgtaaactactacgccggtaccgtcccgtaacgggtacggtccccgtacgaacgttacgttccgtacggtccggtacctaccgtaaacggttcccgtacggttaccccgtacgtacccgtacggtaccccccgttaccttaacccgtaacccgtagtaacccgggttaaccggtccgggggttaaacccggttccgggttaacccgggaagtttacgggaaacgggttacccggtcgttaaacgtacgttttaacgtccgttaggtaacncgtaccgttaccgggacgggaccgacccgggtaagtaaccggttagggaaacgttagtaacccggtacgttaccgggtacggttaacggggtttccggggttaccgggggtttacgggttcccggggaaaccgggttaacccggaaccccgggtaaccgtaccggggtttaccccgttaccgggtaccggttaacccggg

SEQ ID NO: 25418 - DNA, 690 bp, Homo sapiens
  misc_feature: GYAE6OF02FG4TK.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatgccggcttccctctcctctcaccctcctcactcactgcgcagggtcctgggcccagtctgtgctgactcagccaccctcagcgtctcgggacccccggcaggacgggtcaccattcttcttgttcgtggacggcaacctccaacagtacggaagtaacttatcgttattctggtatcacgacactcccaggaactccggaccccaaactcctacactccaagaggaactaactcacggccgtaccctacggacggggttccctacggaccgtatttccgtcgtcggtccttaccgaagttcctacggacctaccgtcaacgtcccctaccgtagaccctagtccgtacgggtcgggacccttcccggggtaccgaaggtacttacgggaacggtcgttacgtacttaacgtttacgtggttacgacctagtacccggaacggggtaccacgtaaacgcgttaacgggatacggtaacctagttccggtacggtaacggggttccgggttaggggttccgtaccggggacgggtaacggtaacccgtaaacggttccgggacccggttaccgtagtacccgg

SEQ ID NO: 25419 - DNA, 896 bp, Homo sapiens
  misc_feature: GYAE6OF02H2FRT.21.22.B11.1.454.CMB.1.raw
  modified_base (122)..(122): a, c, t, g, unknown or other
  misc_feature (122)..(122): n is a, c, g, or t
tcagtcgtcgctcgcacgaccggtgctcgatttagacgacagctcagggggggggaagctcagcttcagctgtggtagagaagacaggactcaggacaatctccagcatggccggcttcccnctcctctcaccctctcactctactgcgcgagggtcctcgggccagtctggtgcgtgactacacgcccacccgtcacggtccggttcgtacccggggggacccccgggacgaacggtaacgggggttaccaacccgtacgtttccgtttcggtttaccggttcggtacggggtaccggtaaccctaaaccggttaccccaaaacgtaccggttaaccggggtaaaacgtttaatttacggttagttacgttttacggtacggttaacgtacgaaccggtaccgtaaaaccctacccggtaaaggtaaacccgttaccccggtaaacccccctaaaaccttccctaaccgtaccgtaaccgaagggtaacggtaaaacttaacgccggaccgggtacccggtaccggttaccgggtacccggggttaacccgtaccgggtaactttacctttccggccggttaacgccctaacgttaccggtcgtaccggtaaccacccgttcgtaaccccgtccgtacccggaacgttacccgtaacgttcgggaaccggttccggtaacccgggttcccgggaaccgggtaaggtacggtaccggtacgttacgtaacgttacgtacgttacgcctaggccgtaacgcggaccgacgaactacggtacggtaggtaccacgtaagacgtcggtacgggtcgggttcgggttacgggtccgggttaaccgggacggtaccggaaaccgtccggttaaccgggtccttacgggaccgttaacccgg

SEQ ID NO: 25420 - DNA, 579 bp, Homo sapiens
  misc_feature: GYAE6OF02H4BEE.21.22.B11.1.454.CMB.1.raw
  modified_base (156)..(156): a, c, t, g, unknown or other
  misc_feature (156)..(156): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcgacgggacncaacatgggatgaacaatctgagtcggttggtgttccggcggacggaccaactcggaccgtccgtaggtcacgccgaaggcctcgccccctcggtacaccgtcgtccgtcccgacctcctccgtcgtctactcgtgacggtcggtctacggcgaacggccgactacgttagctacgctgancgagngactcgctcgcagtcancgtnacgctagcatggcagtncctgaacgngtactgacgctntcgtacgtcgtacgtcgtcgtacgtacgtacgtacgtcgtagacgtacgtacgtacgtcgtacgtacgacgtacgtacgtacgtacgtacgtacgtacgtacgtcgttacgtacgtacgtacgtacgtcgtacgtactacgtacgtacgtacgtaccgtacgtacgtacgtacgtacg

SEQ ID NO: 25421 - DNA, 587 bp, Homo sapiens
  misc_feature: GYAE6OF02HDKM6.21.22.B11.1.454.CMB.1.raw
  modified_base (497)..(497): a, c, t, g, unknown or other
  misc_feature (497)..(497): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggcagagggtcaccatcgtcttgttctggaggcaactccaacatcggaagtaattatgtattctggtatcagcaacctcccaggaactcggacccccaaactccctcatccagagaactaatcagccggccctgacggggtccctgaccgtattcctcgtggcctaccaaggtcctggcccacctcacgtccctccctgaccatccagtggcctccgtcgagctgagctgacttattctagcgactacgtcgacgggtcacgaacgtatcgggatagactagtcgtaggngggttacgggtttgggacggtttacgggccggggtaaaccggggtcccaaaacggtttccgggaaccccggtttacgacggttaacccgg

SEQ ID NO: 25422 - DNA, 609 bp, Homo sapiens
  misc_feature: GYAE6OF02HVDB6.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnaggagggtcaccatctcttgttcgtggaggcaactccaacatcggaataattatgtattctggtatcagcaactccagaatcgaccccaaactcctcatccagagaataatcagccggccctcgacggggtccctgaccattcctctcgcctaccaacgttcgtcggcctaccctcacgtccctcccgtacgaccctataccgacggtgggcccgttcccgggaccggtagggacttcgggacggtcctcgtaaccttacttacgtggtcactactccggaacgggaccgacaagacgtggaagttgactatcgtaggcggttacggggtttgggtggttccgggacgggtaacgggaaccaaaccggttcggaacccggttaccggtacggtaccg

SEQ ID NO: 25423 - DNA, 739 bp, Homo sapiens
  misc_feature: GYAE6OF02JTE1T.21.22.B11.1.454.CMB.1.raw
  modified_base (213)..(213): a, c, t, g, unknown or other
  misc_feature (213)..(213): n is a, c, g, or t
  modified_base (552)..(552): a, c, t, g, unknown or other
  misc_feature (552)..(552): n is a, c, g, or t
  modified_base (627)..(627): a, c, t, g, unknown or other
  misc_feature (627)..(627): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgacgggtcctgggcccagtctgtgctgactcagcccacctcagcgtcgcggggacccccggnacggagggtccaccagttccttcgttcgttcgtggacggccaacctccaaactacgtccggtaaagttaattagtagttagttcctggtatcgacgacaaccgtacccaggacgtaccggacccccaagtccctacactaccgagaaggtaatactacgacgccggcctcgacgggtcctacgtacctacgttctcgtcggtacctctaacgtcgtacggccctacgtcctaacccgtccctacccgtacgaaccctacgtaccctaaggggtcccgaccgtacccgggtacggaggtacgtaaccggtcggttacgtacttaaccggttaatttccgnggtttccacggtacgtaaccggtacccgggaacgttaccgaaactcgggtcgggaaacgtttcaaaacccggttntaccggttacgggtaacggggttttccgggttaggggttaccgggttacccgggtaacgggtaaccggttaaccgaaccggttaccggtacccggttacggtaccgggtacc

SEQ ID NO: 25424 - DNA, 740 bp, Homo sapiens
  misc_feature: GYAE6OF02H2148.21.22.B11.1.454.CMB.1.raw
  modified_base (217)..(217): a, c, t, g, unknown or other
  misc_feature (217)..(217): n is a, c, g, or t
  modified_base (653)..(653): a, c, t, g, unknown or other
  misc_feature (653)..(653): n is a, c, g, or t
tcagtcgtcgctcgcacgaccggtgctcgatttagacgacagctcgaggggggggaagctcagcttcagctgtggtagagaagacaggactcaggacaatctccagcatggccggcttccctctcctcctcaccctcctcactcactgcgctaggtccgtcggcccagtcctgtgctgactcacgccacctcgagtcgtcgtccggggacccccggnacggtacggtcaccacgttcttcttggttcgtagggacgaacctaacgtacccaaatacgttcggtaaagttaacttagttcttagtttacgttggtaactcgtaacgtacctaaccgtaccgaaacggtaccgtacccggtaaccccctaaaccgttcccctactaccgtacgaacggaaacggtaaactaaccgtcgaaccggtccccgtacccgtaccggtacgggtcccctcggtaacgttccttacgtcggtccgttacgtaaccgtacgtccgtaccgtccaacccgttcgaccgtacccctcgtaccgtacgtacgtacgtacgggtcggtccgtccgggtacggtacgacgttcggacgttcggtaactacgtttacgtcgtaacgcggactacggtccggaaccggtaacaccgtagtaggaggtanacgtacagttcggtggtgttccggggtagtcggggttaacgccgggacgtaaccggacggttaccgaccgttccggtagtacccggg

SEQ ID NO: 25425 - DNA, 704 bp, Homo sapiens
  misc_feature: GYAE6OF02GTGCV.21.22.B11.1.454.CMB.1.raw
  modified_base (382)..(382): a, c, t, g, unknown or other
  misc_feature (382)..(382): n is a, c, g, or t
  modified_base (554)..(554): a, c, t, g, unknown or other
  misc_feature (554)..(554): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgagggtcctgggcccagtctgtcgctgacctcacgcccaccctcacgtccgtcgtccggggaccccccggcaggacgggtaccaccacttccttcttgttcgtggacggacctaactccaaacagtacgaagtaattacgtgtattcgtaggtatcgacgactaacctcccgaaggaacgtccggaacccccctaaacttcccacctaactaccgaagtaacggaattacncacggccgacccgtcggaccgggtcccacgaccgtacttctcgtacggtcctacgaacgtcgtacgacccgtacctaccgaccgtccctccgacacccgtataccgacgggtcccggtcccgtacccgggtacggtaagtacgtcggaacgtcttaccgatttacgttccgngtaccgcgtaccgttaccgggaaacgggtcaaccgaacgtaagtcgggtataacgactaaggttcgacggtagggtttcggggttagtccgggtcgggaacggtaccggtaaacctccggtaacccggtccgttaccggtaacgtaccgg

SEQ ID NO: 25426 - DNA, 770 bp, Homo sapiens
  misc_feature: GYAE6OF02JI81X.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtctcgggaccccgggnagacggtcaccatctcttgtctgggacgcaaacctccaaacgacgtaccgggaaattaatttagtagttacttacgtgggttaactccaaggtacctaaaccgttccccgaagggtaaacctccgggtaacccccctaaaaccttccctaccgtaactacccgaacgggaacggtaaacttaacgtacgacgggtcccggtacccctacgggtaccgggggtcccctcgggtaacccttaagttccgttacgtcggtacccttaaccggtaacgttccgtacgggtaccctaacccgtccgtaaccgtccccgttacccgtacggtaaccctacgtccggtacgggttccgggtccggtacccggtacgggaacggtacgttacgggacggttacctagtacgtttaacttcgtgtcgactaccgtaccggacggggtaaccacgtaaacgtaggtacggtacacggtaactagttcggtaggtcgggttacgggttacggttcgggttaccggacgggtaacgaaccgttaacggtcggtacccggttagtccggtaacg

SEQ ID NO: 25427 - DNA, 735 bp, Homo sapiens
  misc_feature: GYAE6OF02ICJ8C.21.22.B11.1.454.CMB.1.raw
  modified_base (59)..(59): a, c, t, g, unknown or other
  misc_feature (59)..(59): n is a, c, g, or t
  modified_base (121)..(121): a, c, t, g, unknown or other
  misc_feature (121)..(121): n is a, c, g, or t
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (572)..(572): a, c, t, g, unknown or other
  misc_feature (572)..(572): n is a, c, g, or t
tcagtcgtcgctcgcacgaccggtgctcgatttagacgacagctcgagggggggggaanctcagcttcagctgtggtagagaagacaggactcaggacaatctcagcatggccgcttcccntcctctcaccctcctcactcatgcgcgaggtcctgggaccctagtctgtagctgactcgacgcctaaccctcgagccgtcgacccggggccccgntaggaggtccaacctntcttcttcgtacgtggacgtacaacgtaccaataacgtcggtaaaagttattattgtagttcagtaagttcacgtcgaaccctacgtagaccgtacccggaacccctaaacgtcctacaacctacgtaagaaggtaaaatcgtaccggacgtcccgaccgtccggtaacgggtcccacgtaacggttactccgtcgttaccggtacgtaaccggtaacgtttcgaaccggccctaaacccgtcggttacccctacccgttaccgacgttaaccctaacgttaccggacggtaccggtcccggtaccgggtaaccgggtacgtagttaccggaaccggttnaccgtacgttaacttcggtagtcgactacggtacgaaccgtacgtacgagacggttacgagtaactcgtaactcggtacggtacgggttggtttccgggtcgggaacggtaccgggtacgaaacccgggtcgttaaccggaccgtttaccggacgttaaccgg

SEQ ID NO: 25428 - DNA, 790 bp, Homo sapiens
  misc_feature: GYAE6OF02F37FI.21.22.B11.1.454.CMB.1.raw
  modified_base (265)..(265): a, c, t, g, unknown or other
  misc_feature (265)..(265): n is a, c, g, or t
  modified_base (774)..(774): a, c, t, g, unknown or other
  misc_feature (774)..(774): n is a, c, g, or t
  modified_base (777)..(778): a, c, t, g, unknown or other
  misc_feature (777)..(778): n is a, c, g, or t
  modified_base (781)..(782): a, c, t, g, unknown or other
  misc_feature (781)..(782): n is a, c, g, or t
  modified_base (785)..(790): a, c, t, g, unknown or other
  misc_feature (785)..(790): n is a, c, g, or t
tcagtcgtcgctcgcacgaccggtgctcgatttagacgacagctcaggggtcctgggcccagtctgtgctgactcagccaccctcagcgtctgggacccccgggcaggagggtcaccatctcttgttctggaggcaactccaacatcggaagtaattatgttattctggtatcagcaactcccaaggaactcggacccccaaacttcctcgactaccagaaggaaattaactacgacggccggtccctacggacgggggtacccncgacctacgttcctcgcggacctaccgaagtcgtggcccaaccgttcaaccgtcccccttccgtacgaaccgtctaccggacggttccgggggcccttaaccccggggttccgggaacgggtaacgttccggggaacggggtcctacggttaaaccttcggttttaaccgtcgggttccgtaacgtaaccgtttacggaaccgggtccaacgaaccgtaggggttagggactaccggtaaactaaccggttcgtaacgggttacggggtaccgggggttttggggttccgggtttaccggggggaacggaaccggggttaaaccccgaaacggttaccgggtaacccggttacggttacgggtaccgtaaccggacccggtaaacggcccgttaccccggtcccgttaaccggttacccttacgttcccgtacccgtccccttacccgtcccgtccgtacggcgtaaccgtcggcggtcggccggtcggacgcgaacggcgcgagtcgncgnngcnnctnnnnnn

SEQ ID NO: 25429 - DNA, 783 bp, Homo sapiens
  misc_feature: GYAE6OF02F9W4B.21.22.B11.1.454.CMB.1.raw
  modified_base (181)..(181): a, c, t, g, unknown or other
  misc_feature (181)..(181): n is a, c, g, or t
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
  modified_base (653)..(653): a, c, t, g, unknown or other
  misc_feature (653)..(653): n is a, c, g, or t
  modified_base (681)..(681): a, c, t, g, unknown or other
  misc_feature (681)..(681): n is a, c, g, or t
tcagtcgtcgctcgcacgaccggtgctcgatttagacgacagctcaggggggggggaagctcagcttcgagctgtggtagagaagacaggactcgaggacaatctccagcagtcggccggcttccctctcctcctaccaccctcctcgactcactgcgcgagggtcctgggcccagtctgngctgactcacnccacctgacgtcggtccgtcggggacccccgggnacgggtacgggtaccaccgtacttccgttcgtttcggtcggtagggacggtaccctaaaaccgtccaaaaccggtacggttaccggtaaacgtttaaagtttacgttacggtttactttaaccggttacggttaaaccttaccgtaacggaaccctaaacccgtttaccccggaaaggtaaaccgttcccccgggtaaacccccctaaaggtccccttaacgtcgttaaccaagggtaacggaaacttacgtaccggaaccggtccggtacccgtacgggacccgggtacctaacgaccgtactttccgcgtacgaccgttacaaggtcacgcctaccgtcgaccgcccgtaccgtacgtacccgtagacgtcggtaccggccgtaccgggacggacgtgtacggacgacttcgtaacttcgtacgngtacgacagttcgaaccgtcgacaaggngttacgggatcggtaatcgtacggtaccggtaggttcgggttacgggttcgtacgggaacggtaccggaactacccgggaacgtcccggtaagtcggtaccg

SEQ ID NO: 25430 - DNA, 752 bp, Homo sapiens
  misc_feature: GYAE6OF02HP8SP.21.22.B11.1.454.CMB.1.raw
  modified_base (628)..(628): a, c, t, g, unknown or other
  misc_feature (628)..(628): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcgacgggtccgtcgggcccagtcgttgtgctgtacctcgacgccctaccctcgacgtcgtcgtccggggacccccgggcaaggacgggtccaccgtacttcttcttacggttcgtaggacggtacctaacctaccaacgtacgtacggtaaagttaattactagttattcgtggtactcgaagaccgtaactacccgagtaaccgtccggacccctaaaccgtcctaccacgtaccgaaggtaagtaaactacgtcgaccggtccgtcccgtacggtaccgggttcctaccgaccgttacttcgttaccgtcgtacctacgtaacgtcgtaccgacctaccgtccgtacccgcccgttacctcgaaccctagtcggtacgggttccgggtaccgtccgggtacgaaggtcgtcggacgtaccttagtaccgttaagttcgacgtacgcgtacgtaccggacggaacgtacgtaaccgngggttacgacgtacgtaagttaccgtaggtacgggtcgggtttacgggtttacgggtccgggaaccgggtaacggtaaccgtaacggttaccgggtacccggttacgtaccggaaccgtaccgg

SEQ ID NO: 25431 - DNA, 485 bp, Homo sapiens
  misc_feature: GYAE6OF02I23BL.21.22.B11.1.454.CMB.1.raw
  modified_base (142)..(142): a, c, t, g, unknown or other
  misc_feature (142)..(142): n is a, c, g, or t
  modified_base (160)..(160): a, c, t, g, unknown or other
  misc_feature (160)..(160): n is a, c, g, or t
  modified_base (165)..(165): a, c, t, g, unknown or other
  misc_feature (165)..(165): n is a, c, g, or t
  modified_base (404)..(404): a, c, t, g, unknown or other
  misc_feature (404)..(404): n is a, c, g, or t
  modified_base (426)..(485): a, c, t, g, unknown or other
  misc_feature (426)..(485): n is a, c, g, or t
tcagtcgtcgctcgcacgaccggtgctcgatttagacgacagctcagggggtccctgaccgattctctggctccaagtctggcacctcagcctccctgaccatcagtgggcctccggtccgaggatgagctgactattacgngtgcatcgaacggggacncaacngtgggatgacatctgagtcgggtttgggtggttcgggacgggacgggaccctaaacgtccggtacccgttcgtacggtccgacggacccgaagggtcccgtaccgcccccccgttcggtaccctaaccttcccgtttcccggttaccccccctacccccgtttcccttcccgtttcccggtccctttacctaccgttcgggaacgggcccgggtcgttcggggaccgtaaacggggccnccgtaaggtggatcgcgatcgnnnnnnnnnnnnnnnnnnnnnnnnnnnnnnnnnnnnnnnnnnnnnnnnnnnnnnnnnnnn

SEQ ID NO: 25432 - DNA, 867 bp, Homo sapiens
  misc_feature: GYAE6OF02GNILL.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctccctctccaccctcctcactcactgcgcgagggtccgtcgggcccagtctgtgctgactcacgcccaccctcgacgccgtcgtccggggacccccgggcaggacgggtccacctatccttcgtttgttcgtagggacggactaacctaccaaactacgtacggtaaacttaatttataggttaacttcgttacggttatacgacggtacctaaccgtacccggaacggtaacgtacccggacccccctaaaactccctacaccgtaccgaaggaacggtaaataactccgaacggtccccggtaccctacgggtaccgggtaccctacggtaaccgtctttccgtccggttacggcccttaaccgtaacgttccggacccgggtaccaccccgtttaccgaacccgttcccccgtttacccgtaccggtaaaccccttacggtacccgggttaaccggggttccggggtacccgtttacccccgggggttaaccggaaacggggtaaccgttcggggtaaccgggtcccggttaaacgggtttaccctttaacggtttaaccggtcggttccgaccgttaaccggtaccgggaaccgggtaaccgtaccctaaagggttagtaccgggtaaactacgggaaacttacgttcggtaagggtacggggttacggtttggggttaccgggttcgggaacggggtacggaacccgtaagtcccgggtaccgttacggttacgaccgg

SEQ ID NO: 25433 - DNA, 374 bp, Homo sapiens
  misc_feature: GYAE6OF02FKQNU.21.22.B11.1.454.CMB.1.raw
  modified_base (154)..(154): a, c, t, g, unknown or other
  misc_feature (154)..(154): n is a, c, g, or t
  modified_base (183)..(183): a, c, t, g, unknown or other
  misc_feature (183)..(183): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
  modified_base (304)..(374): a, c, t, g, unknown or other
  misc_feature (304)..(374): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactatactgtgcatcacgggacncaacatgggatgacaatctgagcggtggngtcgaggaggcaaatggacctctgtcagccagctcgcccctggtacacgtctcgtcccctacctccttactcgtcctagtacggacnccgggnaggtcaaaggcgaacatacgcnatcgannnnnnnnnnnnnnnnnnnnnnnnnnnnnnnnnnnnnnnnnnnnnnnnnnnnnnnnnnnnnnnnnnnnnnn

SEQ ID NO: 25434 - DNA, 747 bp, Homo sapiens
  misc_feature: GYAE6OF02HNFO9.21.22.B11.1.454.CMB.1.raw
  modified_base (213)..(213): a, c, t, g, unknown or other
  misc_feature (213)..(213): n is a, c, g, or t
  modified_base (439)..(439): a, c, t, g, unknown or other
  misc_feature (439)..(439): n is a, c, g, or t
tcagtcgtcgctcgcacgaccggtgctcgatttagacgacagctcagggggggggaagctcagcttcagctgtgtagagaagacaggactcaggacaatctccagcatggccggcttccctctcctcctcaccctcctcactcactcgcgcgagggtcctgggcccagtctgtgctgactcacgccacctcacgcgtctcggggacccccggntaggagggtccaccatctcttgttctggaggaccactccaacagtacggaagttaattagtgtagttctggtactacagactaacctaccgaggaactccggaccccctaaactccgtacactccaaggaacgaataactcgacgccgtacctcggtacggtccctagaccgtacttcgtcgtcggactacgtacgtcgtcgctacctcgacccgtcccttcccgngtaccgtactccgggaaggttccggggccccttaacccggggtcgtaaacgggtccgttagggacccgggttaccgttagtaaacccggtttaactttcggtaccggtaccgtaggtaacccgttacggggacccggggtactaacccgttagaaccggggttagtaacccgttaaacggcttaacgtttccggggagggtaaccgggggttttcgggtttcggggggtaaaccttcggggggaaccgggtaaccgtaaaccccggttagtaccccggggtaaccgttacccgggtacggtacccggg

SEQ ID NO: 25435 - DNA, 819 bp, Homo sapiens
  misc_feature: GYAE6OF02I0XVA.21.22.B11.1.454.CMB.1.raw
  modified_base (227)..(227): a, c, t, g, unknown or other
  misc_feature (227)..(227): n is a, c, g, or t
tcagtcgtcgctcgcacgaccggtgctcgatttagacgacagctcagggggggggaagctcagcttcagctgtggtagagaagacaggactcaggacaatctccagcatcggccggcttccctcgtcctcctcaccctcctcactcactgcgcacgggtcctcggcccagtctgtcgctcgacgtcacggtcccacctcgacgccgttcgccgggggacccccgggnaacggacgggtccacctcgtcttcgttcgttcggtaacggcgaccaacctaccaacgcgttaacgggtaaacttaatttagtacgttgttcgttaggtactacgacgacctacgtccgaaaggtaacctccgaaccctaacttccacacctacgaagacgtaaacacgtcgaacgtccggccgtacggaccgggttaccctacgtaccgttacgtccgttcgtcggtactcgtaacgtcgttcggaccctcgtacctacggcccttacgtaccgtaacgtactaccggtacgggttacccgggtccggtacccgggtaccgtacgggtacgtaacggttaccggtaccgttaacgttaaccggttacgtttacggtcggtaccgttaacggccgttaaccgggtacccggtaacgaacccggtaacgttgggtaaaaccggtcgaaacccgtaacggttagtacccgggtttacgggttaacgggtttccggggtttaggggttacccggggttaagggttaacccgggaaccgggttaacccggttaaccggttacccggggtaaccggttaccggtaccgaaccccgggg

SEQ ID NO: 25436 - DNA, 391 bp, Homo sapiens
  misc_feature: GYAE6OF02I2QRW.21.22.B11.1.454.CMB.1.raw
  modified_base (279)..(279): a, c, t, g, unknown or other
  misc_feature (279)..(279): n is a, c, g, or t
  modified_base (330)..(332): a, c, t, g, unknown or other
  misc_feature (330)..(332): n is a, c, g, or t
  modified_base (334)..(335): a, c, t, g, unknown or other
  misc_feature (334)..(335): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (342)..(391): a, c, t, g, unknown or other
  misc_feature (342)..(391): n is a, c, g, or t
tcagtcgtcgctcgcacgaccggtgctcgatttagacgacagctcaggggtccctgaccgattctctggctccaagtctggcacctcagcctcccctgaccatcagtgggctccggtccgaggatgaggctgactattactgtgcatcgacgggacgcaaacatgggatgaacaatctgagcgggttgggtgttcgggcgggagggaccaaacgtgtaccgtcctaggtcacggccccaaaggcctccgccccccgttggcctactcctcgttaccccnccctcctcctcgtctcctcgtcgcggcggctggacgacggctatagtacgnnngnngntnacnnnnnnnnnnnnnnnnnnnnnnnnnnnnnnnnnnnnnnnnnnnnnnnnnn

SEQ ID NO: 25437 - DNA, 834 bp, Homo sapiens
  misc_feature: GYAE6OF02I8BYF.21.22.B11.1.454.CMB.1.raw
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
tcagtcgtcgctcgcacgaccggtgctcgatttagacgacagctcagggggggggaagctcagctttcagctgtggtagagaagacaggactcaggacaatctccagcatggccggcttccctctcctcctcaccctcctcactcactgacgcgacgggtcctcgggcccagtctgtgctgactcacgccacctcagccgtcgtccgggacccccggnacggaggtaccaccgattccttnttcgttacgngggacgacctaaccgtaccaacgacgttacgggaaatttaatttagtacgttaatttccgtaggtactacaagtaccaaccgtaccgtaaggaacgttaccccggacccctaaaactccctaacgacctaacggacgggaaaataacttaaacgtccgacggtaccccggtacccgtacggggttaccgggtaccccttacggacccgttaacgtttccgtcccgttaggtacccctaaccggttaaacgttccccgggtacggtaaccccttacccgtaccgtaaccggttccccttacccgaacccggtaccctacggtacccggtaacggtccgggttacccggtttacccggaccgggtagggtacgtacgggacgtaccgttacgtaaccgttacgttgtaccgtctaacgtacgaccggaacgggtaccaggtaaaccgtagggtacggtaaacgttaccgaacttaacgggttccgtaaggggtacgggtttacggggttacgggttacgggtcgggtaaccgggtaacggtaaccgtaaccggttacccggtaccggtaccgttagggaacccgg

SEQ ID NO: 25438 - DNA, 702 bp, Homo sapiens
  misc_feature: GYAE6OF02ICA25.21.22.B11.1.454.CMB.1.raw
  modified_base (164)..(164): a, c, t, g, unknown or other
  misc_feature (164)..(164): n is a, c, g, or t
  modified_base (686)..(686): a, c, t, g, unknown or other
  misc_feature (686)..(686): n is a, c, g, or t
  modified_base (691)..(691): a, c, t, g, unknown or other
  misc_feature (691)..(691): n is a, c, g, or t
  modified_base (696)..(697): a, c, t, g, unknown or other
  misc_feature (696)..(697): n is a, c, g, or t
tcagtcgtcgctcgcacgaccggtgctcgatttagacgacagctcagggtcctggcccagtctgtgctgactcagccaccctcagcgtctgggaccccggcagagggtcaccatctcttgttctggaggcaactccaaacatccggaagtaattatgtattacnggtactcagcaactccaggaatcggccccaaactccgtacactccaagacggaataatcgagccggacccttcgacgggttccctcgaccgtactctcgtagcctaccgaagtcctaggccacctccgacgccccttaccgtgaaccctagtcacgggtacgggcgtcccccggtaccggtaaggtaacgtcggaaggtccgtaggtacctttaagttacgtcgggtatcctaagtcccggtaacgggcaaccggtaaactgggtaggaacgtacgtaaaactacgtccgttaggaacgttcggggtttcggggtcgggttaacgggaccgggtaacgggaaccgttaaaccgtaccggaacccgttcgtacggtacgtaccggtacccgaaacggtccgtccgtacccccgtcgttaccctaccgttcccgttccgtccccgtaacccgtccgttcccgaacggtccgaccgtacgtacggcggccgggactacggcgaagtcgaccgtagtacgcgcagngcagnccaanncagcc

SEQ ID NO: 25439 - DNA, 742 bp, Homo sapiens
  misc_feature: GYAE6OF02FHP36.21.22.B11.1.454.CMB.1.raw
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcgagggtcctgggcccagtctgtcgctgactcacgccacctnagcgtcgtcgggaccccgggnaggacgggtcacattctcttgtctggagcaacctcaacagtacggaataattatgttattcgtaggtactcacgtaccaacctcccgaaggtaactccggaaccccctaaactcctacactaccgaaggtaacggaaactaactccgaacggtccggtaccctcgggtaacgggggttccctacggtaaccgtcttaccgttccggtcggtcccgttaaccgtaacggtccgttcgggaccctaaccgttcgaaccgtccccgttccctacggggggggggtacctacgtacgtacgggtccgggtccggttaccgggtaccggtacggtacggtacggtacggtcgttacgtaccgttacgttacgtacgtcgtacgtacgtacggacggtacgacgtaacgtacgtacggtacgtacgtacgtacgtacgtacggtacggttcgggttacgggttacgggttcgggtaccgggtaaccgggtaaccggtaaccggtaccggtacccggttaccggtacggtaccgg

SEQ ID NO: 25440 - DNA, 969 bp, Homo sapiens
  misc_feature: GYAE6OF02FHT58.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcatcctcctcactcactgcgcagggtcctggcccagtctgtgctgactcagccaccctcagcgtcgtcgggacccccggnagacggtcaccatctcttgtcgtggagctaactccaacatcggaagtaacttatgtattcgtaggtatcgaacgcctaacgtccaacggtaactaccggtaaccccccaaacgttcccgtacctaacgttacccgaaacgggtaaacggtaaaatttaaaccgtacccgtaaaccgggtacccgggttacccccgttaacggtaaacccggggggggtttaccccccttaacgggggtaaacccccgtttaaacggtttttaccccggtttaacccggttacggggttaaccccttaaccccgggttaaaaacgtttcccggttacccggggttaacccctaacccccgttacggttaaaccccggtcccccttttacccccggtaaacgtaaacccccggtacgttaaaacccgggtccggggtttaaacccggggtcccccggtttaaccccgggggtaccgggtaaacgggttaacggttaaacccgggtgggttaacccgttaaccggtaaacgttttaaaccgtttttaacggtacgggttaaccgaaccgttaaaccggttaacccgggtaacccgggggaaacctaaacccgggttaaaactaaacgggttcggggtaaacctacgggtaaccctaaagtttcccgggttaaggaaccgggggttcgggttttaacggggtccggttttacgggaaccggggtaccggttaaaccgtaaacggtttcccgggaacccggttacgtaacgggg

SEQ ID NO: 25441 - DNA, 342 bp, Homo sapiens
  misc_feature: GYAE6OF02JZ6CL.21.22.B11.1.454.CMB.1.raw
  modified_base (250)..(250): a, c, t, g, unknown or other
  misc_feature (250)..(250): n is a, c, g, or t
  modified_base (288)..(288): a, c, t, g, unknown or other
  misc_feature (288)..(288): n is a, c, g, or t
  modified_base (311)..(312): a, c, t, g, unknown or other
  misc_feature (311)..(312): n is a, c, g, or t
  modified_base (315)..(342): a, c, t, g, unknown or other
  misc_feature (315)..(342): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatcgtgagcgggttgggtgttcggcggagggaccaaatgaccgtccgtagtcagcccaaggctgccccctggtcacgtcncgttcccacctcctcctcgtctctacctgacggtcggnttgggactaacggccacgatagnntannnnnnnnnnnnnnnnnnnnnnnnnnnn

SEQ ID NO: 25442 - DNA, 919 bp, Homo sapiens
  misc_feature: GYAE6OF02I893P.21.22.B11.1.454.CMB.1.raw
tcagtcgtcgctcgcacgaccggtgctcgatttagacgacagctcgagggtcctgggcccagtctgtgctgactcagccaccctcagcgtctgggaccccggcagaggtcaccatctcttgtctggaggcaactccaacagtcggaataagttatgtattctggtatcagcaactcccaggactcggaccccaaactcctcatccaggaacggtaataacgtcgacgaccggcccttcggaacgggtcccctaggacccgtagtttcctccgtacggtcctaccgtaaggttaccgttcgggaccctaacccgttaccgaaccggttccccgttaccccgtacggtaaaccccaagttaccgggtaacggttccggggttaccccgtacccggggttaccgggacggtttacggtaccgggaacggttaccgtaccgtaaacgttaacgttttaacccggtcggtagtaacccgttagtacccggaaaccgggttaccggaccttaaaccgtacggtacggggtaacttacggaaacgtaaacggttcggtacgggtcggggttttaacggggtttcgggtaccgggtttaccgggggacgggtaaacccggttaaaccgtaaacccgggttaaccgggtacccgtttaaacggggtaaccgggttaccaaccgggaaacccgggtaacgggtaccccgtacccggttcccccgggttacggtacccggttaacccgttcccggttacccgttaacccccgtacccctttccccggtacccgttaccggttaccccttacggttacccggtaacgggtcggttaccccgggttcgtaacccgggtaagggtaacccggtacctaaccgtacgttaacgggcacccgtagacctacggttacgacgttcgcgtcgacgca

SEQ ID NO: 25443 - DNA, 753 bp, Homo sapiens
  misc_feature: GYAE6OF02I0EXF.21.22.B11.1.454.CMB.1.raw
  modified_base (712)..(712): a, c, t, g, unknown or other
  misc_feature (712)..(712): n is a, c, g, or t
  modified_base (717)..(717): a, c, t, g, unknown or other
  misc_feature (717)..(717): n is a, c, g, or t
  modified_base (726)..(726): a, c, t, g, unknown or other
  misc_feature (726)..(726): n is a, c, g, or t
  modified_base (731)..(731): a, c, t, g, unknown or other
  misc_feature (731)..(731): n is a, c, g, or t
  modified_base (738)..(738): a, c, t, g, unknown or other
  misc_feature (738)..(738): n is a, c, g, or t
  modified_base (752)..(752): a, c, t, g, unknown or other
  misc_feature (752)..(752): n is a, c, g, or t
tcagtcgtcgctcgcacgaccggtgctcgatttagacgacagctcagggtcctgggcccagtctgtgctgactcagccaccctcagcgtctcgggaccccgggcagagggtcaccatctcttgttctggaggcaactccaacatcggaagtaattatgtattctggtatcagacaactcccgaggactcggaccccaaactcctcactccagaaggaatatcagccgcctcgacgggtcctacggaccgtattccgtcgtcggcctaccgtaacgtcgtcggcctacctcaccgtccctcccgtacgtaacctacgtcgtacggtccgggtccgttccgggtacccgaggtacgtggaccggtactacggtaccttacgttacgtggtcgacgtaacgtaccggacggtacgaccaacgtagtagggtactaggactaacgtcgtacgtacgggtcgggttggggtacgttccggggacgggtacgggtaaccgtaacgtacggtaccggtacgttacggtacgtccggaacccgtacggtcccgtacccggttccccgtacgggtttacctacccgttaccttaccccgggtttaccccctaccccggttaccccttcccggttacccttacccgttaccggtaccgggttcccgggacccgggttccggtaccggacccgggtaacggtacccgtacggtacgtaccggngtccnggttaccgngaacncggtacncgactcgtacggtnc

SEQ ID NO: 25444 - DNA, 593 bp, Homo sapiens
  misc_feature: GYAE6OF02G0IC6.21.22.B11.1.454.CMB.1.raw
  modified_base (121)..(121): a, c, t, g, unknown or other
  misc_feature (121)..(121): n is a, c, g, or t
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
  modified_base (334)..(334): a, c, t, g, unknown or other
  misc_feature (334)..(334): n is a, c, g, or t
  modified_base (346)..(346): a, c, t, g, unknown or other
  misc_feature (346)..(346): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
  modified_base (502)..(502): a, c, t, g, unknown or other
  misc_feature (502)..(502): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
  modified_base (528)..(528): a, c, t, g, unknown or other
  misc_feature (528)..(528): n is a, c, g, or t
tcagtcgtcgctcgcacgaccggtgctcgatttagacgacagctcagggggggggaagctcagcttcagctgtggtagagaagacaggactcaggacaatctccagcatggccggcttccnctcctctcacctctcactcactgcgcgagggtccgtcgggcccaggtctgtgcctgactcgacgtccaccctnagtcgtcgtaccggggacccccggcaggtacgggtccacctagttccttcgttcggttcgnggacgacaacctcaactagtacggaagttatagtgtattcgngtatcagcaactcgagtactcgacccaactcactacnccagagaatacngacgccgtctacggacggtccagtaccgtatctgtcgactacgtagtcgtacgcctacgtcnccgtacctcctgacctcgtacgnggtccggtaccnccgggtacaggtactacgcgtcacgtagttactgtcgactacgacttacggaccggtanacgagtacgngtaacgnacgttacgngttaggcggttcggtcgggttctaacggggcgaacgtacctaaccgtgacccgttgtacgaccgg

SEQ ID NO: 25445 - DNA, 747 bp, Homo sapiens
  misc_feature: GYAE6OF02JF6XW.21.22.B11.1.454.CMB.1.raw
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
  modified_base (352)..(352): a, c, t, g, unknown or other
  misc_feature (352)..(352): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccaggtctgtgctgactcagccaccctnagcgtcgtcgggacccccggntacgagggtccaccgattcctcttgttccgtggacggccaacctccaaactagtccgggtaaagttaacttagtagtatttcgtaggttatcaagtaccaccttccgaaggtacgtccggaccccctaaactcccgtanactccgaaggaacggtaaactacgtaccgacggcccgggtacccgtcgggaaccggggttccctagggaaacccgtttcttccgttacgtccgggtacccttaccggtaaacgttccggttaccgggtacctaaaccccgttccgaaccggtttacccccgtccccgtaaccggaacccttaacgtccggtaacgggtcgggtacccgtccgggtacccgagggtacgttcgggacgtacgtacgtaacttacgtcgttacggctacgactcgtacgagggtaccagtaacgtaggtgggacttaacggacttaaccgtggtacggtacggtcggggttacggtcggttacggggacggtacggacccgtaacggtccggtacgtccggtaacgg

SEQ ID NO: 25446 - DNA, 840 bp, Homo sapiens
  misc_feature: GYAE6OF02HTJ9I.21.22.B11.1.454.CMB.1.raw
  modified_base (58)..(58): a, c, t, g, unknown or other
  misc_feature (58)..(58): n is a, c, g, or t
  modified_base (122)..(122): a, c, t, g, unknown or other
  misc_feature (122)..(122): n is a, c, g, or t
  modified_base (535)..(535): a, c, t, g, unknown or other
  misc_feature (535)..(535): n is a, c, g, or t
tcagtcgtcgctcgcacgaccggtgctcgatttagacgacagctcagggggggggaanctcagcttcagctgtggtagagaagacaggactcaggacatctccagcatcggccggcttcccnctcctcctcaccctcctcactcactcgcgcacgggtccgtcgggaccctagtctgtcgctagactcacgtcccacctcgacgcgttcggaccggggacccccggatagggacggtccaaccgtactttcgttcttcggttacgcgggacgacctaaccgtccaactaggtacggtaaagtttaattacgttacgtatttcgtaggtactacgacgtaccaaccgttaccggaagtaccgtacccgaaccccttaacgtacctactaactccgaaaggtaacgtaaaacttcgaccgacggtcccgccgtaacggtccgggtaccacggtaaccgttcttaccgtcggtacgaccgtaacctaacgttccggtacgtacccgtaccgtacccgccgttaccccgtacgtaaccncccgtaacgtttacgaccgggtttaccggtaccgtcccggggtaaccggtacggtaggtaaccggccggttcgttaacgttaaccgttacttacggtttacggcgtaaccgtttaccggacccggttaacgggtaccgaaaccgtttacgaacggtttaggaaccttacgttaaccggacgttttcgggtaacgggttacgggggtttccggggttaggttaacccgggggttaccggaacggggtaaacccgttaccgaaacccgggtttacccggaacccgtttccggggtaaacacccgggg

SEQ ID NO: 25447 - DNA, 771 bp, Homo sapiens
  misc_feature: GYAE6OF02GHUSF.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctgggcccagtctgtgctgactcagccacctcagcgtcgtcgggccccgganaggaggtcaccattctcttgttcgaggacgcaacctaccaacagtacggtaaattaattagttagttacttcgttaggttactacgacgacctaaccctacccgaagggtaacgtaccccggaaccccctaaacctccctaccgtactaccgaaggtaaacggtaaactaacgtacgacggtcccggtaccccgtacgggtaaccggggtccctaacggtaaccgttactttaccgtccgttacggcccgttaccgtaacggttcgtccgtaccctaccgtcctacccgtacccttcccgtaccgtaaccctgtaccggtagggtccgggtcccgtacccggggtacgaaggtcggtgaccgggtactacggtttaacttacgtttcggtccggtacgtactaccgggaaccgggtaccgaaccgaacgttaacggtacgtaacggtacgtaacacgttacgtggtacgggttcggggtttcggggttaacggggtcgggtaccggggacggtaaccggaaccggtaaccgtcccggtacgggtaccggtacggtaaccgg

SEQ ID NO: 25448 - DNA, 800 bp, Homo sapiens
  misc_feature: GYAE6OF02JDWKT.21.22.B11.1.454.CMB.1.raw
  modified_base (123)..(123): a, c, t, g, unknown or other
  misc_feature (123)..(123): n is a, c, g, or t
  modified_base (235)..(235): a, c, t, g, unknown or other
  misc_feature (235)..(235): n is a, c, g, or t
tcagtcgtcgctcgcacgaccggtgctcgatttagacgacagctcagggggggggaagctcagcttcagctgtggtagagaagacaggactcaggacaatctccagcatcggccggcttcccnctcctcctcaccctcctcactcacgtgcgcgagggttccgtcgggcccagtcttagtcgctcgactcacgcccaccctcgaggccgttaccggtccgggggacccccggganaacgggtacggggtaccaacctacttcctttccgtttggtttccgagggaaccggactaaaccttaccgaaacctaggtaaccggtaaagttaaactttagtacgtttaacgttccgttacggttactacgtacgaccgtaaaccttacccgaaagggtaaccgttacccggaccccctaaactcccgttacaacctaccggaaaggtaacggttaaactaacgtaccggaccgggccggttaccccgtacgggtacccggggtacccgtacggtacccgttacgttaccgttcggtcggtaccttacggtaacgtccgtacgaccttcctaccgaccgttcccgttaccacgtacccgtacgtcgtacggttacgggtccgtccggtacgagggtactcggacgtcgtacgtacgttacttcgtcggtactagtacgaccggtcgaaccgtacgtaacggttaggacgtaactcgaattacgttacgacgggtcggttagggttcgtcggggttacggaacgggttaccgtaacgtacgggtccgtaccggtttcacgggtccg

SEQ ID NO: 25449 - DNA, 872 bp, Homo sapiens
  misc_feature: GYAE6OF02FT2CU.21.22.B11.1.454.CMB.1.raw
tcagtcgtcgctcgcacgaccggtgctcgatttagacgacagctcagggggggggaagctcagcttcagctgtggtagagaagacaggacctcaggacaatctccagcatggccggcttccctcgtcctccgtcacctctcactcactgcgctagggtcctgggccctagttcctagtcggctgtactcaaggcccaccctcgagcgttcctcggggacccccggacggacgggttcaccgtattctcttgtcgtggacgacctaacgtccaactacgaccggtaattaacgttagtcgttattaccgtaggttactacacggtacctaaccgtccaacggtaacgtcccggtaaccccccaaagttccctacggtacctacccgtaaggtaaccgggtaaactacggtacctaccggggtaccggttacccccgtaccgggttaccggggggtttaaccccctaacggggtaaaccccggttttacgtaaccccgtttccgggttaccggttaccccgttaacggttaaaccgttcggtttaaccccggggaccctaacggttaccggtacccgtaccgtacccgtaaccgtacccgtacgttaccggtacgggttacggtacccggttaccgggttacccggtaagtacggttacgggtacggtaccgttacgtaccgtttaacgttacgggtattaccggacggtaacgtaccgggtacgtaaccggaccgaaacggttggtaacggtaacgtacgtaaccgttcgtaacggtgtacggggtaccggtttacgggtccgggttaccgggacggttaaccgggtaccgaaccgggtttacccgacgggttttacgaaccggttaacccgg

SEQ ID NO: 25450 - DNA, 374 bp, Homo sapiens
  misc_feature: GYAE6OF02JZBQT.21.22.B11.1.454.CMB.1.raw
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (338)..(374): a, c, t, g, unknown or other
  misc_feature (338)..(374): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacagtggggatgacaatctgacgtcgggttgggtcggttcggcgggacggaaccaacttggacccgtcgtaggtccacgacccgaaggctccgcccccgtggtaccncttcgtccgtacccctacccgtccctctccggtctcgttacngtcggcggtgtgacgacgcncctaatgacgtnnnnnnnnnnnnnnnnnnnnnnnnnnnnnnnnnnnnn

SEQ ID NO: 25451 - DNA, 408 bp, Homo sapiens
  misc_feature: GYAE6OF02F5CG1.21.22.B11.1.454.CMB.1.raw
  modified_base (165)..(165): a, c, t, g, unknown or other
  misc_feature (165)..(165): n is a, c, g, or t
  modified_base (242)..(242): a, c, t, g, unknown or other
  misc_feature (242)..(242): n is a, c, g, or t
  modified_base (291)..(291): a, c, t, g, unknown or other
  misc_feature (291)..(291): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
  modified_base (349)..(408): a, c, t, g, unknown or other
  misc_feature (349)..(408): n is a, c, g, or t
tcagtcgtcgctcgcacgaccggtgctcgatttagacgacagctcaggggtccctgaccgattctctggctccaagtctggcacctcagcctccctgaccatcagtgggctccggtccgagatgagctgactattacgtggtgcagtccgacgggccgcctaaanagtgggatacgaactaatccgtgaggtcgggttggtgttccggacggacggaccaaacgcggccttacgacggtacncgtacccgaagtcgtcccgtaccgcgtaacctctccgtcccgttccccncccctctctccggaaccttctcgtcaacggtcgtaccgngnggccacggttacngtcnnnnnnnnnnnnnnnnnnnnnnnnnnnnnnnnnnnnnnnnnnnnnnnnnnnnnnnnnnnn

SEQ ID NO: 25452 - DNA, 753 bp, Homo sapiens
  misc_feature: GYAE6OF02FVFX9.21.22.B11.1.454.CMB.1.raw
  modified_base (539)..(539): a, c, t, g, unknown or other
  misc_feature (539)..(539): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgccgcgacgggtccgtcgggcccagtctgtcgctgactcacgccaccctcgacgcgtccggtccgggacccccgggctacggacgggtaccacctacttccttcgtttcgttcgtaggtacggaccgtaaccttaccgaactaacggtacggtaaacgttaacttaattagtttacgttcgttagggtaactcgacgaacctaaccgtacccgaaacggtaaccgtccccggaacccccgtaaaccgttccctaccgtacctaaccgtaacggaaacggttaaactaacgtccggtaacggcccggtaccgtcgggtaccgggttacctacggtaccgtacgttccgtcgtcggtacctacgtacgtccgtgaccctaccgtcaccgtccnccgttacgacctagcgtacggtcgccggtccggtacgtcgagtcgacgactcgttaacttagtcgtcgcgtaacaggtaccgaccggacgacgactggtacgtctacgtacgttcgtaccggaggtttccgggtacggggtttgggtaccggttcgggtaacgggaaaccggtaccgtaaccggttcccggtacccgttacggtccgtaaccgg

SEQ ID NO: 25453 - DNA, 755 bp, Homo sapiens
  misc_feature: GYAE6OF02IG584.21.22.B11.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcagggtcctcgggcccagtctggtgctcgactcacgcccaccctnacgccgtcgtcggggaccccccggnaggacggtccacctatccttccgttgttccgtgggacgctaacctccgaaacacgtcggaagttaattatgttattcgtaggtactcgaacgccaacctcccgaaggtaacgtacccggaccccctaaactccgtacacgtaccaagaaggttaaatacgtacgacgccggccctacggtaccggggtcccttacggaccgttacgttccgttccgttaccggtccttacccgtaacgttccgtacggacccctaacccgttccgtaccggtaccccttcccgtacccgaaacccgtctcggtaaccgggtcgggttccgtacccgggtaccgaggtaccgtggaacgttccgtaagtaccttataccgtcggcgtacctacgtacgggaccggtaaccacgaacgtggacgggtacgtaacgtaaccgtatccgttagggtcgggttcgggtttacgggtcggttaacccggggacgggtaacggtaaacccgttaaccgttaccgggtaacccgttaccggttaggacccgg

SEQ ID NO: 25454 - DNA, 821 bp, Homo sapiens
  misc_feature: GYAE6OF02IHJIE.21.22.B11.1.454.CMB.1.raw
  modified_base (127)..(127): a, c, t, g, unknown or other
  misc_feature (127)..(127): n is a, c, g, or t
  modified_base (245)..(245): a, c, t, g, unknown or other
  misc_feature (245)..(245): n is a, c, g, or t
  modified_base (577)..(577): a, c, t, g, unknown or other
  misc_feature (577)..(577): n is a, c, g, or t
tcagtcgtcgctcgcacgaccggtgctcgatttagacgacagctcagggggggggaagctcagcttcagctgtggtagagaagacaggactcgaggaacaatctccagcagtcggccggctttcccnctcctcctccaccctcctcacctcgactcgcgacgtcgggtccgtcggcctagttctcggtcgactgtactcgacgaccctacctcgacggtcggtccggttaccgggggaccccggnaacgggtacgggtccaaccgtctttcgttcgttacggttcggcggtaccgaccgtaaaccaccgtaaaccgtaaggttaacggtaacgtttaaagtttacgttaagttaccgtttacgtacgggttaactccgaaccgttaacccgtaacccttaaccggtaacggaacccgttaaccccggaaaccccctttaactacccgaattaaccacggaacggtaaaacttaacgtaacgtacgaccgccggttaacccgcggtaccggggtacctaccggactttcgttaccgtaggcccgtttacacgtacgttccggaccgttacacggtccncgttacccgtcctcgacctacgtacgtacggtgtacccggtcggtacggacgcgtcggtacgacgtactaacgttacgtcgtcgtacgtactaccgaccgtacggaccacgtacgtacgggtaacgtacggtaacgtacgtacgtacggtaggtacgggttacggggttcggggtaaccgggtaccggacggggtaacggtaacccgtacgggttaaccggttacggaccggttacgaacccgg

SEQ ID NO: 25455 - DNA, 625 bp, Homo sapiens
  misc_feature: GYAE6OF02F0LZC.21.22.B11.1.454.CMB.1.raw
  modified_base (237)..(237): a, c, t, g, unknown or other
  misc_feature (237)..(237): n is a, c, g, or t
  modified_base (413)..(413): a, c, t, g, unknown or other
  misc_feature (413)..(413): n is a, c, g, or t
  modified_base (596)..(596): a, c, t, g, unknown or other
  misc_feature (596)..(596): n is a, c, g, or t
  modified_base (602)..(602): a, c, t, g, unknown or other
  misc_feature (602)..(602): n is a, c, g, or t
  modified_base (607)..(607): a, c, t, g, unknown or other
  misc_feature (607)..(607): n is a, c, g, or t
  modified_base (612)..(613): a, c, t, g, unknown or other
  misc_feature (612)..(613): n is a, c, g, or t
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (624)..(625): a, c, t, g, unknown or other
  misc_feature (624)..(625): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctgtatcagcaactccaggaatcggaccccaaactcctcatccagaaggaataatcagccgcctcgacgggtcccngaccgtattcgtcgtcggcctaccgaagttccgtcggacctaccttcgaacgtcccctacccgtcgaaccctacgtaccgacggtcggggccttaccccggggtccggaaggtacgttggacggtccgtacgtactttaacgtctgtcgactacgtacgaaccgggacacaacggngtacgggatacggactaacgtcgtagtacggtcgggttgggtacggtcgggacggtaacgggaacgaacgtcgtaccgtacgtacgtcgacgaccgacggccgtccgtcccgttcgtcctaccgtccgtccgtccccgtccctccgtcctccgtctcctacgtcgtcgcgcgtcgacgtacgngtacgngtcgntgcgnntnctncgntcnn

SEQ ID NO: 25456 - DNA, 588 bp, Homo sapiens
  misc_feature: GYAE6OF02FIGDM.21.22.B11.1.454.CMB.1.raw
  modified_base (280)..(280): a, c, t, g, unknown or other
  misc_feature (280)..(280): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgtctggaggcaactccaacatcggaagtaattatgtattctggtatcagcaactcccaggaatggcccccaaatcctcatccagaggaataatcagcggccctcaggggtcccctgaccgattcgtctggctccaagtctggcacctcagccctcccngaccatcgagtcggctccggcaggatgaggctgatactntgngtacagtccacgggtacncaacgtgtagggatacggaacaagtcgtaggaagtccgggtttagggtcgttacgggacgggtaacgggtaaccgaaacgtacggtaccgtacccgtaggtacaacgtacccaaggtccgtacccgccccgttacggtcctaccgtcctaccgttccccgacccttccctacccgtcgtccttacctcgttagacggtcggcgtcgaccgtaggccgatacgtagntncgtancgncactganactnc

SEQ ID NO: 25457 - DNA, 922 bp, Homo sapiens
  misc_feature: GYAE6OF02HEMT7.21.22.B11.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagacgacagctcagggggggggaagctcagcttcagctgtggtagagaagacaggactcaggacaatctccagcaatggccggcttaccctctccctcctcacccctcctcactcactgacgcgagggtcctagggacccagtctgtgactggaacctcgaacgcccgtaaccctcgacgtccggtccgtaccgggggtacccccccgggnaacgggtacggggtccaaccctagttccgttacttggtttccgtggggaacggtaccctaaacgtaccctaaaccggtacgtaaccgggtaaagttaaacgtttaacgtttcggttaacttttaccggtacgggttaacttaccgaaccggttaccaaaacccggttcccgtaaacggggtaacgttaccccgggaaccccccttaaaacgttaccccgtacgtaaccgttaccggaaggtaaacggaaaactttaccgaccgtaacgggcccgtaccccggtcggtaacccggggttaccctagggtaacccttacgttaccgtacggttacccggtcccgttaaggtaaacggttcccgtacgggtaccctaccccggttcgaccgttaccccgttacccgttacgaacccgtacgtcggtaacgggtcgggttacccgacccgggttaccggaaggtcgtaggcggtactacggtacttacgtagcgttacgacgtacgtcccggacggtaccgaacttacgtaaggtccggtaacgtaagtaacccttaccggtacgtaccggggttacgggttacccgggggttttaagggtccgggttaaccggggaaccgggttaacccgggaacccttaaccgggttacgtaacccccgggttacgtaccgggtaacccg

SEQ ID NO: 25458 - DNA, 725 bp, Homo sapiens
  misc_feature: GYAE6OF02FTAC7.21.22.B11.1.454.CMB.1.raw
  modified_base (204)..(204): a, c, t, g, unknown or other
  misc_feature (204)..(204): n is a, c, g, or t
  modified_base (693)..(693): a, c, t, g, unknown or other
  misc_feature (693)..(693): n is a, c, g, or t
  modified_base (700)..(700): a, c, t, g, unknown or other
  misc_feature (700)..(700): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcgagcaactcccaggaatcggacccccaaactcctnactccagaggaataatcagccggcctcgacgggtccctgaccgattctctcggcctccgaagtccgtggaccacctcacgtcccctcccgtacgaaccctactcgtaacggtcgggccttcccggggtccgaaggtactcggaacggttcctaggtaaccttacttacgtcgtcgactaacgtcgaacgggactacctaacgaggttcgggatacggaactaaacgttccggtaggacggttcggggtttacggggttcggttacggggaccgggtaacgggtaaccgttaaacgtcggtaacccggttaccgtaacgggtacgtaaccggacccggttaagggtcccgtacccggttcccccgttacggaccttaccgttcccgttccgttacccctaccccgttacccgttacccttccggttccttaccgtaccgtcggtaaccgtccgggtacgttacgaccgtaaccggtccgacgtagtacgnacggtanctaccgtgactacgcgtagcacgtg

SEQ ID NO: 25459 - DNA, 814 bp, Homo sapiens
  misc_feature: GYAE6OF02G1YQ3.21.22.B11.1.454.CMB.1.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctccaccctcctcactcactgcgcagggtcctggcccagtctgtgctgactcacgccaccctnagtcgtcgtccgggacccccggnaggacggtaccaccgtacttcttcttagtcgtggacgactaacgtccaactagtacggtaattaagttattagttattcgtgtactaccgagtacctaaccgtacccgtaaggaacgtcccggaaccccctaaccgtaccctactactaccgaagaagtaactaacgtcgaccggtccgacccgtacggacccgggtcctacgtaccgtcttccgtgtacgtaccgtaccgtaggttcctacgtaccctaccgtaccctaccgtcccctccgtaccgtaacctacgaccggtacgggtcccggtccgtaccggggtaccgtaagggtacacgggttaccggcggtttacgttaaccgttaacgtttccggtagtaccgtaccgttaaccgggtacccggtaaccgggggtaaccaaccggtaaccgttaccgggggtaagtaacccggtacgtaaaccgtcgttaccggggtacgggtcggggttttaccgggggttacggggttcccggggttaaacggggaacccgggtaacccgggttaacccgtaaaccgggttcccgggttaaccccggttaccggttaccgggtaaaccccggg

SEQ ID NO: 25460 - DNA, 943 bp, Homo sapiens
  misc_feature: GYAE6OF02G2ZHA.21.22.B11.1.454.CMB.1.raw
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactgcgcgagggtccgtcgggccctagtctgtgctgacctcacgcccacccgtcacgtccggtccgtccggggacccccgggcgacgggtacgggtccacctacttcttcgtttgttcgtggacgtacactaccaactagtacggtaattaattagtattagttctaggtataccgacgaccaacctaccggtaaggaccgtacccggaaccccctaaaccgttcccacctacgtaaccgtaaggtaaacgtaaactacgccgaccggtacccggtacccgtaccgggtaacccggtacccggtacgtaccgttacgttccgtacggtccgtacctacggtacgtacgtcgaccctaccgttaccgacccgtccccgtacgtaccctaaccgttagtaacccggtcggggttccggttacccggggtaccccgggtagggtaaccgggtacgtaaccggggtacggttaacccggtacgtttaacggtttaacccgtttacggtaccggttaccggtaacccgttaaccgggttacccgggaaacgggggtaaccctaaacccggttaaacggtacggggttacggtaaaaaccggtaccggtaacccgttagggtttaacccgggtttaggggtttccccgggggggttttacgggggggttttaacgggttcccgggggttaaccccggggggggtaaacgggtaaaccccgggggttttaaaaccccggttaaccggggttaaccccggggttttaacccgtaaccggggtttacccgggtaaaccccccggggg

SEQ ID NO: 25461 - DNA, 872 bp, Homo sapiens
  misc_feature: GYAE6OF02HJQHO.21.22.B11.1.454.CMB.1.raw
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctcctcaccctcctcactcactcgccgcgacgggtccgtcgggccctagtctgtcgctcgacctcgacgccctaccgtcacggtcgttaccgtccgggggaacccccggnagggtaccgggtacaacctnttccttcgtttacggtttcggaggacggaccctaactacccgaaacgtagtaccggtaaaggttaaatttagttagtttacgttacgtacggtagttacaccgacgtaaccgtacccgaacggtaacgtcccggaaccccttaaaccgtcctacgtaccgaccgaacggtaacggtaaacttaactacgacggtacccggtccgtaccggtaccggggttaccacggtaaccttacgttaccgtccggtacggtacctaccgtaagtccgttacggacctaacccgtaccgtaaccgtcccgttaccgtacaaccgtcgtaccgtacgggtacggtacccgtaccgggtaccggtaggtacgtacgggaacgttacccgagttaaccggttaacgtacgttcgtaccggtaacgtacccggttaccggaacccgggaacggaaccgttaaccggttaaggggtaaaccggtacgttaactaaccgggtaccttaacgggcggggtttaacggggttaccggggtgggtttaacgggggtaccgggtaaccggggaaccggttaaccgggtaaccggttaaccccgggttaaccgtcgggttaccgggtaacccggg

SEQ ID NO: 25462 - DNA, 822 bp, Homo sapiens
  misc_feature: GYAE6OF02FRVAE.21.22.B11.1.454.CMB.1.raw
  modified_base (789)..(789): a, c, t, g, unknown or other
  misc_feature (789)..(789): n is a, c, g, or t
  modified_base (800)..(800): a, c, t, g, unknown or other
  misc_feature (800)..(800): n is a, c, g, or t
  modified_base (805)..(805): a, c, t, g, unknown or other
  misc_feature (805)..(805): n is a, c, g, or t
  modified_base (819)..(819): a, c, t, g, unknown or other
  misc_feature (819)..(819): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaaactcccaggaatcggacccccaaaactcctacacgtccagaggaaataatcacggcggccctcgacggggtccctacgaccgtattccgtcgtcggcctaccgaaggttctggaccaaccgtcgacgtcccctccgtacgaccctacgtacgtacgggtcggggtcccgttacccgggtacccggaagggtacgtagggtaacggtccgtacggtaaccttttaacgttaacgttcggtccgtacgtacggtaccggaaaccgggggtacctaccgtaaaacggtacgggttaggggaacttaccgggtaaactaacgttcggacgggtacgggttacggggttttcgggggttacggggttccgggaaaggggtaaccgggtaaaccgttaaaccggtacggttaaccccggttaacggtaaccgggttaccgaaccggtacccgggtaaccggtccggtacccgttacccccggtacggttcccgttacccgttccgttaccccgttccctaccccgttaccccttccggttacccgttccgttaccgttacccggtacggtaccggggtacccggtcggtacggaaccgggccggtaccgcgtaagtcggancgcgttaccgngtacncgtacgacgtactnatc

SEQ ID NO: 25463 - DNA, 1058 bp, Homo sapiens
  misc_feature: GYAE6OF02G5SJH.21.22.B11.1.454.CMB.1.raw
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcaggtcctcgggcccagtctgtcgctcgactacgacgccctaccctcacgtccgttcgtaccgggggaccccccgggtcgacggtacgggtacccaaccacgttccgttcctttaggtttccgacggggtacggtacctaaaccgttacccgaaaaccgttacgttaaccgggtaaaacgtttaaagttttaacgttacgttttaacgtttacccgtttagggtttaactaccgtaacgtaacccgtaaaaccccttaccccggtaaacgggtaacccgttaccccgggtaaaccccccctaaaaccttacccccgttaaccgtaaacccgtttacccggaaacgggtaaacggtaaaaacgtttaaccgttaaccgaacccgggtccccggtaaccccggttccgggttaacccgggggttaccccgtttaaaccgggaacccggtttaaccttacccggtttccggttaccggttaacccgtttaaccggtaaccgttacccggtaccgggtacccttaccccgttaccgtaacccggttcccccccgtaacccgttacccggaaaccccggttaacttaccccggggtaaccggggtttcccgggtttcccggttaaccccggggtaccgggttaacggggttaaccggttacggggtaaccgggttaccgtttaaaccggtaaccgttttaaccgttacccgtttaacgggtccgttaaccgtacggttaacccgggaaacccggggtacccgtaaacgaaacccgttagggtaaccggttaagtaaccgtaacgttacggtacgttacgggtacgggttacgggtttcggggtcgggttaaccgggacggtaacgggtaacccgtaacggtttacccgggtacccgtttacgtaacggtacccgg

SEQ ID NO: 25464 - DNA, 870 bp, Homo sapiens
  misc_feature: GYAE6OF02JVGG0.21.22.B11.1.454.CMB.1.raw
  modified_base (58)..(58): a, c, t, g, unknown or other
  misc_feature (58)..(58): n is a, c, g, or t
  modified_base (146)..(146): a, c, t, g, unknown or other
  misc_feature (146)..(146): n is a, c, g, or t
  modified_base (231)..(231): a, c, t, g, unknown or other
  misc_feature (231)..(231): n is a, c, g, or t
tcagtcgtcgctcgcacgaccggtgctcgatttagacgacagctcagggggggggaanctcagcttcagctgtggtagagaagacaggctcaggacaatctccagcatcggccggcttccctctcctcctccaccctcctcactcnctgctcgaggtcctcgggaccagtctgtcgctgacctcgacgcccaccctccgaggtcggttccgccggggaacccccccggggngtacgggtaccggtacccaaccttcttcccgtttcgtttcggttcgtaacgggaccgtaccaacctacccaaacgtacggtaacggtaaagttaagttagtacgttagttcgtagtactacacgacctaacctaccgtaacgtacccgtacccgtaacccctaacgtcctaactacgtaaccgtaaggtaaacggtaaacgtaacgtaccggccggtacccggtacccggtaccgggtaacccggggttaccgtaccgggtacttaaccggtttccgtcgggttaccgtacccgttaccgtacgttccggttccgggtaaccctaaccgttcccggacccgttacccgtaccctaccgtaaccgtaacgttaccggtacgggtccgggtaccggttaccgggtaccggtacggtacggtacggttaacggtacgtacgttacgttaacgtcggtacggtcgtacggttaccggtaaccggtaccggggtaaccgtaccgtaaccggtacggtaacggtaacgacgtaccgtacgttacggtacggtcggggttccgggttcgggtaccggtacgggtaaccgggtaacggtaacccgggtaaccggtacccgggtaccggttaccggtacggtacccgg

SEQ ID NO: 25465 - DNA, 976 bp, Homo sapiens
  misc_feature: GYAE6OF02JA9TQ.21.22.B11.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagtcgtcgctcgcacgaccggtgctcgatttagacgacagctcaggggggggggaagctcagcttcagctgtggtagagaagacaggactcaggacaatctccagcatggccggccttccctctccctcctccaccctcctcactcactgcgcgacgggttcctcgggccccagttctgtgctgactcagcccaccctnagccgtcgccggggacccccgggnaggtcggtactacacttcttcttgttcgcgggacgaccaaacctaccgaaacacgtaacgggtaaagtttaaaattagtaggttaacctttcggttaggttaactcctaaacggaccctaacccctacccgtaacgggacgttaacccccgggaacccccccttaaaactcccctaccgtaacccgttaaccaacggggtaaacggttaaaacttaaccgtaccggtaacccgggtcccccgggtaacccccggttacggggtaaacccccggggggttcccttaaacgggttaaccccggtttaacctttacccggttccgggtacccggttacccggttaaccgtaaaccggtttcgtccccggtacctaaccccgttaccgacccgtttaccccgtttaccccaccggtaccctaccgttccggggtaacggttcccgggtaaccgtccccgggtaaggtacgggtagttcggggacgtttaacggacgtttaaccgtttaacgtttccgtcgggtaacgtacgtaaccgtcccggggaaacggttacccggaaacctaaaggggttcgtagggttaactaaccgggtaacccttagggttcccgttaacgggggtagggttttacccgggggtttttacgggggtacggggtttcccggggaaaccgggggttaaacccggggttaaccggtaacccggttttaacccgggggaacccggtttacccgggttacccgggtaacccgg

SEQ ID NO: 25466 - DNA, 839 bp, Homo sapiens
  misc_feature: GYAE6OF02GIQVE.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggaccccggnaggagggtcaccatctcttgttcgtggacgctaactccaaactagtcgggaaattaattatgtattcgtaggtactcagtcctaactcccgaaggtacgtccggaaccccctaaaatccctacgaacttaccgaaaggtaagtaaacgttaaatcccgaacgggtacccggtaccccttacgggtaccgggggttacccctacgggtaaacccgttacgttttccggtaccgttacgggtacctaacccgtaaacggtttccgtcggggtaacctaacccggttcaaacccgggtccccttacccgttaacgaaccccgtacttaccggtaaggggtcccgggtacgttacccggggtaacgaccgggtaattccgggaacggtccggttaacgtaacttaactttacggacgttcgtaccgtaacggtaccggtaaccgggaaccgacgtaaaccggagtttacgggaaattaaccggtaaacgtacgtttacggagggttaaccggggttcgggggttttaaaccgggggttcggtaacccggggtaacgggggttaaccgggtaaacccccgttaaaacggttacccggggtaccccgggtttaaccggtaacgggtaaccccgg

SEQ ID NO: 25467 - DNA, 837 bp, Homo sapiens
  misc_feature: GYAE6OF02GKN75.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagccgtcgtcggggacccccggnaggacgggtcaccatcttcttgttctggacgcaactccaacatacggaagtaattatgtattcgtaggtatcgagacaaactcccgaaggtactccggaacccccctaaactccctacgaactccgaaggtaacggtaaattaactaccgtacggacccggtacccctacgggtaaccgggggttacccctagggaacccgtaactttcctacggtacggtaccttaccgtaaacgttccgtacggaccctacccgttacgacccgtcccttacccgtacgaaccgtaccgtacgtacggggtccggtcccgttaacccggggtaccggaacgggtaagtcgggaaccggtacgttaaccggtaacctttaaacgtttaccgtgggttacgaaccgtaacggttacccgggaaacccgggggtaaccctaaacgttaaaaccggtacgggttaacgggggtaacttaaccggtaaaccgttaacgttccggttaaggggtaccgggtttacggggggtttacgggttaaccggggtttaccgggggaaccggggtaaacggggtaaccccgttaaaaccgggttaccgggtaaccccggtttacccggaaggggttaaccccg

SEQ ID NO: 25468 - DNA, 816 bp, Homo sapiens
  misc_feature: GYAE6OF02IWKBE.21.22.B11.1.454.CMB.1.raw
  modified_base (57)..(57): a, c, t, g, unknown or other
  misc_feature (57)..(57): n is a, c, g, or t
  modified_base (174)..(174): a, c, t, g, unknown or other
  misc_feature (174)..(174): n is a, c, g, or t
  modified_base (216)..(216): a, c, t, g, unknown or other
  misc_feature (216)..(216): n is a, c, g, or t
tcagtcgtcgctcgcacgaccggtgctcgatttagacgacagctcaggggggggaanctcagcttcagctgtggtagagaagacaggactcaggacaatctccagcatggccgcttccctctcctctcaccctcctcactcactgcgcgacgggtccgtcggccctagtctgtnctgactcacgccctcctcgagtcgtccgccgggacccccggnaggacggtaccacctattcctacgtttgtactgggacgtacctaacgtcccaaatagtaacggaaagttaacttacgttagttaacgttcgtacgtaactacgaactaaccgtaacccgtaccggtaacggaaacgttccccggaaaccccctaaacgttccccgtacctaaccgtaacccgaaggtaaaaccggtaaacttaacgtaacgaccggtaccgtacccgtaaccgggtaccggtacccgtaccggtaaccttaacggttccgtcggttacggtacccttacggaaaccgtttcgaccgttaccgtacccgtaacgtccccgttacccgtaccctacggttaacctaaccgttacggtacgggtccggtaccgtaccggggtaccgtagtaccgtacggtacgtacggacgttaacgttcgaacggttcgtacgtaccgtaacgggtccggaaccgtacgtaacggaaccgtcggttaaacggcgtaaacgtacttcgacggtttcggaacggggtttccggtagggtttccgggtacgggaccgggaacccggttaagtaaccgtcccggttaacgcgttaccgggtaaccg

SEQ ID NO: 25469 - DNA, 735 bp, Homo sapiens
  misc_feature: GYAE6OF02HSKDR.21.22.B11.1.454.CMB.1.raw
  modified_base (221)..(221): a, c, t, g, unknown or other
  misc_feature (221)..(221): n is a, c, g, or t
  modified_base (269)..(269): a, c, t, g, unknown or other
  misc_feature (269)..(269): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctccactccactgcgcgagggtcctcgggcccagtctcgtgcctgactcacgcccaccctcagccgtcgccgggacccccgggnacggacgggtccacctactcttcttgttcgtggacgacactccaaacngtacggtaattaattatgtacttcgtagtatacagcaacctcccgaagactcggaccccaactctacactccgagagtaactaagtcaaggtcccggacctacgtaaccggggtcctacggaaccgttatttccgacgttacggtcctaccggtaagtcccgtacggtacctacccggttacacccgtcccctacccggtaccgtaaacccgtctcgggtaacggtccgggtacccgtcccgggtaacgtacggtacgtacggtaacggtcgtaacgttaccgttacttacgtacgtcgaactacgtaccggtacggaccgaactaaccggtcggtaacggaattaccggaaacgtacgttcggtacggggtaacgtttaccgggggttagggtccggtttaaccggggacggttaaacggaacccggttaacgttccgggtaaaccccggttcggtagtaccccg

SEQ ID NO: 25470 - DNA, 805 bp, Homo sapiens
  misc_feature: GYAE6OF02GGFDC.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcacgggtcctgggcccagtctgtgctgactcacgccaccctcacgcgtcgtcgggacccccggnaggacgggtcaccatcttcttcgttcgtggacggtaccaacctaccaacacgtacggaaagttaattagttgtattcgtaggtactacgacgaccgaacctccgaaggtaacgtaccggtacccccaaaacttccgtaccacgtaccgaaggaacgtaaataacgtacgacggacccggtaccctacgggaccgggtccctacggtaaccgtcttaccgtacgtacggtcctaccgtaacggttccgtcggacctacccgtaccgtaccgtacccctccctacgaaccgtactacggtacgggttcgggtacccgtacccgggtacggacggtacgttcggaacgtacgtacgttacttaacgttacgtacggacgttacgaaccgttacccgggtaaccgggacccttaacgtaaccggttaaggtaccgggtaaacgttacgaaaccgtttacggtaccgttaacggggtcggggtttaaccggggtttcgggggttaccgggtttaccgggggaacgggtaacccgggtaaacccggttaaacccggttaacggtccccggtttaaaccgggtacggtaaccccgggg

SEQ ID NO: 25471 - DNA, 898 bp, Homo sapiens
  misc_feature: GYAE6OF02IUR41.21.22.B11.1.454.CMB.1.raw
  modified_base (111)..(111): a, c, t, g, unknown or other
  misc_feature (111)..(111): n is a, c, g, or t
  modified_base (240)..(240): a, c, t, g, unknown or other
  misc_feature (240)..(240): n is a, c, g, or t
  modified_base (272)..(272): a, c, t, g, unknown or other
  misc_feature (272)..(272): n is a, c, g, or t
  modified_base (592)..(592): a, c, t, g, unknown or other
  misc_feature (592)..(592): n is a, c, g, or t
tcagtcgtcgctcgcacgaccggtgctcgatttagacgacagctcagggggggggaagcctcagcttcagctgtggtagagaagacaggacttcaggacaacgttccacgngactaggtccgggcgtttcccgtccctccctccctctaccctaccctcacctcgcctcggtcggcccgaggggtccctgggtcccgtaacgtcgtgttcggaccttgacgttacccagccgaccctccngaccggtccttggggacccccgggggtacccngaacggggtccacccctaacggttcttccttcgggtttcctacggtaacggggtcaaacccttccgttaaacccgaatttaccggtaacggtaaagtttaacttcgttaacgtttctttacggtagttacctaacgtccgaactacccgttaccggaaacgttacgccccggaactaccgtacacgtacctaccgaggaaacggtactacggtaaccggtaccggtcgtaccccgaaggggttccccggtaccgttacggaccctttcgtaacgtccgttaggtccctaacgtcgtccgacgaccgtccacggttacccncctaccgtcgtaccgtacggtacggtacggtccgggtccgggtaccgggaccgttacggaggtaccgtacggttaccgtaacggtaactttacgtacgttccgggtacggtaactaccggaaacgtaccgggttaccgtaaagtacgtacggttaaccggttacgtaccggtaacgttcgttaacggggttcggttaacgggggtttacccgggttaacgggttcccggggttaaccggggtacgggttaaaccgggtaccggttaaaccgggtcccgtaaccgggggtttcctacgtaccccggg

SEQ ID NO: 25472 - DNA, 909 bp, Homo sapiens
  misc_feature: GYAE6OF02IT0DD.21.22.B11.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcacgggtcctgggcccagtctgtgctgtacctcacgccaccctcaggtccgtcgtcgggggaccccccgggtanacggaggggttccaaccgtattcccgttcctttggttccgtagggacggtcctaaaccttcccaaaactcgttaaccgggaaaggtttaaacttagttcggtttaactttccgttaggttaacttacgaacggtacctaaacccttaccccgtaagggaaacgtttcccgggaaccccccctaaaaaccgttcccttacctaacgtaccccgtaaagggtaaaccggtaaaacttaaacgttaccggaccggtaccggggtacccccttacgggtaaccggggggttccccctaggtaaaccccggttactttaccgttccgttaacggggccctttacccggtaaacggtttcccggtcggtaacccgtaccctacccggtacgtacccccgttacccgttacccggtaccctaaccgttaccgtacgggttaccggttccggtacccgggttaccgggtaacggtacgtacgggtacggtaccgtacggtaccttaagttaccgtgtacgtccttagtaccgtacggtaccgacgtaaacgtacggtcggtaacgtacgtaacaccgttcggtaaacggcgggtttaccggggttcgggtttacgggttacccggggtacgggtaaccgggttaacccgtaaaccggttaaccggtacccggttaaccggtcggtaaccccggg

SEQ ID NO: 25473 - DNA, 642 bp, Homo sapiens
  misc_feature: GYAE6OF02F0BNH.21.22.B11.1.454.CMB.1.raw
  modified_base (164)..(164): a, c, t, g, unknown or other
  misc_feature (164)..(164): n is a, c, g, or t
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (414)..(414): a, c, t, g, unknown or other
  misc_feature (414)..(414): n is a, c, g, or t
  modified_base (594)..(594): a, c, t, g, unknown or other
  misc_feature (594)..(594): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (623)..(623): a, c, t, g, unknown or other
  misc_feature (623)..(623): n is a, c, g, or t
  modified_base (628)..(628): a, c, t, g, unknown or other
  misc_feature (628)..(628): n is a, c, g, or t
  modified_base (641)..(641): a, c, t, g, unknown or other
  misc_feature (641)..(641): n is a, c, g, or t
tcagtcgtcgctcgcacgaccggtgctcgatttagacgacagctcagggtcctgggcccagtctgtgctgactcagccaccctcagcgtctcgggaccccgggcagagggtcaccatctcttgttctggaggcaactccaacatcggaagtaattatgtattcnggtatcagcaactccaggaatcggaccccaaactccnactccagagaataatcacgccggccctgacgggtcccngaccgtnttcnctggctccagtcncggaccaccgtcacgtcccttccgtacgacccatcgtacgggtcggtccgttcccggggtaccgaggacgttaggacggtcgtagtaacgtttacttaccgtgtacgacctacgtacccggaacggggtccaacgaacgtacggtacgggntaacgaaacctagttacctggggtaacggttccgggtttgggtacgttcgggaacgggtacggtaaccgtaacgtacgtacccggtaccgtacggacgtaccgtaccgacggtccgtacccgtcccgtcgtacctccgtctccgtcccctccgtcctcctccgtctctcgcgcgcggtcncggacgacgtcgacgtacgtgacncngtnatcgntacggctgacgcnc

SEQ ID NO: 25474 - DNA, 749 bp, Homo sapiens
  misc_feature: GYAE6OF02JAWUF.21.22.B11.1.454.CMB.1.raw
  modified_base (173)..(173): a, c, t, g, unknown or other
  misc_feature (173)..(173): n is a, c, g, or t
  modified_base (410)..(410): a, c, t, g, unknown or other
  misc_feature (410)..(410): n is a, c, g, or t
tcagtcgtcgctcgcacgaccggtgctcgatttagacgacagctcaggggggggggaagctcagcttcagctgtggtagagaagacaggactcaggacaatctccagcatcggccggcttccctctcctctcacctcctcactcactgcgcgacggtcctgggaccctaggtntggtgccgtgacctacgacgccctaccctcgaggtccgttaccgtaccggggacccccggagtaggacgggttaccacccatcttcttagttcgtacgggagaccaaacctaccaaaccgtgtaccggaaagttaacttagttagtaacttcgtaggttacctacgacgaactaaaccctccggaacgtaacgtcccggtaaccccaaacgtcctacactaccgaagaaggtaaaanaccgtagtaaccgccggtacccttaggaccgggtcctacgacgttacctttcgaccgttcggtacgtacgtactacgtacgacctacctccgtacggtccttaccgtactaccctagaccgtacgggtacgggtcccgtccggtaacggaacggtacggtcggtaacggtcgttaccgtaactttaacggtacgtctagggtacaccggttcggaaacgtacccggatacgtaacggagttagacgtaacgtatcggtagtcgggtggttcgggtaacggttccgggaaggtacccgtaaccgttaacggaccggtaacccgttacggacggtaaccgg

SEQ ID NO: 25475 - DNA, 686 bp, Homo sapiens
  misc_feature: GYAE6OF02ILL35.21.22.B11.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcaggtcctgggcccagtctgtgctgactcagccacctcagcgtcgtcgggacccccggnaggaggtcaccntctcttgttctggagcactccaacatacggaagtattagtgtattctgtatcnactaacnccgagactccggaccccaactccacactacgaagaggtaataactcgacggccggtccctcggaccggggtccctacggaccgttacttccgtcgtcggaccctaccgtaaaggttcctacggacctacccgtacgtaccgtcccgttacccgttcggaccctgtccgtaacggtcggtaccgtaccgggtccgagggtactcgggacggtctacgtaaccgttatcggtagtcgactacggtacccgggaagggcctaacgaaacgtggtaacgggtaactaccgtaaactacggttcgtgggtaacgggttccgggtttgggggttacgtaccggggaaccggggttaacggaacccgttaaacccgttcggggaaccccgtttccgggtaacggtaacccgg

SEQ ID NO: 25476 - DNA, 317 bp, Homo sapiens
  misc_feature: GYAE6OF02FOMWA.21.22.B11.1.454.CMB.1.raw
  modified_base (266)..(266): a, c, t, g, unknown or other
  misc_feature (266)..(266): n is a, c, g, or t
  modified_base (299)..(299): a, c, t, g, unknown or other
  misc_feature (299)..(299): n is a, c, g, or t
  modified_base (305)..(308): a, c, t, g, unknown or other
  misc_feature (305)..(308): n is a, c, g, or t
  modified_base (310)..(317): a, c, t, g, unknown or other
  misc_feature (310)..(317): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgcccctcggtcactctcgttccccgcccttccnccgtctctcctactgacgcgggctggcaaggcncatagnnnnannnnnnnn

SEQ ID NO: 25477 - DNA, 1040 bp, Homo sapiens
  misc_feature: GYAE6OF02JFBV6.21.22.B11.1.454.CMB.1.raw
  modified_base (219)..(219): a, c, t, g, unknown or other
  misc_feature (219)..(219): n is a, c, g, or t
  modified_base (356)..(356): a, c, t, g, unknown or other
  misc_feature (356)..(356): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactcgcgcagggtcctgggcccagtctgtgctgacctcacgccaccctcaggccgttcgtacggggacccccggngtaggacgggtaccaccgtacttccgttctttacgttccgagggaacggtccctaaaaccgttaccccaaacgtaacgttaaccggtaaacgtttaaaacgtttaacgtttacggttaacgttttaccggtttaacncggggggttaaattaccctaaaaccggttccccgaaaaaaccgttttacccccgtaaccggggggaaaaaaccccctttaagggggtccccccccccctaaaaaaacttaccccgtttaccccgaaaaacggtttacccccggaaaaggttaaaacggggtaaaaccttaaaaacgttccccggtaaacccgtaaccggggtaccccccggtttacccaaagggggggttaccccccttaaggttaaccccggtaacgttttaccggtaccctttaacggggaacctttaccccgtaaaacggggttccccttaaccgggtacccgtaaaccccgtttcccgtaaccgggtacccgttaacccccgttaaggttaacccccaaggttacccggtaacggtttacccgggggaccttaacccggggtacccgtaagggaaccgttcggtaacgggacttaaccgttaacgttagtttaaccgtacgtacgtaccgtaacggttacgaaccgggtaaacgtaccgtaaacgtacgttaacgggaacgttacgtacccgtaaagttacccggttaagggttaacgggtaccggggtttaccggggttaacgggtttacccgggaacccgggtaaaggggttaacccccgaaaaccggtttcggtaacccggttacccgttaaccggg

SEQ ID NO: 25478 - DNA, 366 bp, Homo sapiens
  misc_feature: GYAE6OF02IG62K.21.22.B11.1.454.CMB.1.raw
  modified_base (318)..(318): a, c, t, g, unknown or other
  misc_feature (318)..(318): n is a, c, g, or t
  modified_base (341)..(366): a, c, t, g, unknown or other
  misc_feature (341)..(366): n is a, c, g, or t
tcagtcgtcgctcgcacgaccggtgctcgatttagacgacagctcaggggtccctgaccgattctctggctccaagtctggcacctcagcctccctgaccatcaggtggctccggtccgaggatgaggctgactattactgtgcatcgacgggacgcaacagtgggatagacaatcgtggagtcgggttggggttggttcgggacgggagggaaccaacgtcggacccgttactacggtcacgcccgtaaggcctcgcccccgtggctacctcgtcgtcccgcccttcctccttcgtcctcctacgtggcgccgggtntcggcgaacggcacgagtacggnnnnnnnnnnnnnnnnnnnnnnnnnn

SEQ ID NO: 25479 - DNA, 729 bp, Homo sapiens
  misc_feature: GYAE6OF02GOAEL.21.22.B11.1.454.CMB.1.raw
  modified_base (126)..(126): a, c, t, g, unknown or other
  misc_feature (126)..(126): n is a, c, g, or t
  modified_base (132)..(132): a, c, t, g, unknown or other
  misc_feature (132)..(132): n is a, c, g, or t
  modified_base (154)..(154): a, c, t, g, unknown or other
  misc_feature (154)..(154): n is a, c, g, or t
  modified_base (231)..(231): a, c, t, g, unknown or other
  misc_feature (231)..(231): n is a, c, g, or t
tcagtcgtcgctcgcacgaccggtgctcgatttagacgacagctcaggggggggggaagctcagcttcagctgtggtagagaagacaggactcaggacaatctccagcatggccgggcttccctcncctccncgaccctcctcactcactggcncgaggttccgcgggacccagttcgtgtcgactcgactcaagcccaccttcaggtcgtccgtccggggacccccgggnaggtacgggtaccaccgattcctcttttggttcgagggacgtacctaacctaccaacagttcgggaaattaagttatgttaattcgttaaggtatcgaacacctaccgtaccaaggtaacgtcccggaacccctaactccgtactactaccgaaggtaaaggtactaaagcgaccggtccggtccttacgggccggttccgtacaaccggtatttccgcgtacgtaccgactaacgggtctcgccctaacccgtctaccgtccctacccctacggtacccacgtagggtcggtccgggtcgaccccggggttcggaacggtcgtggggacgtacggttacactttcgtacgttcggacgttcgaccgtacgggaaccgtacgtaacgcgggtttagaacgggttacaacggtaacgcttagggccggtaagggtccggggttttgggaccgggttcgggtaggccgtaacggtacggcctcgggtttcgacggtaccg

SEQ ID NO: 25480 - DNA, 848 bp, Homo sapiens
  misc_feature: GYAE6OF02G9VCP.21.22.B11.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgacagctcagggggggggaagctcagcttcagctgtggtagagaagacaggactcaggacaatctccagcatggccggcttcctctcctcctcacctcctcactcactgcgcagggtcctgggcccagtctgtgctgactcacgccacctcagcgtcgtcgggaccccggnaggacggtcaccatctcttgttctggaggcaactaccaacagtacggtaaagttaattattagttaattcgtaggttactacgacgacaaccctcccgaaggtaacgtcccggacccccctaaaacgttcccctacgtaacctacccgaaggaaacggtaaaattaactaccggtaaccgggacccggtaccccgttaccgggtaccggggttacccccgtaggggtaaccccttactttcccgttaccggtaccgggttacctaacccgttaaacgttccgggttaccggacccttacccgtaccgacccgtccccttacccccgttacgaacccgttacgttaccggtacggggttccgggttacccgttacccggggtaaccgggtacggtacggtcgggtaaccggtacgttacgtaaccgtttacgtttacctacggttaccgggcgttaaccgttaccggggaaaccggggacccgttaacgaacgggttaaccgggagggtaacgttaacgtaaccggttactcggtacggtacgggggtttccggggttaggggttaccgggtcgggaaccggggtaaccgaaccggtaaccgggttacccggtacccgggtttacggaccggtaacccggg

SEQ ID NO: 25481 - DNA, 763 bp, Homo sapiens
  misc_feature: GYAE6OF02IUPF5.21.22.B11.1.454.CMB.1.raw
  modified_base (176)..(176): a, c, t, g, unknown or other
  misc_feature (176)..(176): n is a, c, g, or t
  modified_base (188)..(188): a, c, t, g, unknown or other
  misc_feature (188)..(188): n is a, c, g, or t
tcagtcgtcgctcgcacgaccggtgctcgatttagacgacagctcaggggggggggaagctcagcttcagctgtggtagagaagacaggactcaggacaatctccagcatcggccgtcttccctctccctctccaccctcctcactcgacgtcgcgcgacgggtccgtcgggcccnggttctcggtcnccgtgtacctccaacgccctacccgtcacgccggttccggtacccgggggacccccgggtagaacgggtaccgggttcccaaccgttctccgtttaccgttggtttaccggaggtaccggacctaaacctccccgaaagtcgtaacggtaaagttaatttacgttagttacgttacgttacggtactcgtaacgaccgtactacccgacggtaacgacccgtaaccctaacctaccaccgtacgtacgaagacgtaaactagccgacgtccggtaccctacggacccggttccgtacgtacgtacctcgtacgtaccggacctacgtacgtccgtacgtaccacgtcgacttccctactcgactacgtcggtacggtccgtccgttaccggtccggagtcgtggtacgtcgtacgttacgttctcgtcgcttaccgacgttaccggacgtaccaacggtacgacgttaaggactaagttacgacgttgtaacgggttcggtcgggttacgggtccggtaaccgggtacggtaaccggtccgttaaggcccggtttaacggtaccggtacgtacgg

SEQ ID NO: 25482 - DNA, 856 bp, Homo sapiens
  misc_feature: GYAE6OF02FNJLS.21.22.B11.1.454.CMB.1.raw
  modified_base (125)..(125): a, c, t, g, unknown or other
  misc_feature (125)..(125): n is a, c, g, or t
  modified_base (175)..(175): a, c, t, g, unknown or other
  misc_feature (175)..(175): n is a, c, g, or t
  modified_base (183)..(183): a, c, t, g, unknown or other
  misc_feature (183)..(183): n is a, c, g, or t
  modified_base (193)..(193): a, c, t, g, unknown or other
  misc_feature (193)..(193): n is a, c, g, or t
  modified_base (215)..(215): a, c, t, g, unknown or other
  misc_feature (215)..(215): n is a, c, g, or t
tcagtcgtcgctcgcacgaccggtgctcgatttagacgacagctcagggggggggaagctcagcttcagctgtggtagagaagacaggactcgaggacaaatctccagcatggccggcttccctntcctctcaccctcctcactcactgcgcgaggtcgtcggacccagtctgtnctagcctnacgccacctnacgcgtccgcgggaccccggtnacggacggtccacctagtcttacgttcgttcgtaggaccggtactaaccgccaaactagtaccggaagttaaatttagtacgtttactcgttacggtactacacgtacaccgttaccgaaggtactcccggaaccccctaactccctagtaccgtacgaaggaacgttaaacgtaacaccgggacgtaccccggttacccctggggtttaacccggtccgttaaccggttaccgtacgttttacccgtcgtccggttacccgtaaacgtacggttccgtccggtacctaacccggtcccgaaaggttccccctaccgtaccgaaccttacgtacggttccgggtacccgggtttaccggtacccgggtaaccggtacggggttaccgtacgggttaacgtaccggttaacgtttaacccggttaaacgtttcggtaacccggtttcggaaccgttaccgggtacccggaaccgggttaccgaaccgaacggttaacggtacggtaacgtacggtaataccggttaccggtacgggtttacggggttccggggtttacgggttaccgggtaccgggtaacgggttacgggaccccgaaccggtttacccggtccgggttaaaccgggtttcccgaacccggg

SEQ ID NO: 25483 - DNA, 663 bp, Homo sapiens
  misc_feature: GYAE6OF02JF5WA.21.22.B11.1.454.CMB.1.raw
  modified_base (190)..(190): a, c, t, g, unknown or other
  misc_feature (190)..(190): n is a, c, g, or t
  modified_base (209)..(209): a, c, t, g, unknown or other
  misc_feature (209)..(209): n is a, c, g, or t
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (372)..(372): a, c, t, g, unknown or other
  misc_feature (372)..(372): n is a, c, g, or t
  modified_base (488)..(488): a, c, t, g, unknown or other
  misc_feature (488)..(488): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctnagcgtctcgggaccccggnaggaggtcaccatctcttgttcaggagcaacgtcaacagtacgaagtaactatgtaacttctggtatcagacaaacctccgaaggaactaccgacccctaaactccgtanactccgaagaagaactaancgagtccgcctcgacggtcctgaacctattccgntcgactactaagtccgtgaccctactacgacgtccctaccgtacactaacgcgtaaggtcggtcccgtaccggtacggacgtacttcggacggacgttacgaactttacgttaacncgggttacacgaccgttacggaaccgggtaacaaccgaaagtcgtaacgggtaacacggtaaaccagtacggtcgtaaacggggtcggttttacggggtaggttaccggggtaaccggaaacccgggtaaaccttaacggacccggtaacccggttttaccggaacgtaccccgg

SEQ ID NO: 25484 - DNA, 880 bp, Homo sapiens
  misc_feature: GYAE6OF02ICLTZ.21.22.B11.1.454.CMB.1.raw
  modified_base (223)..(223): a, c, t, g, unknown or other
  misc_feature (223)..(223): n is a, c, g, or t
  modified_base (331)..(331): a, c, t, g, unknown or other
  misc_feature (331)..(331): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctctccaccctcctcactcactgcgcgagggtcctcgggcccagtctgtgctgactcacgcccaccctcacgtcgttccggtccggggacccccggnaggacgggtaccaccattctctttgttcgtgggacggacctaacctaccaaactagttaccggtaaagttaaatttagttacgttactttcgtaggttaacaccgaanacctaaccctacccggaaggtaaccgtcccggtaacccccctaaacgttcccctacgtactaccgaaggaaggtaaacttaacgacgaaccggtcccgggtacccttaccgggtaccgggggttaccccgtaacggtaacccggttactttcccgttcggtaccggttacccgttaaccgtaaacggtttcccgtacggaccccgtaacccgtccgtacccgttccccgtccccgtaacgtaacccgtaacgtaccggtaacggggtttccgggtacccggttcccggggtaaccgggaaggttaccggtagggtaccgttaccgtaacggttaacctttacgtttacggtcggtacgtcctaaccgggtcggaaaccgggacccgtaacgtaaacgtacgggttaacggacgttaaccgtaacttacggtacgttaaggggtccggggtttacggggttacggggttaccggttaccgggggtaacgggaacccggttaacgtaacccgggttacgtaccccgggtttaccggacggtaaaccccggg

SEQ ID NO: 25485 - DNA, 767 bp, Homo sapiens
  misc_feature: GYAE6OF02HDAAZ.21.22.B11.1.454.CMB.1.raw
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
tcagtcgtcgctcgcacgaccggtgctcgatttagacgacagctcagggggggggaagctcagcttcagctgtggtagagaagacaggactcaggacaatctccagcatcggccggcttccctctcctcctccaccctcctcactcactcgccacgtacgggtcctcgggcccagtctgtgctcgactcacgccaccctcgacgtcgtccgtccggggacccccggngaggacgggtccacctntccttcttgttccgtgggacggtaccaactccaactagtacggtaaagttaattagttcgttattacgttaggtactacgacgtacctaaccgtaccggtacgtaaaccgtcccggaacccccctaaaccgttcccgtacctaaccgtaccgaaacggtaaacggtaaacttaaacgtaccgtaaccggtcccgggtacccccgtaacggggtaccggggttacccgtaccggtaaccgttaaccttccgtacgttaccggaccttaaccgtacggttccgtcggtaccctacccgtccgtaccgtcccgtccctaaccggtacctacgttaccggtcgggttaccggtccgttccgggaccgtaggtacgtggcgtacgtcgtaacgttacgttcgtagtacacgtacgtacggacggtacacgtacgtacgtaggactagtactagtcgtagtacgggtcggttacgggtcgtacgggacggaccgtacgtaccgttacggtaccgttacggacgtaccgg

SEQ ID NO: 25486 - DNA, 861 bp, Homo sapiens
  misc_feature: GYAE6OF02IDUIE.21.22.B11.1.454.CMB.1.raw
  modified_base (179)..(179): a, c, t, g, unknown or other
  misc_feature (179)..(179): n is a, c, g, or t
  modified_base (208)..(208): a, c, t, g, unknown or other
  misc_feature (208)..(208): n is a, c, g, or t
tcagtcgtcgctcgcacgaccggtgctcgatttagacgacagctcgagggggggggaagctcagcttcagctgtggtagagaagacaggactcaggacaatctccagcagtggccggtccttccctctccctcctccacccctcctcacctcactcgcgcgacgggtccgtcgggcccngtcgtgtgctgactcgacgccctacctcncggccggtccggtcccggggaccccgggacgaggtaccgggtacacctacttcttcgtttacggttcggacggtacggacctaacctaccaaacgttacggaacggttaaagttaatttagttacgtttagttgtacggtactcgaacgaaccctaccgtaaccggaagaacggtaccccgtaaccccaaccttcctaacctactaccggaaagaacgttaacaacttccggacggtaccccggtacccgtacgggtcccgggtacccctaggtacccgttattccggtccgtacggtacccaacgtacggttccgaccgacccgtaacccgtaccgtccccgtaccgtacccgttaccgtaaccggttaccgttacgggtccgggttaacccgggttcccggtaaccgggttaccgggaacggttaacgtcggtaccggttacgttaccgttaaacggtttaaccttcggacggttgtacccggaaggttacccgggaacccgttaaacgaacccggttaggtaacgggttcgtaacgtaaccggactttagccgggttacggttggggttaccggggtttcggggtacccggtacggggaaccgggttacgaaccggtaaccgtcccggttaacggtcgaacccggttacg

SEQ ID NO: 25487 - DNA, 845 bp, Homo sapiens
  misc_feature: GYAE6OF02F4ER8.21.22.B11.1.454.CMB.1.raw
  modified_base (211)..(211): a, c, t, g, unknown or other
  misc_feature (211)..(211): n is a, c, g, or t
  modified_base (253)..(253): a, c, t, g, unknown or other
  misc_feature (253)..(253): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccacctcagtccgtctcgggaccccggnaggacgggtcaccatctcgttgtcgtggcgtcaactccaacntacggaagtaacttatgtatctgtactcgacgcacctaccgaggaacgtaccggaccccctaaactccctacactacccgaaggtaacggaaacttaacgtaccgaccggtacccggtaccccgttacgggtaccgggggttaccccgttaacgggtaacccgttacgttttaccgtccggttaacggtcccgttaacccgttaaacgggttcccgtttaccgggacccttaacccgttccggaacccgtcccctttacccgtaaccgtacccgtaaccgtcggtaaccggggtttccggtacccgggtttacccgggtccggaagggtacccgttagggaacggttccgttaaccggtacttttacgtttaccgtagggttaccgtacgttacgttacccgggaagggacccgttaacggaccttaagggttaccgggtaacgttacggtaaccgacgttttcggaccggggttaagggttccggggttttaacggggtcccgggttaaccggggggtaccgggaaaacggtaacccggttaaacccggtaccgggttaacccgggtttacccggtaagggttaaccccgg

SEQ ID NO: 25488 - DNA, 938 bp, Homo sapiens
  misc_feature: GYAE6OF02ICR83.21.22.B11.1.454.CMB.1.raw
  modified_base (227)..(227): a, c, t, g, unknown or other
  misc_feature (227)..(227): n is a, c, g, or t
tcagtcgtcgctcgcacgaccggtgctcgatttagacgacagctcaggggggggggaagctcagcttcagctgtggtagagaagacaggactcaggacaatctccagcatggccggcttccctctcctctccaccctcctcactcgactgcgcgaggtccgtggcccagtcgtgtgcgtgtactcacgcccgtaccctcacgcggtaccgtccggggacccccgggnacggtacgggtaccacctacgttccttacggtttcgttcgtacgggacgtaccgtaaccgtccgaaacacgttaaccggggtaaattaaagtttacgttaggttactttaccggttacggttaacgtcgtaacgtacctaaaccctcccggtaaaggtaaacgtcccggaaccccccgtaaacttaccgtactaacctacgtaacgggtaagtaaaacttaacgtaccgtacgggaccccggtacccgttaccggtaccggggtaacccgttacgtaaaccggtttaccttccggttacgtacggtacctaaccgtaacggttaccggtacgtacccgtacccgttacccgaccggtacccctaccgtaccgtaacccgtacttacggtaacggttccggggtacccgtcccggggttaaaccggcgggtaacgtacgggtacggtacggttacgtaaccgttacgtttacggttacggtacccgtagtaaccgggttacccggacggggttaaaccccacgggaaaacgtttcgggtaacggtaaccgtttaacggaaccgttacggtaaccggtacccggggtttaaggggtaaccggggtttttcgggggttaccggggttaaccggggtttaaccggggaaaccccgggtttaaaccgaacccgggttaacggtttcccgggtaaccccgtttaggggaaacccccg

SEQ ID NO: 25489 - DNA, 608 bp, Homo sapiens
  misc_feature: GYAE6OF01EAAFP.45.34.D01.1.454.CMB.1.raw
  modified_base (220)..(220): a, c, t, g, unknown or other
  misc_feature (220)..(220): n is a, c, g, or t
tcagacgcgatcgacacgaccggtgctcgatttagatcgtctgtgttgggtttgggggtctcagagaggagccttagccctggactccaaggcctttccacttggtgaccagcactcgagcacagaggactcaccatggaattggggctgagctgggctttccttgttgctattttagaaggtgtcaatgtgagatgaaagtggtggagtcgtggggganactttgtccagtccgggggggtccctgagactctcctagtacagcctctggactcaccttgagcaattattggatgacctgggtccgcaggctccgagggaaggggctggagtgggtggccaacataaagcaagatggagtcgaaagactatgtggactctaggtgaaagggtcgttacacctatctaccagaagacaatgaccaaagaacttacgagttaccgttttaggaaattggactagttctagaagaagtaccggaagaacgtacggacgtaagttaataattaccgtggaccgacggagaacggtaagttggaagttaacggtacccgttaaaggttacggggggtaacgaaggaaccgtaattccggtagggtttaacgg

SEQ ID NO: 25490 - DNA, 255 bp, Homo sapiens
  misc_feature: GYAE6OF01BXM72.45.34.D01.1.454.CMB.1.raw
  modified_base (253)..(255): a, c, t, g, unknown or other
  misc_feature (253)..(255): n is a, c, g, or t
tcagacgcgatcgacacgaccggtgctcgatttagatcgtctgtggtgggtctggcacagaattcactctcaccatcagccgcctgcagcccgaagattttgcaacttattactgtctacaagatttcaattaccctcggacattcggccaagggaccaagcttgagatcaaacgaactgtggctgcaccatctgtcttcatcttcccgccatctgatcgatcgcgtctgagcgggctggcaaggcgcatagnnn

SEQ ID NO: 25491 - DNA, 606 bp, Homo sapiens
  misc_feature: GYAE6OF01ERIIM.45.34.D01.1.454.CMB.1.raw
  modified_base (354)..(354): a, c, t, g, unknown or other
  misc_feature (354)..(354): n is a, c, g, or t
tcagacgcgatcgacacgaccggtgctcgatttagatcgtctgtgttgggtttggggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccgagggggacgccccccaatcctagtctatggtgcttccaggttacaaagtgggtccatcaaggttcagtggcggtgggtctggcanagaattcactctcaccatcagccgcctgcacgccccgaagtacttttgactaactttattactgttactacaagtactttacaactttaccctacgggactacgtttccgggaccctaaacggggtacccaaggtccttaggaaacgtactaaaccgaaaaccggtaaaccgttgggttacgggacccgttacggaccctaaacccgtactttacccgttacggttcccttttaccgaaccttttacccccg

SEQ ID NO: 25492 - DNA, 597 bp, Homo sapiens
  misc_feature: GYAE6OF01C0M8N.45.34.D01.1.454.CMB.1.raw
  modified_base (154)..(154): a, c, t, g, unknown or other
  misc_feature (154)..(154): n is a, c, g, or t
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattgggctgagcggngtgtctaggtcgctattagagtgcatgtgagatgaagtgtgancgtgggganacttggccagtccgggggcctgagctctcctagacncgtctcgtacgctacacgtgatatatagtagagtacgtacgtcggtccgacgacgcgtacggaggaggcgtggtaggtggcgacgaacaagaagagagagtaggagtaagaagtagtagtagtagtacgtagtagtaggtaggtacgtactactactacgtacgagacgaacgaacgacgaacgtaacgtacgttacgttagtttagtttaggtaagtacgtacgtacgtacgtacgtacgtaacgtaacgtaacgtaacgtacgtacgtaacgtaattacgttacgtacgtacgacgagtagtagtagtacgtacgtacgtaaggtaggtacgacgtagtacgttgttggttag

SEQ ID NO: 25493 - DNA, 637 bp, Homo sapiens
  misc_feature: GYAE6OF01BIJA4.45.34.D01.1.454.CMB.1.raw
  modified_base (256)..(256): a, c, t, g, unknown or other
  misc_feature (256)..(256): n is a, c, g, or t
  modified_base (588)..(588): a, c, t, g, unknown or other
  misc_feature (588)..(588): n is a, c, g, or t
  modified_base (616)..(616): a, c, t, g, unknown or other
  misc_feature (616)..(616): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattgggctgagcgtggcttcctgttgctattttagagtgtcatgtgagatgaaagtggtggagtcgtgggggatacgttggtccagtccgggggggtccctgagactctcctgtacngcctctggactcaccttgagctaattattggatgacctgggtccgccaggctccgagggaaggggctggagtgggtggaccaagaataaagcaaaggatagggagtacgaaaagtaactagtggtaggacttcgtaggtaggaaacggggttcggttaccaccagttaccgtaccgaagaaggaacctaattcggaacctaaaggtaaacttccgtaagggttttcgttttaagggaaaacgttgggaacctaaggttctagggaacgtacgtacccggaaagtacgttaaccgggataaggttaactagttaaccgtgacggtcgagacgntagtaatacgtcgtaaaggtggggtaanaggaactgttcggtggtttag

SEQ ID NO: 25494 - DNA, 323 bp, Homo sapiens
  misc_feature: GYAE6OF01ABWKS.45.34.D01.1.454.CMB.1.raw
  modified_base (255)..(256): a, c, t, g, unknown or other
  misc_feature (255)..(256): n is a, c, g, or t
  modified_base (258)..(261): a, c, t, g, unknown or other
  misc_feature (258)..(261): n is a, c, g, or t
  modified_base (263)..(264): a, c, t, g, unknown or other
  misc_feature (263)..(264): n is a, c, g, or t
  modified_base (266)..(266): a, c, t, g, unknown or other
  misc_feature (266)..(266): n is a, c, g, or t
  modified_base (271)..(275): a, c, t, g, unknown or other
  misc_feature (271)..(275): n is a, c, g, or t
  modified_base (281)..(282): a, c, t, g, unknown or other
  misc_feature (281)..(282): n is a, c, g, or t
  modified_base (284)..(323): a, c, t, g, unknown or other
  misc_feature (284)..(323): n is a, c, g, or t
tcagacgcgatcgacacgaccggtgctcgatttagatcgtctgtggtgggtcgtggcacagaattcactctcaccatcagcccgcctgcagcccgaagatttgcaacttattactgtctacaaggatttcaattaccctcggacattcggccaagggaccaagcttgagatcaaacgactgtggctgcaccatcctgtcttcatcttcccgcatcctgatcgatcgcgtctgagcgggctggcaaggcgcatagnntnnnngnnantgatnnnnncgatgnncnnnnnnnnnnnnnnnnnnnnnnnnnnnnnnnnnnnnnnnn

SEQ ID NO: 25495 - DNA, 517 bp, Homo sapiens
  misc_feature: GYAE6OF01B3HSW.45.34.D01.1.454.CMB.1.raw
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagtcaccatcacttgccgggccagtcagagtattagtaactggttggcctggtatcagcagaaaccagggaaagcccctaagctcctgctctataaggcatctagttagaaagtgggtccatcaaggttcagcggcagtggatcgtgggacagaattcactctcaccatcagcagcctgcagcctgatgtattttgactaacttattactagaccaacgtagtatgtaattagttacttcggtacgttccggaccgtaagggacctaagggtacggaaactacgaaacgactggtacggactgccacgtacg

SEQ ID NO: 25496 - DNA, 595 bp, Homo sapiens
  misc_feature: GYAE6OF01BZ5QO.45.34.D01.1.454.CMB.1.raw
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggnaagtcaggatatagaaatgagttaggctggtatcagcagagaccgagggggacnccccccaactcctagtctagtggtgtcttccgaggttacaaaggtgggtcccagtcaaggttcaggtggcggtgggtctggcacgagaattcactctcaccatcacgccgctgcacgcccgaagtatttcgactaactttattactgtactaactaagtactttaccaaacttaccccgtaggtacctagtttaccggaccgtaacggggaacctaaacggtcttacggaagtaacgttaaccgtaaaaccggtaacgttcggtagggaccctttaggaccctaacccgtaatttcccttggttaccctttaccg

SEQ ID NO: 25497 - DNA, 616 bp, Homo sapiens
  misc_feature: GYAE6OF01CWBMY.45.34.D01.1.454.CMB.1.raw
  modified_base (224)..(224): a, c, t, g, unknown or other
  misc_feature (224)..(224): n is a, c, g, or t
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
tcagacgcgatcgacacgaccggtgctcgatttagatcgtctgtgttgggtttggggacaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataactgccggnaagtcagatatagaatgagtagctggtatcagcagagacgaggggacncccccaatctagtctatggtcncttaccgaagttacaaaggtcgggtacccatcgtaaggttcaggtggcggtaggtctggcacgtagacttcacgtactaccgaacatcacgccgtacctgacaacgtaccgtaaagttactttcgaccttaaatttactacgttgttaacctaagtaacgttaacttttaccgaaaccgttttaccccccgtagggtaaacctacggtttacccgggaacccgtaaagggaaccccgtaaagttcccgttagaaacgaacgttaaccgaaaacggtactgggtacgactacggacctaacctagtcccgttagtccttaacg

SEQ ID NO: 25498 - DNA, 574 bp, Homo sapiens
  misc_feature: GYAE6OF01DANIR.45.34.D01.1.454.CMB.1.raw
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (477)..(477): a, c, t, g, unknown or other
  misc_feature (477)..(477): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (566)..(566): a, c, t, g, unknown or other
  misc_feature (566)..(566): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattattggatgacctgggtccgccaggctccagggaaggggctggagtgggtggccaacataaagcaagatgggagtcgaaaagaactatgtggactctgtgaagggtcgttcaccatctcagagacaatgccaagaattcagttcttttggaaatggacagtctgagatccgaagatacggcagtatattactgcgcgagagatgatagtcctaagtggggtanagacatctggttnatgtctttcgatgtgtgggcacgggacgacggtcaccgtctcttcacgtccctccgaaccgaacgggcccagttccggttccttcccccgtggccgcccctagccctcgaacggcnccaccctccgaagngccanacgccggtcccgtgggcctcggcccgttggcaacggtacctacgttcccgtacgacttccggccgttcgnggtacggg

SEQ ID NO: 25499 - DNA, 554 bp, Homo sapiens
  misc_feature: GYAE6OF01B6TIR.45.34.D01.1.454.CMB.1.raw
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
  modified_base (390)..(390): a, c, t, g, unknown or other
  misc_feature (390)..(390): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccaggggganccccccaatcctagtctatggtncttcaggttacaaagtgggtccatcaagttcagtggcggtggtctggcacgagattcactctcaccatcagccgctgcacgccgaatnttttgctaaactttattacctgtactaacaagtattttaccaactttaccccgtcgggtactactttccgggacctaaggggacccaaggtcttaggactaacgtaccaaaacggtacgttggtcgggtactcggacctaacccgtattccttgttcccttaac

SEQ ID NO: 25500 - DNA, 686 bp, Homo sapiens
  misc_feature: GYAE6OF01DEFMO.45.34.D01.1.454.CMB.1.raw
  modified_base (222)..(222): a, c, t, g, unknown or other
  misc_feature (222)..(222): n is a, c, g, or t
tcagacgcgatcgacacgaccggtgctcgatttagatcgtctgtgttgggtttggggggagtcagacccactcaggacacagcatggacatgagggtccccgctcagctcctggggctcctgctgctctggctcccaggtgccagatgtgccatccagatgacccagtctcattctccctgtctgcatctgtaggagacagagttaccataacttgccgggnaagtcaggatattagaaatgagttaggctggtatcagcagagaccgagggggacgcccccaactcctagtctatggtcgtcttccaggttacaaaggttcggggtcccagtcgtaaggttcaggtggcggtgggtctgggcacgagtaacttcgactctacacctatcacgcccgccgtcgccgacgaccccgtaagttacttttacgaccttaactttacttacgttcgttaccttaacgtaaacgttacttttaaccgtaaacttttaccccgtacggtaaccgttaacgtttcccgggaacccgtaaacggggtaaccctaacggttaccgtttaacgaacggtaaaccttaaccgaaaaaccggttaaccgttacgggttacgggtaccgttacgggaaccctaacccgttacgttacccgtttcggtttaccctttaccgtacccgttttaccccccgg

SEQ ID NO: 25501 - DNA, 257 bp, Homo sapiens
  misc_feature: GYAE6OF01A1P9S.45.34.D01.1.454.CMB.1.raw
  modified_base (251)..(257): a, c, t, g, unknown or other
  misc_feature (251)..(257): n is a, c, g, or t
tcagacgcgatcgacacgaccggtgctcgatttagatcgtctgtggtgggtctggcacagaattcactctcaccatcagccgcctgcagcccgaagattttgcaacttattactgtctacaagatttcaattaccctcggacattcggccaagggaccaagcttgagatcaaacgaactgtggctgcaccatctgtcttcatcttccgcatctgatcgatcgcgtctgagcgggctggcaaggcgcatagnnnnnnn

SEQ ID NO: 25502 - DNA, 587 bp, Homo sapiens
  misc_feature: GYAE6OF01CKHFZ.45.34.D01.1.454.CMB.1.raw
  modified_base (442)..(442): a, c, t, g, unknown or other
  misc_feature (442)..(442): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccgggggggtccctgagactctcctgtacagcctctggactccaccttgagcaattattggatgacctgggtccgccaggctccgaggggaaggggctgggagtggggtggccaaacataaagcaagagtgggaagtacgaaaagaactatgtggactcgtgtggaagggttcgttacaccatctaccgagagacaatcgacaagaattnagtttcttttaggaatggacagtctgaagataccggaagagtacggacaaggttatacttaacgtgtacggcgtaaggagtacgtagtaattacggtaccgttaaaggttgggggtaagaaggactaagttcgttagggtttacg

SEQ ID NO: 25503 - DNA, 600 bp, Homo sapiens
  misc_feature: GYAE6OF01EAKW9.45.34.D01.1.454.CMB.1.raw
  modified_base (316)..(316): a, c, t, g, unknown or other
  misc_feature (316)..(316): n is a, c, g, or t
  modified_base (378)..(378): a, c, t, g, unknown or other
  misc_feature (378)..(378): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
  modified_base (539)..(539): a, c, t, g, unknown or other
  misc_feature (539)..(539): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagcgtgggtctttccttgttgctattttagaaggtgtccaatgtgagatgaaagtggtggagtcgtggggagacgttggtccaggtcccggggggtccctgagactctcctgtacacgcctcgtggacctcaccttgagctaatttatggatgtaccgtgggtcccnccgaggcctccggaaggggaaggggctgggaggtgggtcgaccaacgaagtaaagcgaaagngtagggagtacgaaaagaactagtgtaggactcgtaggtacggaaggggttccggttacaccgtatctaccgagagacaatgaaccaagtaattctagtttnttttagaagtgacngtctaggatagaccgaagtagtacggatagtatatacgtgacggngaagagtagtgagttacgtaaccgtaagggtaggggtagaacgtatactttggtggtttag

SEQ ID NO: 25504 - DNA, 511 bp, Homo sapiens
  misc_feature: GYAE6OF01EA4SO.45.34.D01.1.454.CMB.1.raw
  modified_base (227)..(227): a, c, t, g, unknown or other
  misc_feature (227)..(227): n is a, c, g, or t
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
  modified_base (380)..(380): a, c, t, g, unknown or other
  misc_feature (380)..(380): n is a, c, g, or t
  modified_base (491)..(491): a, c, t, g, unknown or other
  misc_feature (491)..(491): n is a, c, g, or t
  modified_base (504)..(504): a, c, t, g, unknown or other
  misc_feature (504)..(504): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccatttctccctgtctgcatctgtaggagacagagttaccataacttgccgggnaagtcaggatattagaaatgagttaggctggtatcagcagagaccgagggggacncccccgaatcctagtctatggtncttcaggttacaaagtgggtcccatcaagttcagtggcggtggtctggcacagattcgactctcacatcacgccnctgacagacccgaagtactttgactaacttattactcgaccaactagtatgtaatagtttattcgacggttcgacgaaggacctaaggtagaaatacaaacgactgtggcngcacatctgtctncttcccg

SEQ ID NO: 25505 - DNA, 555 bp, Homo sapiens
  misc_feature: GYAE6OF01CUOFE.45.34.D01.1.454.CMB.1.raw
  modified_base (178)..(178): a, c, t, g, unknown or other
  misc_feature (178)..(178): n is a, c, g, or t
  modified_base (183)..(183): a, c, t, g, unknown or other
  misc_feature (183)..(183): n is a, c, g, or t
  modified_base (186)..(187): a, c, t, g, unknown or other
  misc_feature (186)..(187): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (222)..(222): a, c, t, g, unknown or other
  misc_feature (222)..(222): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagcggcgtgtctaggtcgctattagagtncatgnganngaagtgtgagtgnggngngtgcgngtcggtcgngncnctcntacngctctgctctctgatactatatagtatcgtcgtcggcgcgcgcgtcggaggacggcgtggaggtggtacgacgacgaanaagacgagagtaggagaagtaacgagtagtagtagtacgtacgtgtacggtacggtcgtacgtacgtcgtactacgagagtacgtagtacacgtaatacgtacgtagttagttagtaagtacgtagtagtacgtagtagtacgtaacgaacgtacgtacgtacgtagtagtacgtacgtacgtacgacgtagagtagtagtagtacgtacggtaggtacggtacggtagtagtcgtgttggtag

SEQ ID NO: 25506 - DNA, 770 bp, Homo sapiens
  misc_feature: GYAE6OF01DP8X8.45.34.D01.1.454.CMB.1.raw
  modified_base (184)..(184): a, c, t, g, unknown or other
  misc_feature (184)..(184): n is a, c, g, or t
  modified_base (322)..(322): a, c, t, g, unknown or other
  misc_feature (322)..(322): n is a, c, g, or t
tcagacgcgatcgacacgaccggtgctcgatttagatcgtctgtgttgggtttgggggagacttggtccagtccggggggtccctgagactctcctgtacagcctctggactcaccttgagcaattattggatgacctggggtccgccaggctccgagggaaggggctggagtgggtggccaanataaaagcaagatgggatacgaaaagactatgtggactctggtgaagggtcgtcaccatctcagagacaatgccaagaattcagtcttttaggaatggacagtctgagataccgaagatacggcagtatattactgcncgagagatgatagtactaagtggggtaagagacatcgttggtttgaagtgtactttcgagtggtaggtcggggaccgaacggggaaccgtaaacgggtccgtaacccggttcctttaccgtttacccgacggtacccccttacccgaaaccccggaaacgggggtcccccctaaacggttcccgggtttaccccgtttacccccccgtcgggtccccggtcccccgttcgtaccccgttcccggaagggtacccgacccgtaaccccgttacccggaaacgaccggacccgtaaccggaacccgggcccggggtaccccgttcgggggtaccccttcggggtccccgtttacggggtaacccggtaaaaccggggttaccctttaaacccgttttcccccgttaccggtaacgttcccggtccggtttccgttacggggaacccgggg

SEQ ID NO: 25507 - DNA, 690 bp, Homo sapiens
  misc_feature: GYAE6OF01C4EMG.45.34.D01.1.454.CMB.1.raw
tcagacgcgatcgacacgaccggtgctcgatttagatcgtctgtggttggggtttggggggtctcagagaggagccttagccctggactccaaggcctttccacttggtgaccagcactgagcacagaggactcaccatggaagttgggctgagctgggtctttccttgttgcttattttagaaggtgtccaatgtgagatgaaagtggtaggagtcgtgggggatacgttggtccaggtcccggggggtcctgacgacctctcctgtacagcctcgtggacctcctaccttgagactaatttagttggatcgaccgtgggtcccgccgaggcctccggaaggggaacgggcgtagggtaggtggggtcggacccaaagtaagtaaacggacaaagaggtagggaacgttaacggaaaagtaacgttagtcggtaggactcgtaggtagggtaacgggttccgttacaaccgtatacctacgagaacgaacaagtacgaaccgtaagtaacttacgtagtttacgttttaaggtaagtaggtacgtacgtcgtagtagaacgtacgaagtacgtaacggagtaagttagttacttacgtagtacggacgtaagaggtaacgtaggtaagttacggtaccgttaaagggtacgggggtaagtaacggtaagtacgttcgtttggtttaagg

SEQ ID NO: 25508 - DNA, 590 bp, Homo sapiens
  misc_feature: GYAE6OF01CITWO.45.34.D01.1.454.CMB.1.raw
  modified_base (146)..(146): a, c, t, g, unknown or other
  misc_feature (146)..(146): n is a, c, g, or t
  modified_base (351)..(351): a, c, t, g, unknown or other
  misc_feature (351)..(351): n is a, c, g, or t
  modified_base (415)..(415): a, c, t, g, unknown or other
  misc_feature (415)..(415): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattattggatgacctgggtcccnccaggctccaggggaaggggctggagtgggtggccaacataaagcaagatgggagtcgaaaagactatgtggactctgtgaagggtcgttcaccatctccagagacaatcgaccaaagattcagtctttttgaaatggacagtctgagatccgaagatacggcagtatattactgcgcgagagatgatagtcctaagtggggtanagacatcttggttgatgtctttcgatgtggtgggccacgggacaacggtcaccgtctcttcacnccctccaccgaacgggcccagtccggtccttcccccgtggccgccctgccctccgaaggtacgccaaccgtccgagagccacgacggcccggcccgtgggcctcggcccgttagggtaccctaaacggtcccttaccgttccgtaccggtacttccgcggttcgttggaaccggg

SEQ ID NO: 25509 - DNA, 718 bp, Homo sapiens
  misc_feature: GYAE6OF01C3ZGW.45.34.D01.1.454.CMB.1.raw
  modified_base (316)..(316): a, c, t, g, unknown or other
  misc_feature (316)..(316): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagtacgtggtccgaggtcccggggggtcctgagacctctcctgacagcctctggacctctaccttgagactaattagtggatcgaccgtcgggtccnccgaggccgtccggaaggggagggcgtgggtaggtcggggtcgaccaaacgaagtaaagacaaggtacggtagggtaagtaacggaaaagtaacgtagtcggtacggaacttcgtaggtagggtaacgggttcgttaccaaccgtactacctaccgaaggaactaacgtaagtacgaaccgtaaagtaaccttacgttaggtttacgtttttaacggaaagttacggaacttagtacgtaggtaacggtaacgtaaccggtaaaggtacgttaaccgggactaaggtttaacttacgttaacgtggaccggagtaaggaggtaacgtaggtaacgttacggttaacgttaaggggtaagggggttaacgaacggttaagtacggttggtttgggtttaacgg

SEQ ID NO: 25510 - DNA, 767 bp, Homo sapiens
  misc_feature: GYAE6OF01BM92E.45.34.D01.1.454.CMB.1.raw
  modified_base (185)..(185): a, c, t, g, unknown or other
  misc_feature (185)..(185): n is a, c, g, or t
tcagacgcgatcgacacgaccggtgctcgatttagatcgtctgtgttgggtctgggggagacttggtccatccgggggggtccctgagactctcctgtacagcctctggacctcaccttgagcaattattggatgaccgtgggtccgccaggcctccgaggggaagggctggagtgggtgccaanataaagcaagatgggagtacgaaagactagtgtggactcgtgtagaagggtcgttcaccatctcagagactaatcgaccaagtattctagttcttttaggaatggactagtctgagatacgaagagtacggactagtatattactgcgcgtagagatagatagtaccgtagtaggggtagaagtacatcgttggttagtagtgtctttacgagttggttcggtacgggaccgtaacgggtaaaccgtaaccgggtacccgtaaccgtttccgttaccgtttaccgaccgtacccccgtacccggaaacccgtaacccggggtccccctaacggttccccgggttccccctttcccccggtccgggtcccccgtccccgttccggacccgtcccgtaacgggccgaccccgtacccgtaccggacggtaccgacccgaaccggtccggaccccggtccccgggtacgggtcccggttcccgggtccggttaccgggtaaccgttaacccggggttaaccctttacccggtttcccccgttaccggtaaccgtttcccgggttccggttcccgggttaccgggg

SEQ ID NO: 25511 - DNA, 620 bp, Homo sapiens
  misc_feature: GYAE6OF01C1X2H.45.34.D01.1.454.CMB.1.raw
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattgggctgagcgtggcttctgtgctattttagagtgtcatgtgagatgaaagtggtggagtgtgggggatacgttggtccaggtccgggggggtcctggagtctctcctagtacagcctcgtggacctcaccgttgagactaattagttggatcggaccgtgggtcccgccgaggtccaccggaggggaagggcgtagggnggttggggacgacccaaanagtaaagacaagngtaggaagtacgaaagtaactagtacgtaggtactgtagtaggtaacgggtcgtacactatccgtcgagaagactaagtcgaaccaagtaattacgtagttttacgttttaaggaaattcgggactaacgtgtaggaacgtacgtaccggagtaacgtacggactaaggttatacttacgtgacgagagtagagtagagtacggtaacgtaagggtacggggtactagacctagttcggttgttagg

SEQ ID NO: 25512 - DNA, 530 bp, Homo sapiens
  misc_feature: GYAE6OF01B05V1.45.34.D01.1.454.CMB.1.raw
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtctgggggagacttggtccagtccgggggggtccctgagactctcctgtacagcctctggactcaccttgagcaattattggatgacctgggtccgccaggctccgagggaagggctggagtgggtggccaacataaagcaagatgggagtcgaaagaactatgtggactctgtggaagggtcggttcaccatctccagagacaatgaccaagaattcagttcttttaggaaattggactagtctgagataccgaagatacggacagtatattactgcgcgagagatgatgtactaagtggggtanaganatcgtggttag

SEQ ID NO: 25513 - DNA, 669 bp, Homo sapiens
  misc_feature: GYAE6OF01AQ5QO.45.34.D01.1.454.CMB.1.raw
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
tcagacgcgatcgacacgaccggtgctcgatttagatcgtctgtgttgggtttgggggtaggacttggtccatccggggggtcccgtgagactctcctgtacagcctctggactcaccttgagcaattattggatgacctgggtccgcaggctccagggaaggggctgggagtgggtggccaacataaagcaagatggggatcgaaagaactatgtaggactngtgaagggtcgttcaccatctcaganaacaatgccaaagattcagtntttagaatgacagtctagngatcgaagatacggnagtatatatagcgcgagagagtgaagtagtacctaagtggggtaaggagacaagtcgtaggtttgaatgtctttaggatggtggtggggaccgacgggtacgtaacgggtctacggtacttctaccggtagccccttaccgaacgtaaaccgggtccccaaggttcccggttcccgttaccccccgttgggaccccgtcccgttcgtcccgtaccgtaacgggaccgtcccgaccgtcccggaaggtccgaaccgaccgtccggaccgggtccccgtggggacccttccggccgtaccgggttacgaaacgttacccgtaccttcccggtaccgaccgttcgggcccgttcgtgggtaacccggg

SEQ ID NO: 25514 - DNA, 635 bp, Homo sapiens
  misc_feature: GYAE6OF01EB11V.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaggtgtcaatgtgagatgaaagtggtggagtcgtgggggagacttggtccagtccggggggtccctgagactctcctgtacagcctctggactcaccttgagctaatttattggatcgaccgtgggtcccgccgaggctccggaggggaaggggctgggaggtgggtcggacccaaagaagtaaagcgaaggagtagggaagtacgaaaagtaactagtggtaggtactcgtaggtggtaaacggggttcgttaccaaccgtattccgacccgaagaacggaactaaagtcggaacctaaagtaacttacgtagttttacgtttttaggaaagttggaactagttacgtagagtacgtaccgaaagtacgtacggactagttaattagttacgtgacgagaagagtagtagaagttacggtaccgtaagggtggggtaagagtatagttgttggttag

SEQ ID NO: 25515 - DNA, 577 bp, Homo sapiens
  misc_feature: GYAE6OF01C89D0.45.34.D01.1.454.CMB.1.raw
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (340)..(340): a, c, t, g, unknown or other
  misc_feature (340)..(340): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtctgggggagacgttggtccagtccgggggggtcctgagactctcctgtacagcctntggactcaccttgagcaattattggatgacctgggtccncgaggctccgagggagggctggagtgggtgccaanataaagcaagatgggagtacgaaaagaactagtgtggactctggtaggaagggtcgttacacctatctccagaagacaagtgaccaagtaattacgtagttactttttaggaaatggaactagtactgagataccgaagtagtacggacagttaatagttaacgtcggacgccgtaaggagtaagtagtagtacggttacgtaagggtaggggtaagacgatactggttggttacgg

SEQ ID NO: 25516 - DNA, 839 bp, Homo sapiens
  misc_feature: GYAE6OF01BOMKA.45.34.D01.1.454.CMB.1.raw
  modified_base (195)..(195): a, c, t, g, unknown or other
  misc_feature (195)..(195): n is a, c, g, or t
  modified_base (334)..(334): a, c, t, g, unknown or other
  misc_feature (334)..(334): n is a, c, g, or t
  modified_base (390)..(390): a, c, t, g, unknown or other
  misc_feature (390)..(390): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattatggatgacctgggtccgccaggctccgaggggaagggctggagtgggtcggccaaacataaagcaagngtgggagtacgaaaagactagtgtggactctggtgaagggtcgttcacctatcctcagagacatcgaccaaagtattcagttcttttaggaatggactagtctgagataccgaagacgtacggactagtattagttacnggacgacgaaggagtagtagtaagttacgttaccgttaaagggttacgggggtaanaacgtaacgtagttacggttggttttaggaacgtttcggttaccgtttttacggaagtttcggggttacgggttaccgggggaacccgtaaccggggtaaccgtaaccgggtccgtacccggttccttccgttaccgaccgtccctacccgaaccggtaacggtcccctagtttccccgggtaccccgtttcccccggtaccggtccccggtaccccgtttcggaccccgttacccgggaacgggtaaccgtaccccgtaacccggtacccggtaacggtaaccggtacccgaaccgtacccgggcccgggttaccccggtcggggttacccgttcggtaccccggttacgggtaacccggtaaaccgggttacccctttaaccccggtttaccccgttaccgggtaacccgttcccgggtaccggtcccgttcggggaaccccggggg

SEQ ID NO: 25517 - DNA, 712 bp, Homo sapiens
  misc_feature: GYAE6OF01BF6OO.45.34.D01.1.454.CMB.1.raw
  modified_base (151)..(151): a, c, t, g, unknown or other
  misc_feature (151)..(151): n is a, c, g, or t
  modified_base (390)..(390): a, c, t, g, unknown or other
  misc_feature (390)..(390): n is a, c, g, or t
tcagacgcgatcgacacgaccggtgctcgatttagatcgtctgtgttgggtttgggggcaggagtcagacccactcaggacacagcatggacatgagggtcccccgctcagctcctggggcctcctgctgctctggctcccaggtgccagntgtgccatccagatcgacccagtcctccatttcccctcgttcgtcgtcactactcgtaggtaaggacgaacgtaacggttaacttaacctaacgttaaccggttccggggacccggtaactaacgtacggaaggttaacttaagttaaagtaagttaggttaaggttacggtacggttagtacgtacgacgacgaggaaccggaccggggacgggacccccaccctacgtacgtacgtntaggtcggtactccgtacgtaacggtaacgtacgggtccgtactacgtacggtagtcggagggtcgggtcggtcggtcgacgacaagataccgtctactcacactagccgaccgtccgtacgcgaccggtacgtaaccgtaatttaccgttactaaacttaacttagttactacgtaactaagtaacctttacgtaacttaacccgttacgacgtactacgggtaccgaacggaacgacgtagtacgtacgaaacgttacaaaaccgagtacggttcgggctaacgttcccaacgtaccgttattcgttcccgttctacccg

SEQ ID NO: 25518 - DNA, 541 bp, Homo sapiens
  misc_feature: GYAE6OF01EJM5F.45.34.D01.1.454.CMB.1.raw
  modified_base (527)..(527): a, c, t, g, unknown or other
  misc_feature (527)..(527): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccgggggggtccctgagactctcctgtacagcctctggactcaccttgagcaattattggatgacctgggtccgcaggctccgagggaagggctggagtgggtggccaacataaagcaagatgggatcgaaagactatgtggatctgtgaagggtcgttcaccatctacagagacaatgacaagaattcagttctttttagaaattggacagtctagagataccgaagagtacggcaacgtatattacgtgacgcgagaggatagatagtaccgttaagtacgggggtagaaganatcgttgggtttag

SEQ ID NO: 25519 - DNA, 251 bp, Homo sapiens
  misc_feature: GYAE6OF01AR5VA.45.34.D01.1.454.CMB.1.raw
tcagacgcgatcgacacgaccggtgctcgatttagatcgtctgtggtgggtctggcacagaattcactctcaccatcagccgcctgcagcccgaagattttgcaacttattactgtctacaagatttcaattaccctcggacattcggccaagggaccaagcttgagatcaaacgaactgtggctgcaccatctgtcttcatcttcccgcatctgatcgatcgcgtctgagcgggctggcaaggcgcatag

SEQ ID NO: 25520 - DNA, 582 bp, Homo sapiens
  misc_feature: GYAE6OF01EWCRR.45.34.D01.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccggnaagtcagatatagaatgagttaggctggtatcagcagagaccgagggggaccacccccgaactccgtagtctagtggtgcttccgaggttacaaaggtcggggtacccagtcgaaggttcaggtgggcggtgggtctggcacagattcactctacacatcacgccgctgccacgacccgaagttactttcgacttaactttattactcgtacttaactaagttactttactaaacttaccccgtacggtaccttacgttaccggaaccgtaacgggaaccctaaggtcttaggaacgtaacgtaaccgaaacgtacgttcggtacggtactcgacctacctattcttagttccttac

SEQ ID NO: 25521 - DNA, 668 bp, Homo sapiens
  misc_feature: GYAE6OF01C9J29.45.34.D01.1.454.CMB.1.raw
  modified_base (598)..(598): a, c, t, g, unknown or other
  misc_feature (598)..(598): n is a, c, g, or t
  modified_base (607)..(607): a, c, t, g, unknown or other
  misc_feature (607)..(607): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattgggctgagctgggctttccttgttgctattttagaaggtgtccaatgtgagatgaaagtggtggagtcgtgggggagacttggtccaggtccggggggtccctgagactctcctgtacacgcctcgtgactcaccttgacgactaatttagttaggatcggtaccgtcgggtcccgcccgaggtcctccggaaggggaacggggtcgtggggtagggtggggtcggaccaaacgaataaaacggcgaaaggagtagggagtaacggaaaagtaactagtggtacggacttcgtggtaggtaacgggttcgttaccaaccgtacgtcctaccgaaggaacgaacgaactacgaacctaaagtaactttccgtaagtttacgttttaagggtaaagtaggtacgtaagttcgtagagtaacgtaaccgaagtaacgtacgattagtattagttacgnggcgagganacgtagtagtagttacgtaaccgttaagggtggggtaagagtagtacgttgtttggttacg

SEQ ID NO: 25522 - DNA, 744 bp, Homo sapiens
  misc_feature: GYAE6OF01EZA7X.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtaccaatgtgagatagaaagtggtggagtcgtgggggagacgttggtccagtcccgggggggtccctggagaccgtctccgtgtacacgcctctggacctcaccttgagactaatttattggatgaccgttggggtacccgccgaggcctccggaggggaaggggctgggagtgggtgaccaaagaactaaaggcaaacgagtagggagtaccgaaagaaactgtgtaggacttctaggtacggtaacgggtcggttaccaccgttactccgttacccgaaggtaacgaaccgtaaagtacgaccgtaaaacggttaacttaccgtaacggttttaccgttttttaaggaaaacgttcggtaacgtacgttacgtagggtaacgtactaaccgggaaaggtacgttaacccggggtattaacggttaatttaacgtttaacccgtgggtaaccgtcgggaaagtaacggtaggtacggtaatttaaaccggtaaccggtttaaaggtaacggggggttaaacggaaacgtacgttaacggtttcggtttacgggtttaagg

SEQ ID NO: 25523 - DNA, 624 bp, Homo sapiens
  misc_feature: GYAE6OF01AV346.45.34.D01.1.454.CMB.1.raw
  modified_base (216)..(216): a, c, t, g, unknown or other
  misc_feature (216)..(216): n is a, c, g, or t
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagcgtggcgttcctagtcgctattttagagtgtcaatgtgagatgaaagtggtggagtctggggganacttggtccagtccgggggggtccctggacgactcgtacctgtacagcctctggactcaccttgagctaattntggatgacctggtaccncaggctcgaggagggctggagtggtggccaacgataaagcaaggngtgggagtacgaaaacggaactataggtcggacttcgtaggtagaaaggggttcgttaccacctattcctaccgagacggaactaagttcgaccaaggtaacttaccgtaagtttacgtttttaggaaagttaggacgtaacgttcttaggaagtacgtaaccggaagtagtaccgggtactaagttaacgtagttaccgtagtccggagacggagtagtgaagttcgttaccgtaaggtggggtaacgtagacttattcggttacggtttag

SEQ ID NO: 25524 - DNA, 743 bp, Homo sapiens
  misc_feature: GYAE6OF01CFKBD.45.34.D01.1.454.CMB.1.raw
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccgaggtgccagatgtgccatccagatcgacccagtcctccatttcctccctgtctgcatctgtaggagacagacgttaccattaacgtggccggganaagtcaggtataattagaatgagttaggctaggtancgagcgagacggaccggacgggggaccacccccgaactccgtagtcgtagtcggtcgtacttaccgtaaggttaacgtaacggttcgggtacccagtacgtaacggttcgagggttcgggcgggttgggtcgtaggacctaagtaacgtaacttccgaccttacctaccaacctacgtccgacgtcccgacctaggacccgtaaccggtacccgtaaaagtttacgtttttaccgaacctttaaaccttttacgttaccgttacgttaacccttaaacggttaaactttaacgttttaacccttaaacccgtttaccccgtaacgggttaaccttacggtttaacccgggaaccgtaacgggtaaaccctaacggttccgttaaggtaacgtaaacgttaaccgaaaacggttacgttggtaccgggtacttaccgacccgttaaccttgttccttaccgttcttaaccccg

SEQ ID NO: 25525 - DNA, 741 bp, Homo sapiens
  misc_feature: GYAE6OF01A1G8L.45.34.D01.1.454.CMB.1.raw
  modified_base (227)..(227): a, c, t, g, unknown or other
  misc_feature (227)..(227): n is a, c, g, or t
  modified_base (261)..(261): a, c, t, g, unknown or other
  misc_feature (261)..(261): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttggccgggnaagtcaggatatagaatgagttagctgtatcagnagacgaccgaggggaccgccccctaactcctagtcgtatggtcgtccgttacgaggttaacgaaaggtcggggtacccagttacgtaaaggttcgaagggtcggggtccgggttgggttacgtcgggacctacgtaaaggttaaactttcctaaccgttcctaccaaccgtacgttaccgaacggaccgtaacggcccttacggaccgacgtacccgttaggagtttaacgtagtttttacgaccgttaaccttttaacttaccgtaccgacctaaaccgtagttaacgttagtaacgtttacgtttaacggtttacccggtaccggtttaccgggaacccggtaaacgggggttaaacccgtaaagggggtttaaacggtaaaaccgttaaccggaaaaacgggttaaccggttacgggttacggggtacccgttacgaaccccgttaacctaccggtttactttccgggtttaacccc

SEQ ID NO: 25526 - DNA, 647 bp, Homo sapiens
  misc_feature: GYAE6OF01D47VR.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtcaatgtgagatgaaagtggtggagtcgtgggggagacttggtccaggtccgggggggtccctgagactctcctgtacagcctcgtggactcaccttgagctaattattggatgaccgtgggtccgccaggctccggaggggaaggggctgggaggtgggtggaccaaacataaaacggcaaagagtgggagtacgaaagaactagtgtggactcgtgtggaaggggtcgttacaccatacctccaagagaactaatacgacctaaagtaattcctagtttacgtttttaggaaagttgggaactaggtcttaggagtacgtaaccggaaggtaacgtaaccggacgtaagttaattatttacgtcgacggtactaaggaagtacgttagtaaagttacggttaacccgttaaaggggttagggggtaagaacggtaacgtaacgtttccgttagggtttacgg

SEQ ID NO: 25527 - DNA, 985 bp, Homo sapiens
  misc_feature: GYAE6OF01CU0XE.45.34.D01.1.454.CMB.1.raw
tcagacgcgatcgacacgaccggtgctcgatttagatcgtctgtgttgggtttggggtctcagagaggagccttagccctggactccaaggcctttccacttggtgaccagcactgagcacagaggactcacatggaagttgggctgagctgggtcttttccttgttgcttattttagaagtgtcaatgtagagatagaaagtggtggagtcggtggggagtacgttggtaccgtacggtcccggggggtccctaggacgtaccttccgttcccgttacggtaaccgtacggtcccgttacgttacgggtaaccctttccgtaacccgttttaggaacgtacctaaaagtttttaaagtttcggggtaaacttacggtaaccccggtttcgggggtcccccgtacccgggtaacggtacccgttaccccggggaaggggggtaaaccggggtccgttaggggaagggtttcggggtacggaacccgtaaacgtaaagtaaaaccggacgaaaggtaacggttacggggtaaacgtaaacggaaaaacggtaaaccgttaggtaggtttacgggaaaccgtttggttacgggtaacggggttaaaccgggggtttaccggtttacccgtaaaccccgttagtttaaccccggtttaaacccggaaggaaaccgttaaaacggtaaacgttacccggtaaacccggtaaaagttaaaacccgtttttacggtaacgggtttttttaacccgttttttaaaggggaaaaccgtttcgggaaaacgtttacggtttaacccgtaagggtaaccgtaacgttaacccgggaaaacggttaacgggtaaccgttaccgtaaagtttaacgttagttaacccggtggtaaccggtaaaccgaggtaacgtaagtttaacggaagttaacggttaacccgtaaggggttaacgggtaacgtaagtacgttacgttacggtttgggttttaacg

SEQ ID NO: 25528 - DNA, 704 bp, Homo sapiens
  misc_feature: GYAE6OF01CUWNZ.45.34.D01.1.454.CMB.1.raw
  modified_base (182)..(182): a, c, t, g, unknown or other
  misc_feature (182)..(182): n is a, c, g, or t
  modified_base (256)..(256): a, c, t, g, unknown or other
  misc_feature (256)..(256): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattattggatgacctgggtccgcaggctccgaggggaagggctggagtgggtgccaaanataaaagcaaagatggggatacgaaaagaactatggtggactctgtagaaggggtcgttcaccatctacagganacaatgaccaaagaattcagttcttttaggaaatggacagtctgagatccgaagatacggcagtatattactgcgcgagagatagatagtacctaagtggggtaagagacatacgtggtttgagtgtccgtttagtagtggtgggtggggaccctaacggggaacaacgggtccaacccggttcttccttacacggtcccctaccaacccgaaacgggaccctaacgtcccggttcccgttccccccgtggcccgcccccgttcggacccttacccggaaacgggtaaccgaccgtaaaccccgttcccggaaacggacgacccgaacgaaccgggcccggtccccggtcggggtcctcgggtcccgtagggtaaccggtaaacggtaacccgttaacctttacccgtaccggtaacgttccgggtccgttccgtggtaacccggggg

SEQ ID NO: 25529 - DNA, 693 bp, Homo sapiens
  misc_feature: GYAE6OF01DBAPY.45.34.D01.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctccaggtgccagatgtgccatccagatgacccagtctccatttcctccctgtctgcatctgtaganacagacgttaccataactgccgganaagcagatatanaatgagtgctgtancagcagagaccgaggggaccncccccaatcctagtctagtcggtgcttaccgtaggttaacgtaaacggtcggggtacccagtacgtaaggttcgaggttcgggacggggttggtcgtcgggacaacgagtaacttctactacctacacctaatcccgaccggtcccgtccgtacgaccggtaaccggacccggtaaagtttacgttttaccggaaccttaaacgttttacttaaccttcggttaacctaacgtaactttaacgtttaacccgttaaacgttaccccgttacggaaccttaacggttaccggtaaccgggaacgggtaaacccgaacggttacttaacggaagtaaccgttaaacctaaaaccggttaacgttagggtccggtacgtacgttacccgaacccttagtttaccgttccggttctttaacccg

SEQ ID NO: 25530 - DNA, 677 bp, Homo sapiens
  misc_feature: GYAE6OF01B8XYO.45.34.D01.1.454.CMB.1.raw
  modified_base (273)..(273): a, c, t, g, unknown or other
  misc_feature (273)..(273): n is a, c, g, or t
tcagacgcgatcgacacgaccggtgctcgatttagatcgtctgtgttgggtttgggggcaggagtcagacccactcaggacacagcatggacatgagggtccccgctcagctcctgggggctcctgctgctctggctcccaggtgccagatgtgccatccagatgacccagtctccattcctccctgtctgcatctggtaggagacagacgttaccataacgttggccggacaagtcaggatattagaaatgtaagttaggctaggtatcagngaaggacgaaccggacgggggaccgaccccccaactcctagttctagtcggtcgtccttcgaaggttaacgaaaggtcgggtaccagtacgtaaggttcgagtgggcgggtggtcgtcggacacgagtaacttcactctacgaccatccgacgcccgtctgaccgtaacgaccggtaattacgttttacgaacctaactttacgttaccgtcgtaacccaacgtaagtatacgtaagtttagtttaacgttccgggttaaccggtttaccggggaacctaacggggtaaaccgtaaagggtaaacggtaaaactaaccggtaaaaccgtaacggttcgggtaggtacctacggtaccctaacctacgtttacccttacgttccttacccgtcgtttaccccccg

SEQ ID NO: 25531 - DNA, 686 bp, Homo sapiens
  misc_feature: GYAE6OF01D2RE9.45.34.D01.1.454.CMB.1.raw
  modified_base (260)..(260): a, c, t, g, unknown or other
  misc_feature (260)..(260): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtcctccatttcctccctgtctgcatctgaggagacagagttaccattaacgttggccgggacaagtcgagtatattagaaatgagttagntggtatcagcagacgaccgaggggaccacccccaagtcctagtctagtgtcgtccttacgaaggttaacaaggtcgggtaccagtaccgaaggttcgaggtcgggcggtgggtctggacaacgagtaattccgacttcaccgacactcgacgccgtactcgacacggtacccgtaagttacgttttcgaaacttaaccgtttactttaaccgttcgttaacccgtaaacgttaacgtttaccgttttaacaaacccggttttaccccaccggggttaacttaacccgggttccgggaacccgtaaaggggtaaccccgtaagttacccggttaaggaaccgtaaaccggttaaccgtaaaaacggaccgttttgggaacccggttctacgaccgtaaccctagtttccctgttacccgtttaaccc

SEQ ID NO: 25532 - DNA, 796 bp, Homo sapiens
  misc_feature: GYAE6OF01C8DMX.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaagttggggatgagctgggtctttccttgttgcttaattttagaaggtgtccaatgtgagatagaaaggtggtggagtcgtgggggagtacgttggtcccgtaggtcccggggggtccctggacgtacctctccgtgtacagtcctcgtacggacctccgtaccttgacgtactaaatttagttggatcgaaccgtcgggtcccgccgaaggcctaccggaagggggaacggggtcgtaggggaggtgggggtacgaccccaaagtaagtaaaacggacgaaaggtaggtaggggaaacgttaacggaaaaaggtaacttagtggttaggaccttacggttggtaacgggaacgggggtttccgtttaaccgaacccgttaacgttcccttaccccggaaaggtaacgtaaaccgtaaacgtacggaaaccgtaaagttaaacgttaccgtttaacggttttacggttttttaaagggaaacgttacggtacgttaacgttacgtagtagtaacttaccggaaagtacggtacgacgtaagtttaacgtacgttacgacggtacgacgtaaggacgtaagtacggttaagttaaccgttaacggttaaagggtacgggggttaacaaggtaactaacgtttcggttaagggttttacg

SEQ ID NO: 25533 - DNA, 763 bp, Homo sapiens
  misc_feature: GYAE6OF01ENA32.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagcgtggcttcctgtgctatttagagtgtcaatgtgagatgaaagtggtggagtcgtgggggagtacgttggtccacggtccggggggtccctaggacgtacctctcctgtacacgtcctcgtggacctccgtaccgttagagtactaatttagttggtactcgtaccgtcggggtcccgccgagggccgtaccgggaagggggtacggggcgtgggtagggtcggggtacgaccgaaacgtaacgtaaacgacgtaaaggtaggtagggaacgtaacggaaaagtaacgtagtaggtacggtaccttggtaggtagggtaacggggttaccgttaccaaccgttactacccgtaaccgaaggtaacgaactaaacgtacgaaaccgtaaagttaactttacgttacgttttacgttttaaggaaagttacggtaacgtagtcgtagacgtaacgtaccggaaagtacgtacggtacgtaagttaagttaacgtttacgacggtacgacgggtaacgtaaggtacgttagggtaaagttaaccgggttaacggttaaaggggttaggggggttaaacaacgggtaaccttaggtttccggttttgggttaacgg

SEQ ID NO: 25534 - DNA, 692 bp, Homo sapiens
  misc_feature: GYAE6OF01EA0UG.45.34.D01.1.454.CMB.1.raw
  modified_base (267)..(267): a, c, t, g, unknown or other
  misc_feature (267)..(267): n is a, c, g, or t
  modified_base (383)..(383): a, c, t, g, unknown or other
  misc_feature (383)..(383): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattgggggctgagcgtggtctttccttgttgctattttagaaggtgtccaatgtgagatgaaagtggtggagtcgtggggatacgttggtccaggtccggggggtccctgagtacctctcctgtacngcctcgtggactcaccttgacgactaattattggatcgaccgtcgggtcccgccgaggccgtccggaaggggaggggcgtgggaggtcgggtgacccaaacgaagtaaagacaagngtacgggaagtacgaaagtaactagtggtgtacgtcgtaggtacgggtaacgggtccggtttcaaccgtacgttccgtacccaaggaacgtaacgaaacgtacgaactaaacggtaattacgtacggtttttacgttttaaggaaacgttaggaacgtagtacgtagagtacgtaaccggaaagtgtaaacgagttaacgttaattacgttacgtcggtacgaacggtagtaacgtagtagtaacgtaacggttacgttaaagggttagggggtaacgaacgtacgttaacgtttcggtgggttttacg

SEQ ID NO: 25535 - DNA, 560 bp, Homo sapiens
  misc_feature: GYAE6OF01AI5JK.45.34.D01.1.454.CMB.1.raw
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
  modified_base (441)..(441): a, c, t, g, unknown or other
  misc_feature (441)..(441): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgaggagcagagttaccataactgccgggcaagtcaggatattagaatgagttagctggtatcagcagagaccgagggggaccgaccccccataccctagtctagtggtgccttccgacggttacgaaaggtcggggtcccagtcgaaggttcaggtgggcgggtgggtcgtgctaacngtaacttcactctacaccntcagcccgctgcacggcccagtatttcgactaacgtttatactgtactanaagttacttccaacttcccgtagtacctgtcgaccgacgggaaccctagtcgtacgtaagactaaccgtaaacggacttcgggtcgtcgtacgacctaccgtatcgttcgttccttccc

SEQ ID NO: 25536 - DNA, 705 bp, Homo sapiens
  misc_feature: GYAE6OF01B0OGB.45.34.D01.1.454.CMB.1.raw
  modified_base (184)..(184): a, c, t, g, unknown or other
  misc_feature (184)..(184): n is a, c, g, or t
  modified_base (220)..(220): a, c, t, g, unknown or other
  misc_feature (220)..(220): n is a, c, g, or t
  modified_base (260)..(260): a, c, t, g, unknown or other
  misc_feature (260)..(260): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgcttattttagaaggtntccaatgtgagatgaaagtggtggagtcgtgggganacttggtccaggtccggggggtcctgagactctctgtacngcctctggactcaccttgacgactaattagttggatcggaccgttgggtcccgaccgaggcctaccggaagggggaacgggggtcgtaggggtagggtggggtcggacccaaacgtaagtaaaacggcgaaaggtaagtggggtaagtaacggaaaaacggaactagtaggtaggtaccttcgtaggtagggtaacgggttccggttacaaccgtatcctaccgagaacgaacaagtacgaaccaaagtaacttacgtaacgttttacgtttttaagggaaacgttacggtaactacggttcgtacggaagtacgtaccgaaaggtacgtaaccggattaagttaacttacgttacgtcggacggtacggaagtacgagttagaacgttacggtaaccgttaaagggtacgggggtaagacggtactaagttcgttgggtttacg

SEQ ID NO: 25537 - DNA, 250 bp, Homo sapiens
  misc_feature: GYAE6OF01D36B0.45.34.D01.1.454.CMB.1.raw
  modified_base (226)..(226): a, c, t, g, unknown or other
  misc_feature (226)..(226): n is a, c, g, or t
  modified_base (247)..(250): a, c, t, g, unknown or other
  misc_feature (247)..(250): n is a, c, g, or t
tcagacgcgatcgacacgaccggtgctcgatttagatcgtctgtggtgggtctggcacagaattcactctcaccatcagccgcctgcagcccgaagattttgcaacttattactgtctacaagatttcaattaccctcggacattcggccaagggaccaagcttgagatcaaacgaactgtggctgcaccatctgtcttcatctccgcatctgatcgatcgcgtcngagcggctggcaggctcatgnnnn

SEQ ID NO: 25538 - DNA, 675 bp, Homo sapiens
  misc_feature: GYAE6OF01BHF5E.45.34.D01.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (429)..(429): a, c, t, g, unknown or other
  misc_feature (429)..(429): n is a, c, g, or t
tcagacgcgatcgacacgaccggtgctcgatttagatcgtctgtgttgggtttgggggcaggagtcagacccactcaggacacagcatgggacatgagggtccccgctcagctcctggggctcctgctgctctggctcccaggtgccagatgtgccatccagatgacccagtctccattctccctgtctgcatctgtagganacagagttaccataacgtggccgganaagtcgaggattaattagaagtagtaggttaggcgtaggtatcgagcaggacgaccggacgggggaccacccccaactccgtagtctagtggtcgtcttacgtaggttaacgaaggtcgggtaccagtaccgtaaggttccgagggtcgggtcgggtgggtcgtcggactagtaacgtaactcctacgtctaccaccgtanccgtacgccgcgtcgaccaccggtaccgtaagttactttacgaccgttaaactttacttacgttgtaccttaacgtaagtttaactttacctaaacctttacccgtacggtaaccgtaccgtttaccgggaacccgtaaccgggtaacaacggtacgttaggaaaccgtaacgtaaaccgaaaacgtacgttggtaaccggtcgtaacccgtactaaccgttacttccggtttccgttcgttaccc

SEQ ID NO: 25539 - DNA, 724 bp, Homo sapiens
  misc_feature: GYAE6OF01BDYCB.45.34.D01.1.454.CMB.1.raw
  modified_base (169)..(169): a, c, t, g, unknown or other
  misc_feature (169)..(169): n is a, c, g, or t
  modified_base (217)..(217): a, c, t, g, unknown or other
  misc_feature (217)..(217): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgtgntatttagaggtgtcaatgtgagatgaaagtggtggagtcgtggggganacgttggtccgaggtcccgggggggtccctggagacctctccctgtacacgtcctcgtacggactctaccgttgagctaatttagttggtagtcggtaccgttcgggtcccgccgaggtccgtaccggagggggaacgggcgtgggagggtggggtcgacctaaacgaagtaaaacgcgtaaaggtacggtaggggaagtaacggaaaaggtaactagtaggttggtaccttcgtggtaggtaacggggttcgtacctaccgtactcctaccgagtaacgaactaatacgtaacctaaggtaacttacgtacgttttagttttaagggaaatttacggaacctaggttactaacggtagtaacgtaccggaaagtacgtaaccggacgttaagttagttacgttacgtacgggcgtaacgggagtaaggtacgttaggaaaggttcggttaaccgtaaaggggttacgggggtaataacgggtattaacggttgggtttcggttagg

SEQ ID NO: 25540 - DNA, 598 bp, Homo sapiens
  misc_feature: GYAE6OF01CD1JQ.45.34.D01.1.454.CMB.1.raw
  modified_base (221)..(221): a, c, t, g, unknown or other
  misc_feature (221)..(221): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtggggganacgttggtccagtcccgggggggtccctggagactctcctgtacagcctctggactcaccttgagcaattattggatgacctgggtccgccgaggctccgaggggaaggggctgggaggtgggtgccaaacagtaaacgcgaaagagtggagtacgaaaagactagtggtaggactcgtgtagaagggtcgttcaccatctcagagacatcgaccaagtaacttctagttcgttttaggaagtggactagtctagagtataccgaagtacgtacggactaaggtattattacgtggtacgcggaagagagttagaacgttacggttaccgttaaagggtacggggggtaagaacggtaagagtttcgttgggtttag

SEQ ID NO: 25541 - DNA, 813 bp, Homo sapiens
  misc_feature: GYAE6OF01DAF58.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattgggctgagctgggtctttcctgttgcttattttagaaggtgtccaatgtgagataggaaagtggtggaggtcgtggggagtacgttggtccgaggtcccggggggtcctgagactcctcctgtacacgtcctcgtacgacctcaccgttgagtactaaatttagtcggatcggtacccggtcgggtacccgcgacggccgtaccggaggggaacgggcgtagggacggtggggtacgaccaaacgaagtaaacggacgtaaaggtaggtagggaagtaacgaaaagtaacgttagtacggtacgtacgttgtaggtagggtaacggttccgttacaccctataccaccggagaacgaacgtaaacgtacgtaacctaaaggttaactttacggttaaacgttttaccgtttttaaagggaaaaccgttacgggtaaaccgtaaccggttaacgttaagggaaacccgggtaacgttaaaccccgggtaaacgggtaaacggtttaacccggaaacgtttaaaccgttaaaggtttacctttaaaccgggcggtaaacccggaacgggtaagtaaacggttacgttagaacgggtttaaacccggtaaacgggttaaagggtacgggggtttaaaggaagttaaccgttcgtttaggtttacggggtttaag

SEQ ID NO: 25542 - DNA, 752 bp, Homo sapiens
  misc_feature: GYAE6OF01BJ4VA.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcacatggaattgggctgagctgggtctttccttgttgcttattttagaaggtgtcatgtgagatgaaagtggtggagtcgtggggagtacgttggtccaggtccggggggtcctggagactctcctgtacgcgtcctcgtggacctcgtaccttgaacgtactaagttacgttggactcggaccgttcggggtcccgccgaggtcctaccggaggggtaacggggcgtaggggagggttgggtacggacctaaaacgtaagtaaaacgacgaaaggaggtagggtaacggtaacgaaaaaggtaacgttagtacggtaggtacttacggttaggtagggtaacggggttccgttaccgtacctaacgtcctaccgaagtaacgaacttaagtacggaacccgtaaaggtaaccgtttacgtaacgttttacggtttttaacggtaaagttcggtaaccgtagttacgtagggaacgtaacgttaaccggaacggtaacgttaaccgtacgttaaacggttattaacgttacggtacgtaccggtaggaaggagtaagtggtaaagttacgttacggtaaaggggtaggggtagtaacgaacgttgtttacggttgggttaag

SEQ ID NO: 25543 - DNA, 747 bp, Homo sapiens
  misc_feature: GYAE6OF01C7F6L.45.34.D01.1.454.CMB.1.raw
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (717)..(717): a, c, t, g, unknown or other
  misc_feature (717)..(717): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagtacttggtccagtcccgggggggtccctgagactctcctgtacngtcctntggactcctaccgttgagactaattagtggatcggaccgtcgggtcccgccgaggcctacccggaaggggaacggggtccgtaggggtaggttggggtacgaccctaaaacgaagtaaaaacggaccgaaaggtagtaggggtaacggttaacggaaaagtaaactagttggtacggacgttcgtagggttaaggtaacggggttccgtttaccaaccgtattcccgtaaccgaggaacgtaacgtaaactcggaaccgtaaagttaactttaccgtaggttttacctttttaaagggaaacttggtaacctaacggttccgtaaggtaacgaaccttaaccggaaaggtacgtacgggtaacctaaggttaacttattaacgtcggacggacggtaaggagtacgttaggtacttaacggttaccgtaaggggttacggggtaanaacggttataaggtttcgtttgggttaacg

SEQ ID NO: 25544 - DNA, 671 bp, Homo sapiens
  misc_feature: GYAE6OF01E1NSA.45.34.D01.1.454.CMB.1.raw
  modified_base (297)..(297): a, c, t, g, unknown or other
  misc_feature (297)..(297): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattattggatgacctgggtcccgccaggctccagggaaggggctggagtgggtggccaaacataaaagcaagatgggatcgaaaagactatgtggactctgtgaagggtcggttcaccatcctccagagacatgaccaagaattcagttcttttaggaaatggacagtctgaanatccgaaagatacggcagtatattactgcgcgagagatagattagtacctaagtgggggtanacgaactntcttgggtttgagtgtacgtttcgattggtggtggggcccagggaaccacgggtcacccgtctccgttcacgccctaccaccgaacggcccctagtccggttcccttccccccgtaggccccgtccccgttcgccgttacccgaagggtaaccgccccgtaacccgtcccgaaggaccgtaccgaccgacggccccgggccccgttcggggtaccctcgggtcccgtcggttaacgaaaccgggttacccttaacccgtttccccgtacgttaacggtcctccggttcccgtgggtaacccggg

SEQ ID NO: 25545 - DNA, 853 bp, Homo sapiens
  misc_feature: GYAE6OF01DXJ99.45.34.D01.1.454.CMB.1.raw
  modified_base (104)..(104): a, c, t, g, unknown or other
  misc_feature (104)..(104): n is a, c, g, or t
  modified_base (142)..(142): a, c, t, g, unknown or other
  misc_feature (142)..(142): n is a, c, g, or t
tcagacgcgatcgacacgaccggtgctcgatttagatcgtctgtgttggggtttggggggagtcagacccactcaggacacagcatggacatgagggtccccgntcagctcctggggctcctgctgctctggctcccaggtnccagatgtgccatccagatcgacccagtctccattcctcctgtctgcatcgtggtaggagacagtagttaccattaacgttcggaccgggactaagtcgaaggtataagttaagaaagtggtaaggtttagggacgttaggttaatccgaagacgaacggaacggaccggaacggggggaccccaacccccccgtaacgttcccgtaaggttctaaggttcgggtcgtaccgtttaccgtaaggtttaacgtaacgggttccggggtaccctaacgtaccgttaagggttccgtagggtcgggtcggggttagggtccgttacggacgtaacgtaagttaactttccaccgttacccgtaccaaccgtacgtaccgaccggtcccgtcccgtacggaacccgtaccggttaacccggtaaacgtttacggttttaccgaaaccctttaaccgttttaacgtttaacgttacgtttaacccgtaaacgttaaacgttttacttttaaccccgttaaaccgttttacccccgtacgggttaaacccttagggtttaaccccgggaaccggtaaaccgggtaaccctaacggtttacgtacggtaagtacccgtaaaaccggtaaaccgttaggttaccggttacggtaccggtaccgtaaccctaccgttacgtttacctaccggttttccttaccgttacccgttacccccg

SEQ ID NO: 25546 - DNA, 633 bp, Homo sapiens
  misc_feature: GYAE6OF01CCSE3.45.34.D01.1.454.CMB.1.raw
  modified_base (222)..(222): a, c, t, g, unknown or other
  misc_feature (222)..(222): n is a, c, g, or t
  modified_base (454)..(454): a, c, t, g, unknown or other
  misc_feature (454)..(454): n is a, c, g, or t
  modified_base (545)..(545): a, c, t, g, unknown or other
  misc_feature (545)..(545): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggcttttccttgttgctattttagaaggtgtccaatgtgagatgaaagtggtggagtcgtggggganacttggtccaggtccgggggggtccctgagactctcctgtacagcctgtggactcaccttgagactaattattggatcgaccgtcggggtccgccgaggcctccggaaggggaacggggcgtagggaggtcggggtcgacccaaacgaagtaaaaggacaaaggagtagggaacgtaacgaaaagaactagtggtagactcgtgtaggaaggtcgttacactatctacaganacaatgacaagtaacttcgtagtttcgttttaggaagtgacgtagttcgtagagtacgtacgaagacgtacggataagtacttagttacgngacgtacgaggtacgtagtagaagttcggtaaccgttaaaggggttacgggggtaacggaacgtaaggtacgtttggttgggtttacg

SEQ ID NO: 25547 - DNA, 759 bp, Homo sapiens
  misc_feature: GYAE6OF01ESXQY.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggtctttccttgttgcttattttagaaggtgtccaatgtgagatgaaagtggtggagtcgtggggagtacgttggtccgaggtcccggggggtccctgagactcctcctgtacacgcctcgtggacctcctaccttgagctaatttatggatcgaccgttcggggtcccgccgacgggtccgtaccggaagggggaacggggtcgtagggtagggtggggtacggaccgaaaacgaagtaaaacgacgaaaggtaggtagggtaacgtaacgaaaaagtaacgttaaggtggttacggtacttcgtagggtacggtaaacggggttccggtttaccaacccgtacgttcccgtacccgaagaacgtaactaagtaccgaacctaaagtaactttaccgtaaggttttaccgttttttaaagggaaacgttacgggtaacgtacggttacgtagggtaacgtaacgtaaccggtaaaggtaccgtaacggacttaaggttaattacgttacgtcggacggtacgtaaggtagtagttaagtaagttacggttaaccggtaagggttacgggggtaatacgtaacgttaggtttggttgggttttag

SEQ ID NO: 25548 - DNA, 685 bp, Homo sapiens
  misc_feature: GYAE6OF01EM4GK.45.34.D01.1.454.CMB.1.raw
  modified_base (317)..(317): a, c, t, g, unknown or other
  misc_feature (317)..(317): n is a, c, g, or t
  modified_base (351)..(351): a, c, t, g, unknown or other
  misc_feature (351)..(351): n is a, c, g, or t
tcagacgcgatcgacacgaccggtgctcgatttagatcgtctgtgttgggtctgggggagacttggtccagtccgggggggtccctgagactctcctgtacagcctctggactcaccttgagcaattattggatgacctgggtccgccaggctccgagggaagggctggagtgggtgccaacataaagcaagatgggagtacgaaagactatgtggactcgtgtgaagggtcgtcaccatctcagagacatgaccaagattcagttcttttaggaaatggacagtctgagatccgaagatacggcagtatattacgngcgacgagagatgatagtacctaaggtggggtanagacagtcgttggttgagttgtcgtttacgagttgggttggtcggggaccgtaacggggaaccgtaacgggttacccgtacccggttcttaccgttaccgacgtacccctacccgaacccgtaaccggggcccctaaggttccccggtttacccttcccccccggtaggtcccgacccccgttggcccgttaacccggacgggaccgcccgtacccgttccgaacgaccgaccgtaccgacggacccggggtcccgtcggggtccgtcggtacccggtcggtaaccgtaacgggtaccttaccggttccacgtacgttccggtcgtcgtacggg

SEQ ID NO: 25549 - DNA, 643 bp, Homo sapiens
  misc_feature: GYAE6OF01BLLFM.45.34.D01.1.454.CMB.1.raw
  modified_base (353)..(353): a, c, t, g, unknown or other
  misc_feature (353)..(353): n is a, c, g, or t
  modified_base (545)..(545): a, c, t, g, unknown or other
  misc_feature (545)..(545): n is a, c, g, or t
tcagacgcgatcgacacgaccggtgctcgatttagatcgtctgtgttgggtttgggggtctcagagaggagccttagccctggactcccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccgggggggtccctgagactctcctgtacagcctctggactcaccttgagctaattatggatcgaccgtgggtcccgccgaggcctccggaggggaaggggctgggaggtgggtgccaanagtaaagcaagagtagggagtacgaaagtaacgtatggtggactcgtggtaggtaagggttcggttcacctatccgtaccagagacaagtgaccgtaagtacttcgagtttacgttttaggaaagttggaactagttctaggaagtaacgttaccggaaagtacgtaaccggctaaggttattacgttacgnggccgacggaggtacgagttaggtaacgttacggttacccgttaaaggggttacgggggttaagaacggtaaccgtagtttccggtttgggtttaagg

SEQ ID NO: 25550 - DNA, 676 bp, Homo sapiens
  misc_feature: GYAE6OF01BV95C.45.34.D01.1.454.CMB.1.raw
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccgggggggtccctgagactctcctgtacagcctctggactcaccttgagcaattattggatgacctggtccgccaggctaccgagggaggggctggagtgggngaccaanaataaagcaagagtgggagtacgaaaagaactagtaggtggactctaggtggaaagggttcggttaccaacctagtcctaccgaagacgaactaatcgaaccgaaggtaaactttacgtaggtttacgttttttaggaaacgtttcgggaactaacggttacgtaggaaggtaacgttaccggaaagtacgtaaccgggtactaaggttaagttaactttaacgtggtaccggtaccggtaaggaaggtaacgttaggtaacgttacggttaccggttaaacggttaggggggtaacgaacggttaaccgtacgttcggttgggttttaacgg

SEQ ID NO: 25551 - DNA, 792 bp, Homo sapiens
  misc_feature: GYAE6OF01A2D7Z.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttcctgttgctattttagaaggtgtccaatgtgagatgaaagtggtggagtcgtgggggagtacttggtacctacggtcccggggggggtcccttggacggtaccttccgtccgtggtacacggtcctcgtacggaccttaccgtaccgtttaggaacgtactaatttagttaggacttcggtaccggttcggggtacccgccggacggtccgttaccggaaggggtaacggggtcgtagggaggttcggggtacgaacccaaacgtagtaaaacggacgtaaaggaggtacgggaagtaacggaaaacgtaacgttaagtcggtaaggtaccgttacgttgggtaagggtaaccggggttcggttaccgtaacccgtacgttaccgttaccggaaacggaagtaacctaaggttcccgaaacggtaaacgtacgttacgttacgggtttaccttttaaagggaacgttacggaccgtagttacgtaggtaacgtaccgtacggtaaagtaccgtaacggaccttagtaaccttagtaaccgtggtaccgagtaaggataccgtagggttacctaaacggttccggtaaaagggtcggggttaacaacggtacttacgttcggttggtttaacg

SEQ ID NO: 25552 - DNA, 194 bp, Homo sapiens
  misc_feature: GYAE6OF01C2QCC.45.34.D01.1.454.CMB.1.raw
  modified_base (126)..(126): a, c, t, g, unknown or other
  misc_feature (126)..(126): n is a, c, g, or t
  modified_base (170)..(194): a, c, t, g, unknown or other
  misc_feature (170)..(194): n is a, c, g, or t
tcagacgcgatcgacacgaccggtgctcgatttagatcgtctgtgttggggtttgggggtctcagagaggagccttagccctggactccaaggcctttccacttggtgaccagcactgagcacagnggactcacatggaattgggctgagcggctggcaaggcgcatagnnnnnnnnnnnnnnnnnnnnnnnnn

SEQ ID NO: 25553 - DNA, 912 bp, Homo sapiens
  misc_feature: GYAE6OF01B8UW4.45.34.D01.1.454.CMB.1.raw
  modified_base (184)..(184): a, c, t, g, unknown or other
  misc_feature (184)..(184): n is a, c, g, or t
  modified_base (271)..(271): a, c, t, g, unknown or other
  misc_feature (271)..(271): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaagttgggctgagctgggctttccttgttgcttattttagaaggtntcaatgtgagatgaaagtggtggagtcggtggggagacgttggtccgtaggtcccggggggtccctggacgtactcctccgtgtacncgtccttctcggactccgtaccttaggaggtacctaatttacggtggtatacggtaccggtcggggtccccgaccgtagggtcccgtaccggaagggggtaacggggtcgtaaggggtacgggttcggggtacggaacccaaaacgtaaacgttaaaacggaacgtaaagggtaacggttacggggtaaaggtaaacccggtaaaaaggtaaaccgttaaggttacggttacgggaaccgtttacggtacgggtaacggggttaaaccggggtttacccgggtttaacccgaacccgttaaccgttacccgttaacccggaaacggtaaacggtaacccgtaaaaggttccgtaaaaccccgtaaaagttaacgttttaaacccgttacgggtttttaaccgttttttaaagggaaaccgtttaacgggtaccgtacggtttaccggtaagggtaaacgttaccggttaaaccgggtaacggttaaaccgttaaccgggtaacgtttaaacgttaacgtttaactttaccggacgtaccggggtataaacgggtagtacgttaaggtaacgtttaccggaaccgtttaaggggacgggggttaaatacggttaaccgtcgttttcgggttaagggttttcg

SEQ ID NO: 25554 - DNA, 844 bp, Homo sapiens
  misc_feature: GYAE6OF01EBX5F.45.34.D01.1.454.CMB.1.raw
  modified_base (551)..(551): a, c, t, g, unknown or other
  misc_feature (551)..(551): n is a, c, g, or t
tcagacgcgatcgacacgaccggtgctcgatttagatcgtctgtgttggggtttgggggtctcagagaggagccttagccctggactccaaggcctttccacttggtgaccagcactgagcacagaggactcacatggaagttggggctgagcgtgggtctttccttgttgctatttagagtgtcaatgtgagatgaagtggtggagtcggtggggatacgttggtccgacggtcccgggggggtcctaggacgtaccgtcctccgtagtacacgtcctcgtggacctcctaccgttgagtactaatttacgttggaatacggaccggttcggggtccccgaccgtacgggccgtaccgggaagggggtacggggtcgtaggggagggttcggggtaggaaccctaaaagtaacgaaaaggtcgaaaaggtaggtagggaagtaacggaaaagtaacgtagtaggtacgtacgttcgtaggtacgggtaaggggttcccggtttaaccaaccgttactccgtaacccgtaaggaacgtaactaacgggtanaaaccgtaaaggttaacttacggtttaacggtttttaccggtttttaaagggaaaagtttaccggtaaacgttacggtttaacgtacgggttaacgtaaccggttaaccggggtaaaagttaaccgggttaaacgtaccggtaaagttaacgtttaacggttacccggtaagggtacccggagggaaacggtacggtaaacgtttagtaaacggttaacgggttaaccgggttaaaggggttaacgggggtaaacgtaacgtagtttaacggtttcgggtttgggtttaacgg

SEQ ID NO: 25555 - DNA, 920 bp, Homo sapiens
  misc_feature: GYAE6OF01DRO9I.45.34.D01.1.454.CMB.1.raw
  modified_base (221)..(221): a, c, t, g, unknown or other
  misc_feature (221)..(221): n is a, c, g, or t
tcagacgcgatcgacacgaccggtgctcgatttagatcgtctgtgttgggtttgggagtctcagagaggagccttagccctggactccaaggcctttccacttggtgaccagcactgagcacagaggactcaccatggaattggggctgagctgggtctttccttgttgcttattttagaaggtgtcaatgtgagatagaaagtggtggagtcgtgggganacgttggtccaggtcccggggggtccctggacgtacctcctcctgtacacgccttcgtcggacctccgtaccttgaacgtactaatttagttaggtatcggtaccgttcggggtccccgaccgacgggaccgtaccgggaagggggaacggggtcggtaggggtacgggttcgggggtaccggtaacccgaaaacgtaaaacgtaaaacggaccgaaagggtaacggtaagggggaaacggttaaacgggaaaaacgttaaaccgtttaagttggggttacggtaaccgttcggttagggtacggggttaaacgggggtttcccggtttaccaacccgtacttacccgtaccgaaacggtaacgtaaaccgtaacgtaccgaaaccgtaaaacggttaacttttaccggttaacggttttttaccggtttttaaacggtaaacggtttacgggtaaacgttaacggttaccgttaaggaaaccggtaaccggttaaacccggaaagggttaaccgttaaacccgggtacgttaaacggttttacgttaacgttttaacccgtacgggtaaccgggaaccggttaaagggaacgttaagttaagggttaaacgttaaacccgggttaacgggtttaaaacggggtttagggggggtaaacgttaacgggtaacgtttaacgggtttcggttttaaagggg

SEQ ID NO: 25556 - DNA, 727 bp, Homo sapiens
  misc_feature: GYAE6OF01BKLYS.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtggggagacttggtccaggtcccggggggtcctggagactctcctgtacacgcctctggactctaccttgacgtactaatttattggtatcggtaccccgtggggtccccgccgacgggccgtaccgggaagggggaacgggggtccgtggggtagggttgggggtaccgggaacccaaaacgtaaagtaaaaacggacgaaaagggtacggtaggggaacgttaacggaaaaaggtaaacgttaggttaggtacggtaaccgttcgttagggtagggtaacgggttcggttaccaaccgtattaccctacgaagaacgtaactaactcgaaccgtaagtaactttacgtacgtttacgttttaaggaagttcggaactagtacgtagaacgtacgtaacgaacgtaagtaacggtactaagttaacttacgttacgtggacgtacggaagtacgtattagaagttacggtacgtaagggttacggggtaacacgagtacgtttggttggttacg

SEQ ID NO: 25557 - DNA, 730 bp, Homo sapiens
  misc_feature: GYAE6OF01DF7J9.45.34.D01.1.454.CMB.1.raw
  modified_base (190)..(190): a, c, t, g, unknown or other
  misc_feature (190)..(190): n is a, c, g, or t
  modified_base (339)..(339): a, c, t, g, unknown or other
  misc_feature (339)..(339): n is a, c, g, or t
  modified_base (395)..(395): a, c, t, g, unknown or other
  misc_feature (395)..(395): n is a, c, g, or t
tcagacgcgatcgacacgaccggtgctcgatttagatcgtctgtgttgggtttggggggtctcagagaggagccttagccctggactccaaggcctttccacgttggtgaccagcactgagcacagatgactcaccatggtaattggggctgagcgtgggtcttttccttgttgacttatttagaaggtntaccatgtgagagtagaaaggtggtaggtagtcggtgggggagtacgtttcggtaccgtacgggttcccgggggggtccctaggacgtaccttccgttcctaggtacaccgtccgttcgtggaccttccgaccttgactactaattttntacggatcgaccggttcgggcccgtccgaggcctaccgggaggggtaacgggtcgngggtaggtgggtacggaaccaaagaagtaaagacgaaaggtggtacgggaagtaacgaaaggtaacgttagttggtaccgacttcgttagggtaggtaacgggtttcggtaaccactacgtaccgacgtaacgaagtaactaatacgaacgtaaagttaacgttacgttagtttacgttttaacggtaagttagtacgtagtcgttaacgacgtacgtaacgacgtaacgtagtagtagttacttaagtcgtacggaccgaggtaacgagtagttagtaacggtacgtttaaggtaacgggttagggaacgtaagtacgtagtttcggtttaggg

SEQ ID NO: 25558 - DNA, 750 bp, Homo sapiens
  misc_feature: GYAE6OF01CDU06.45.34.D01.1.454.CMB.1.raw
  modified_base (288)..(288): a, c, t, g, unknown or other
  misc_feature (288)..(288): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagcgttgggtcttttccttgttgtcttattttagaaggttcgtccaatgtagagtataggtaagtgggtggtagtcggtgggggagtacttggtaccgtacggtcccgggggggtccctggacgaccttctcctgtacncgtcctacgtgacctcaccgttgagtctaattagttaggagtcgtaccgtcgggtccgccgaggccgtaccggaggggacggggcgtagggtaggtagggtccgaaccaaagtaagtaaacggacgtaaaggtacggtagggaacgtaacggaaaagtacgttaagtcggtacgtacgttccggtaggtacgggtaacgggttccgttaaccgtaaccttacgtaccctacgaaacgggtaacgaacctaacggtaccgtaaaccgtaattaaaccgtttcgttacgtttttaccgggtttaagtaaaagttcggtaacgtaacggttacgtaaggaacggttacgtaaacccggtaagtacggtaacgtacgtagttagttaaccgtcgtaggacgacggtaagtacgtagtagtaaggttacggaccgttaaggtgggtactagacgttagttgttggta

SEQ ID NO: 25559 - DNA, 715 bp, Homo sapiens
  misc_feature: GYAE6OF01A280F.45.34.D01.1.454.CMB.1.raw
  modified_base (639)..(639): a, c, t, g, unknown or other
  misc_feature (639)..(639): n is a, c, g, or t
  modified_base (645)..(645): a, c, t, g, unknown or other
  misc_feature (645)..(645): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggtctttccttgttgcttattttagaagtgtccaatgtgagatgaaagtggtggagtcgtgggggagtacgttcggtccgacggttcccgggggggtccctaggacgtacctccgtcgtcgtacgcgtcctcgtcgacctcctacgtagacgtacttaatttacgtaggtataccggtccggtccggtacccgacggcggtaccgtacgggaacggggacggtcggtacggggtaggtacgggacgaaccgaagtaacgaacgacgaaggtacgggtaggacgtaaacgtaaaggtacgtaggtacggtacggtacttacggtaggtacgggttaacgggttccgtaccaacgtacgttaccgaacgtaaggaactaaccgagtacccgaaactaaacgtttacgtttactaggtttttaacggttaaagtaagtacgtagtacgtagagaacgtcgaacgaagtaccgtagatagttatacgngcgganagagtacgagtataacggtccgttaaggtaacgggtaggtagaccgtattagggtttcgttagggttacg

SEQ ID NO: 25560 - DNA, 919 bp, Homo sapiens
  misc_feature: GYAE6OF01ELG9Z.45.34.D01.1.454.CMB.1.raw
tcagacgcgatcgacacgaccggtgctcgatttagatcgtctgtgttgggttgggggtctcagagaggagccttagccctggactccaaggcctttccacttggtgaccagcactgagcacagaggactcaccatggaattggggctgagctgggctttccttgttgcttagttttagaaggtgtccaatgtgagatagaaagtggtggagtcgtggggagtacgttggtccacgggtcccgggggggtcccctggtaacggaccttccgttcccgtaggtaccacggtcccttacgttcggacctccgtaacccgtttggaacgtaccttaaattttagttgggaactcggtaccccggttcgggttccccggaccgtaaccgggtccttacccggggaagggggggtaaagggggtccgttagggggtaacgggttcggggggttaccggaaccccgtaaaacggtaaagttaaaaaccgggacgtaaaaggtaacgggtaggggaaacggttaaaccgggaaaaaggtaaaccgttaaggtttggtaacggggttaaccgttaggttacgggttaaggggtaaaccgggggtttcccggttaaccgtaacccgtaacgtttacccgtaaccccgtaaaggtaacccgtaaacgtaaacggtcggtaaacccgtaaagggtttaactttacccgggttaacgtttttaacggttttttaacgggaaaagtttcgggtaaacccgtagttaccgttaggaaacgtaccggttaacggaagtaagttaccggaactagtttaacgtactttacggcggtactccgggaaagtaggtaacgtaggttaacgttaaccgttacgggtttaaagggttagggggtaaacaacggttacgtagtttccggttggggtttaccg

SEQ ID NO: 25561 - DNA, 875 bp, Homo sapiens
  misc_feature: GYAE6OF01DBONM.45.34.D01.1.454.CMB.1.raw
tcagacgcgatcgacacgaccggtgctcgatttagatcgtctgtgttgggtttggggtctcagagaggagccttagccctggactccaaggcctttccacttggtgaccagcactgagcacagaggactcaccatggaattgggctgagctggtctttcttgttgcttagttttagaaggtgtaccaatgtagagtagtaggtaaagtgggttggaggtcggtagggggacgtacgtttcgggtaccgtacgggttcccggggggtcctggtacgtaccttccgtccgttacggtacgacgtccggttcgtacgggtaaccttccgtaccgttggaacgtaccgttaagtttagtcgggtagttaccggtaccgttcggggttcccgaccggtaacggtccgtacccgggtaagggggtaacggccggttaagggtagggttaccggggtaccgaacccgtaaacgtaaaccgttaaaaggcggaaaacggttaggtaaacgggggtaactaaacggtaaaacgttaaacggtaggtacgggtaacgtacggttaccgtagggtttaacgggtaacgggttttacccggtaacctaaaccgtcgtaacccgtaccgtaaagaccgtaactaagttacccgtaaccgtaagttaacgttaacgttaggtttacgtttttaacggaaacggttacggtaacgttaacggttacgttacgggtaaccgttaacggtaaaccgtaggtaaaccgttaacgggaacgttaagtaacgtttacgttacggacggttccggaaagtaacggttaggtacgttaagtacggttacgtacggttaaaggcggggtaacaagttacgtcgtttggtaggtttacg

SEQ ID NO: 25562 - DNA, 765 bp, Homo sapiens
  misc_feature: GYAE6OF01AXLXV.45.34.D01.1.454.CMB.1.raw
  modified_base (220)..(220): a, c, t, g, unknown or other
  misc_feature (220)..(220): n is a, c, g, or t
  modified_base (316)..(316): a, c, t, g, unknown or other
  misc_feature (316)..(316): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttcctgttgcttattttagaaggtgtccaatgtgagatgaaagtggtggagtcgtgggganacttggtccaggtccggggggtcctgagactctcctgtacagcctctggacctcaccttgacgctaattattggatcggaccgtgggtcccgacgnggctaccggaggggaaggggctagggaggttggggtcgacccaaacgtaagtaaaacggacgtaaaggagtaggggaacgtaacggaaaaagtaaccttagtcgggttaggaccgttacggttgggtaaggttaaacggggttccggtttaccaacccgtacttcccgtacccgaaggtaaccgtaaacgtaaagttaccgaaccgtaaaaggttaaacgtttccgaagttttaccgtttttaagggaaaacgtttcgggaaccttaaggttctaaggtaacgtaacgtaaccggtaaaggtacgtaacccggggtataacggttaatttaccgttacgtaggaccggtacgaaaggtagtaacgttaggtaagttaaccggttaaccgttaaagggggttacgggggtaaatacgggtaaacttacgtttcggtttagggtttaccgg

SEQ ID NO: 25563 - DNA, 831 bp, Homo sapiens
  misc_feature: GYAE6OF01CG9VZ.45.34.D01.1.454.CMB.1.raw
  modified_base (147)..(147): a, c, t, g, unknown or other
  misc_feature (147)..(147): n is a, c, g, or t
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcgaccatggaattgggntgagctggtctttccttgttgctattttagaggtntcaatgngagatagaaggtggtggtagtcggtgggggacgtacgttgggtccgtacgggttcccggggggtcctggacgtacctcgttccgtacgtaccacgtcccttcgtcggacctcgtaccgttgacgtactaagttagttggatcggtaccggtcgggtcccgtaccgacggtccgtaccggaagggggtaacggggtcggtaggggtagggttcggggaccggaacccgaaaacgtaaacgtaaagggaacgtaaaggtagggtacgggtaaacggtaaacggtaaaaacggtaaacgttaggttacggtacggtactcggttaggtacgggtaacgggttccgttaacgtaccgtactttcccgaacgaacggtaacgtaccgaaagtacgaaaccgtaaagttaccgtagttacgttttacggtttaaaggaacgtcggtaacgttacgtataacgtaaggtacctaaacgggtaagtacgggttaacccggtaataacggttttaattaccggttttaaacgcggtaaccggtaagggaaccggtaagttacggtagggtttaaacgtaccggttaagggttaaacgggggttaggggtaaacgacgttaacgtttacgggttagggtttcggtttaaacg

SEQ ID NO: 25564 - DNA, 744 bp, Homo sapiens
  misc_feature: GYAE6OF01EHSGI.45.34.D01.1.454.CMB.1.raw
  modified_base (149)..(149): a, c, t, g, unknown or other
  misc_feature (149)..(149): n is a, c, g, or t
  modified_base (261)..(261): a, c, t, g, unknown or other
  misc_feature (261)..(261): n is a, c, g, or t
tcagacgcgatcgacacgaccggtgctcgatttagatcgtctgtggttgggtttgggggcaggagtcagacccactcaggacacagcatggacatgagggtcccccgctcagtcctccgtggggcctcctgctgctctgctccaggtcncagagtgtcgccatccgagtactcgaccctagtcctcctacttcctcccgtgtcgtgctatcgtggtaaggagtacgtagtaacgttaacctaagttaacgttcggccgganaacggtacgaggtaattaagtaagaagtggtaagttaggtcgttaggtactacgacggacaacggaccggaccgggaaccgggggacccctaaccccccgtaagttacccgtacgttacgttacggtcggttccgttacgtttaccggtaaacggttaacggtaacggttccgggtaacctacgtacggtaacggtcggtacggggtcggtacggggttgtacggacggactaacgtaacgtactactaccgttacctacaaccgtctaccgcccggccgtcgtacgtaccgtaccgtaacgtattacgttacaacgtttaccttaatcgtacctaactaactacgttacttaacccgtaacctacccggtcgttaacgttaaccggtacccgaacgtacggaacctaggtacttacgaacgtaacgtaaccgtaaaggtaccgtgtaccgctaacgcccttacacgttctacgttcctaccg

SEQ ID NO: 25565 - DNA, 707 bp, Homo sapiens
  misc_feature: GYAE6OF01DVHE0.45.34.D01.1.454.CMB.1.raw
  modified_base (185)..(185): a, c, t, g, unknown or other
  misc_feature (185)..(185): n is a, c, g, or t
  modified_base (286)..(286): a, c, t, g, unknown or other
  misc_feature (286)..(286): n is a, c, g, or t
  modified_base (379)..(379): a, c, t, g, unknown or other
  misc_feature (379)..(379): n is a, c, g, or t
  modified_base (426)..(426): a, c, t, g, unknown or other
  misc_feature (426)..(426): n is a, c, g, or t
  modified_base (594)..(594): a, c, t, g, unknown or other
  misc_feature (594)..(594): n is a, c, g, or t
tcagacgcgatcgacacgaccggtgctcgatttagatcgtctgtgttgggtttggggggtctcagagaggagccttagccctggactccaaggtcctttccacttggtgaccagcactgagcacagaggactcacatggaagttgggctgagcggtgtgttacgtaggtcgactattaggagtcncatgtgagataggaaagtggtagcgtaggtcggggatacgttcggtaccgacggttcccgggggtcctaggagtacctccgtcttgacgtcgtctagtacnctcgtacttatacgacttaattagtaggactgacggtccggtccgctaggcacggaagggacggtgtggagttcggacgaactacgaataagnaagcggagtgaaacgaatacgatcggtattacgcggtgtaaaccggnggtccttaaccactttaacgcccaacgttagaaacgtacaagtacgaaccggtaagttataccgtaggttttaactttaaggacgggttactaagtcgttacggtagaaccggtaagttaccgtaaaggaaccgttacggtaacgtaacttaattccgttaaccgggnggtacggtacggtaacggtaacggttaacggttaacggtaacggttacggttaacgggtttaacgggttaacgggtaacggtaacgtaagttacggttggttacggttaacgg

SEQ ID NO: 25566 - DNA, 787 bp, Homo sapiens
  misc_feature: GYAE6OF01EHRJC.45.34.D01.1.454.CMB.1.raw
  modified_base (730)..(730): a, c, t, g, unknown or other
  misc_feature (730)..(730): n is a, c, g, or t
  modified_base (766)..(766): a, c, t, g, unknown or other
  misc_feature (766)..(766): n is a, c, g, or t
tcagacgcgatcgacacgaccggtgctcgatttagatcgtctgtgttgggtttgggggtctcagagaggagccttagccctggactccaaggtcctttccacttggtgaccagcactgagcacagacggactcacctagtggtaagttgggctgagtcgtggtctttccgttgttgtcttagtttagagttgtactaagtgtagagtagtagtaaggtggtaggtagtcggtaggggatacgttcggccgtacggggttccccgggggtcctaggaccgtaccgttccttacgtacgtaccgaccgtcccgttcggtacggttacctaccgttaccgttagacgttaacgttaagtttggtacggtagtaccggtaccggtccggtccgaccgtacggtccggtacgggagggggacgggtacggtaggggtacgggttcgggaccgaacgtaacgtaagaaacggagtaaagggtcggtaaggaagtaacgtaaacgtacgtaggtacggtacgtacgtacggtaggtaacgggttcggtccttacctacgtacctaccgtaaccgaagacaacgtaacgtaccgaaacgttaacttagttaccggttttagtttacggtttaaaggaagttggtaaccgtttagtgtacgtaacggtaacgtaacggtaagttcgtaacggttaagttaagttaccgttaaggtccgtaggaacgtacgaagttacgngttaaagttcggtaaggtaccgtagggacgtaacgnttaacgtgttaggttcgttag

SEQ ID NO: 25567 - DNA, 882 bp, Homo sapiens
  misc_feature: GYAE6OF01D7796.45.34.D01.1.454.CMB.1.raw
tcagacgcgatcgacacgaccggtgctcgatttagatcgtctgtgttgggtttgggggtctcagagaggagccttagccctggactccgaaggcctttccacttggtgaccagcactgagcacagagctacaccagtggaagttgggctgagtcgtggtctttcgtgttgcttatttagagtgtacaatgtagagtagtagtaaggtggtaggtaggtcggagggggtactacgttcgggtaccgtaccggggttccccgggggtcctaggaccgtaccttccgtccgttagtaccgtaccgtccttcgtaacggccttaccgtaccgttaggacttagttaatttacgtggtaactcggtaccccggtcgggtaccccgcggtaccggtaccggtaccggggaaaggggtcgggtacgtggggtacgggtacggtaccggaaaccctaaaggtaaacgttaaaccggagtaaaacggggtaggttaaccggggtaagtaaaccggtaaaaagtcggttaggtacgggttaccgtaccgtttaggtacggggttaacgggttaaccgggttacccttacccgaaactttccggtaacccgtaacgaccggtaaaacgaccgttaaacgtaaccggtaaccgttaaacgtttaaccgttaacgtttaacgggtttttaacggtttaaacggtaaaccgtttaggaccttaggtttacgaacggttagtaaaccgaacggtacgtaacggtaacggtacttaaggttacttaacgggttcaccggagtacggtaagtacgtaagttaggtaagttacccggttagggttaacgggtacgggttaacgtaagtacccggttttaaacgtgggttttcgtaacggg

SEQ ID NO: 25568 - DNA, 778 bp, Homo sapiens
  misc_feature: GYAE6OF01EXK05.45.34.D01.1.454.CMB.1.raw
  modified_base (272)..(272): a, c, t, g, unknown or other
  misc_feature (272)..(272): n is a, c, g, or t
tcagacgcgatcgacacgaccggtgctcgatttagatcgtctgtgttgggtttgggggtctcagagaggagccttagccctggactccaaggccctttccacttggtgaccagcactgagcacagaggactcaccatggattggggctgagctggtctttcttgttgcttatttagaagtgtccaatgtgagatgaaagtggtggagtcgtagggggagtacgttggtccgacggtcccgggggggtccctggacgtacctcctcctgtacncgtcctctggacttccaccgttggacgtactaattagttaggattcggaccggtcggggtcccgaccgacggccgtaccgggaggggacggggtcgtagggacgggttggggtacgaaccgaaacgaaagtaaaacggacgaaaggtaggtaggggtaacgtaacggaaaagtaaacgttaggtaggtacggtactcggttagggttacggggtaaacggggttcccggtttacacccgtacgttccgtaacccgaaggtaacgtaacgtaaagtaccgaaaaccgtaaagttaacgttttacggtaacgtttttacggtttttaaagggaaaacgtttaccgggaactaacggtttaccgtaaggtaacggttaaccgtaaccggtaaggtaacgtaccgggtaataacggttattaacgtacgtcgggaccgttaggaacgtaagtataggtacgttaacggtaacgtaggggtagggtagactaagttcgttggttggttacg

SEQ ID NO: 25569 - DNA, 785 bp, Homo sapiens
  misc_feature: GYAE6OF01B3BU3.45.34.D01.1.454.CMB.1.raw
  modified_base (167)..(167): a, c, t, g, unknown or other
  misc_feature (167)..(167): n is a, c, g, or t
  modified_base (186)..(186): a, c, t, g, unknown or other
  misc_feature (186)..(186): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagcgtggtcgttctagtnctatttagagtgtcaatgngagatagaagtggtaggagtcgtaggggatacgttggtccacggtccgggggtcctaggacgtccttcgtccgtagtacacgtccttcgtacggtacctcgtaacctggacgactaaatttgtggaactcgtccgtcggtaccgcgacggaccgttcggaaggggtagggtctagggtacggtcgggtcgaacctaaacggtaagaaacgtacaaacgggtagacgggtaacgttaagggaaaaccttcggtaagtttccgggtagtaaccttcgggttacggtaacggggtaaccgggttccgttaccaaccgttaacgtccgtaccgaacgtacgtaactacggtaccgtaaacgtaacgttaacctttagttaacgggttttaccgtttaagggttaaagtacggtaacgtttacggttacgtaacggtaacgttaaccgttaaccgggaacggttaaccgtaacggttacttaaacggtaacccgttttaagtaccccggttaggacccggtaaaggaaggtacgttactaagggtaccgttaccgtaacgggttaaggtaacgggtacgtaactagtacggtttgtacggttcg

SEQ ID NO: 25570 - DNA, 255 bp, Homo sapiens; identical to SEQ ID NO: 25490
  misc_feature: GYAE6OF02HQQME.45.34.D01.1.454.CMB.1.raw
  modified_base (253)..(255): a, c, t, g, unknown or other
  misc_feature (253)..(255): n is a, c, g, or t

SEQ ID NO: 25571 - DNA, 506 bp, Homo sapiens
  misc_feature: GYAE6OF02FYQJN.45.34.D01.1.454.CMB.1.raw
  modified_base (177)..(177): a, c, t, g, unknown or other
  misc_feature (177)..(177): n is a, c, g, or t
  modified_base (180)..(183): a, c, t, g, unknown or other
  misc_feature (180)..(183): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (191)..(193): a, c, t, g, unknown or other
  misc_feature (191)..(193): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagcggcgtgtcctaggtcgcattagagncannnntnangngnnnggantgcancgggtcngantnctgacagcntgactnactgancatntgangactggcncagcncgaggaggngngngtggngcacanaaganagagnggagtagaagaactatagtgactcgtgtaggtaggtacgtcgacatcgtacacgagacaagtacgacgaacgtaacttacgtagttacgtttaggtaagtagtacgtacgtcgtagtagtacgtacgaagacgtacgtacgtagtaatacttacgtagacgacgagagagtagtagtacgtacgtaggtagggtaggacgagtacgtacgtgttag

SEQ ID NO: 25572 - DNA, 511 bp, Homo sapiens
  misc_feature: GYAE6OF02JCDVL.45.34.D01.1.454.CMB.1.raw
  modified_base (275)..(275): a, c, t, g, unknown or other
  misc_feature (275)..(275): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccaggggganccccccaatcctagtctatggtgcttccaggttacaaagtggggtccatcaaggttcagtggcggtggtctggcacagaattcactctcaccatcagccgcctgcagcccgaagactttgctaacttattactgtactacaagtatttacaattaccctcggactattcggaccaagggaccaagcttagagtatacaaacgaactggtagctgacaccatctgtcttcattcccg

SEQ ID NO: 25573 - DNA, 517 bp, Homo sapiens
  misc_feature: GYAE6OF02JABU1.45.34.D01.1.454.CMB.1.raw
  modified_base (277)..(277): a, c, t, g, unknown or other
  misc_feature (277)..(277): n is a, c, g, or t
  modified_base (360)..(360): a, c, t, g, unknown or other
  misc_feature (360)..(360): n is a, c, g, or t
  modified_base (399)..(399): a, c, t, g, unknown or other
  misc_feature (399)..(399): n is a, c, g, or t
  modified_base (505)..(505): a, c, t, g, unknown or other
  misc_feature (505)..(505): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccggcaagtcaggatattagaaatgagttagctggtatcagcagagacgaggggacncccccaatcctagtctagtggtgcttacgaggttaacaaaggtcggggtcccagtcaaggttcaggtggcggtggtctggcanagtaatcactctcacatcagccgctgcacgccgtaagtnttttcgactaacttattactgtactaacagtattcaaacttccctggacagttcgacaaaggacctagctgaagtactaacaaacgactgtagctagaccaacctntcttactcttac

SEQ ID NO: 25574 - DNA, 510 bp, Homo sapiens
  misc_feature: GYAE6OF02HDJ3W.45.34.D01.1.454.CMB.1.raw
  modified_base (280)..(280): a, c, t, g, unknown or other
  misc_feature (280)..(280): n is a, c, g, or t
  modified_base (493)..(493): a, c, t, g, unknown or other
  misc_feature (493)..(493): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccagggggacnccccccaatcctagtctatggtgcttccaggttacaagtggggtccatcaagttcagtggcggtgggtctggcacagaattcactctcaccatcagccgcctgcagcccgaagtattttgctaaactttattactgtctacaagtatttcaatttaccctggactagttcggaccaaagggaccaagtcttgagatacaaacgtactgtcggntgacaccatctgtcttc

SEQ ID NO: 25575 - DNA, 175 bp, Homo sapiens
  misc_feature: GYAE6OF02H8X3J.45.34.D01.1.454.CMB.1.raw
  modified_base (172)..(175): a, c, t, g, unknown or other
  misc_feature (172)..(175): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagcgggctggcaaggcgcatagnnnn

SEQ ID NO: 25576 - DNA, 541 bp, Homo sapiens
  misc_feature: GYAE6OF02IEJD1.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattgggggctgagcgtgggcgttcctaggtgctattttagaaggtgtcaatgtgagatgaaagtggtggagtctgggggagacttggtccatccgggggggtccctgagactctcctgtacagcctctggactcaccttgagcaattatggatgacctgggtccgccaggctccgagggaaggggctggagtgggtggccaacataaagcaagatggagtacgaaagactatgtggactctgtgaagggtcgttcgaccatctccagagacaatgaccaagaattacagttcgttttaggtaaattaggacagtctagagataccgaagatagcccagtatattactgcgcgagagagtgtatagtacctaagtaggggtagagacgattcgtggtttacgg

SEQ ID NO: 25577 - DNA, 558 bp, Homo sapiens
  misc_feature: GYAE6OF02GV15O.45.34.D01.1.454.CMB.1.raw
tcagacgcgatcgacacgaccggtgctcgatttagatcgtctgtgttgggtttgggggagacttggtccatccggggggtccctgagactctcctgtacagcctctggactcaccttgagcaattattggatgacctgggtccgccaggctccagggaaggggctggagtgggtggccaacataaagcaagatgggagtcgaaagaactatgtggactctgtgaagggtcgttcaccatctccagagacaatgccaagaattcagtcttttggaaatggacagtctgagatccgaagatacggcagtatattactgcgcgagagatgatagtcctaagtgggggtagagacatctggtttgatgctttcgatgtgtgggccacgggacacggtcaccgtctcttcagcctcaccgaacgggcccagtccggtcttcccccgtggcccgccctgcctccgagggacgccaccgtccgagcgccacgacgccggccctggggcctcggcccgtggtccaagggtacctaccgtttcctcggattccggcgttctgacggg

SEQ ID NO: 25578 - DNA, 532 bp, Homo sapiens
  misc_feature: GYAE6OF02H7HFA.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtctgggggagacttggtccatccgggggggtccctgagactctcctgtacagcctctggactcaccttgagcaattattggatgacctgggtccgccaggctccgagggaggggctggagtgggtggccaacataaagcaaagatgggagtacgaaagaactatgtggactctgtgaagggtcggttcaccatctccagagacaatgaccaagaattcagttcttttaggaaattggactagtctgagataccgaagatacggcagtatattactgcgacgagagatgatagtacctaagtggggtagagacatcgtggttag

SEQ ID NO: 25579 - DNA, 570 bp, Homo sapiens
  misc_feature: GYAE6OF02IBFJO.45.34.D01.1.454.CMB.1.raw
  modified_base (226)..(226): a, c, t, g, unknown or other
  misc_feature (226)..(226): n is a, c, g, or t
  modified_base (279)..(279): a, c, t, g, unknown or other
  misc_feature (279)..(279): n is a, c, g, or t
  modified_base (404)..(404): a, c, t, g, unknown or other
  misc_feature (404)..(404): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggnaagtcaggatattagaaatgagttaggctggtatcagcagagaccaggggacnccccccaatcctagtctatggtgcttccaggttacaaaggtcggggtccatcaaggttcagtggcggtgggtctggcacagtaattcactctcacctatccgacgcccgctgcagcccgaaagtnttttgacctaactttattactcgttctaacaagtactttcaaactttccctaggtactagttccggaccgtaaagggtaccctaagtcctttaggaacgtacgtaacaaaccggtactcggttacggaccgttacgacctaccgtacgtcttacggtcctttaccg

SEQ ID NO: 25580 - DNA, 256 bp, Homo sapiens
  misc_feature: GYAE6OF02FV8KW.45.34.D01.1.454.CMB.1.raw
  modified_base (253)..(256): a, c, t, g, unknown or other
  misc_feature (253)..(256): n is a, c, g, or t
tcagacgcgatcgacacgaccggtgctcgatttagatcgtctgtggtgggtctggcacagaattcactctcaccatcagccgcctgcagcccgaagattttgcaacttattactgtctacaagatttcaattaccctcggacattcggccaagggaccaagcttgagatcaaacgaactgtggctgcaccatctgtcttcatcttcccgccatctgatcgatcgcgtctgagcgggctggcaaggcgcatagnnnn

SEQ ID NO: 25581 - DNA, 574 bp, Homo sapiens
  misc_feature: GYAE6OF02I6KOE.45.34.D01.1.454.CMB.1.raw
  modified_base (201)..(201): a, c, t, g, unknown or other
  misc_feature (201)..(201): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccggcagtcagagtattagtactggtggcctggtatcagcaagaaaccagggaaacgcccctaagcctcctgctctataaggctatctagttagaagtcgggtaccagtcaaggttcagcggctaggtggatcgtgggacagtaacttcactcacacactcagcacgtcctgcagtcctagtattgtatttagaccttaaactttacttacgtcgacctaacgtagtagttagtaagtttagttaacgttcggtaacggttcgaaccggaagggtaaccgtaaggtacggaaactaccgaaaacggtaacgtaggttacggtaccgttacgaccgtaaccctacgttccttacg

SEQ ID NO: 25582 - DNA, 521 bp, Homo sapiens
  misc_feature: GYAE6OF02G2Y6E.45.34.D01.1.454.CMB.1.raw
  modified_base (278)..(278): a, c, t, g, unknown or other
  misc_feature (278)..(278): n is a, c, g, or t
  modified_base (427)..(427): a, c, t, g, unknown or other
  misc_feature (427)..(427): n is a, c, g, or t
tcagacgcgatcgacacgaccggtgctcgatttagatcgtctgtgttgggtttggggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatatagaaatgagttaggctggtatcagcagagaccgagggggaccncccccaatcctagtctagtggtcgcttccgaggttacaaaggtcgggtcccatcgaaggttcagtggcggtgggtctggcacagaattcactctcacatcagcccgctgcagcctgatgtattttcgactaatttattactgacctaangttatgattagttatccgtacgttcgacgaaggaaccgaggtagaatacgaaacgtactgaggctcgccaacgtctcgtatcgttcacttcccg

SEQ ID NO: 25583 - DNA, 630 bp, Homo sapiens
  misc_feature: GYAE6OF02GXVIO.45.34.D01.1.454.CMB.1.raw
  modified_base (186)..(186): a, c, t, g, unknown or other
  misc_feature (186)..(186): n is a, c, g, or t
  modified_base (207)..(207): a, c, t, g, unknown or other
  misc_feature (207)..(207): n is a, c, g, or t
  modified_base (267)..(267): a, c, t, g, unknown or other
  misc_feature (267)..(267): n is a, c, g, or t
  modified_base (273)..(274): a, c, t, g, unknown or other
  misc_feature (273)..(274): n is a, c, g, or t
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
  modified_base (357)..(357): a, c, t, g, unknown or other
  misc_feature (357)..(357): n is a, c, g, or t
  modified_base (480)..(480): a, c, t, g, unknown or other
  misc_feature (480)..(480): n is a, c, g, or t
tcagacgcgatcgacacgaccggtgctcgatttagatcgtctgtgttgggtttgggggtcgaggagtcagacccactcaggacacagcatggacatgagggtccccgctcagctcctggggctcctgctgctctggcctcccaggtgccagatgtgcctatccagatgaacccagtctccattccncctgtcctgacatctgtaggngtacagtacttaccataacgttcgccgggacaagtcaggtatagttagaaatgagttagntggtannagnagagacgagggacncccccaatcagtcagtgtagcttcgagtacaaggtggaccatcaagttcaggtggacggtgttcgnggcaacgagtaaacttccgtaactcgtaccaacctataccgacgtaccccgtctcggtaccaccgggtaacccggtaattagttttacgacctaaaaccttttgttaacctggtaaccttaanaacgttactttacaaaccgttttcccacgtaactactttaccgggaaccgtaaagggaacctaaggtcgtttaccgaaggtacctaaacgtaaacgtaccgttaacgttggacctacggactaaacccgtattcccgttagtaccttacg

SEQ ID NO: 25584 - DNA, 561 bp, Homo sapiens
  misc_feature: GYAE6OF02G7IH8.45.34.D01.1.454.CMB.1.raw
  modified_base (226)..(226): a, c, t, g, unknown or other
  misc_feature (226)..(226): n is a, c, g, or t
  modified_base (283)..(283): a, c, t, g, unknown or other
  misc_feature (283)..(283): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggnaagtcaggatattagaaatgagttaggctggtatcagcagacgaccgagggggaccnccccccaactcctagtctatggtgcttcgaggttacaaggtcggggtaccatcaaggttcaggtgggcggtggtcgtggcagagtattcactctcacatcacgccgcctgcacgcccgaagtacttttcgacttaactttattactgttactactaagtatttacctaactttacccgtacggactacgttaccgggaccgaaacgggaacctaagtcttagaagtactacgaaacgtacgtgacggtctacgacctacctagttcctagttccttac

SEQ ID NO: 25585 - DNA, 751 bp, Homo sapiens
  misc_feature: GYAE6OF02IT0R7.45.34.D01.1.454.CMB.1.raw
  modified_base (231)..(231): a, c, t, g, unknown or other
  misc_feature (231)..(231): n is a, c, g, or t
  modified_base (264)..(264): a, c, t, g, unknown or other
  misc_feature (264)..(264): n is a, c, g, or t
tcagacgcgatcgacacgaccggtgctcgatttagatcgtctgtggtttggggtttgggggcaggagtcacgaccccactcgaggacacagcagtggacatggacgggtcccccgctcagcctccgtggggcctcctgctgctcgtggcctcccgaggtcgccagtatgtcgcctactccagatcgaccctagtcctcctattcctccctgtctgctatcgtaggtagganacagtacgttaacctaattaacgtcggccgganaagtcgaggtatattaagaagtggtaagttaggctaggtatacgagacgaaggacggaccggaacgggggaccccacccccctaacgttccgttagtaccttagttcggtcgtcccgttacgtaacggtttaacgaaacgggttccggggtaccctagtacgtaacggttcgagggttcgggtacggggtcggttcgtacggactaacgaagtacttcctacgttcctacctaaccacgtaccgaccgcccgtccgtacgaccgtaccggaacccgttaagtttcgtttacgaacctttaacgttttacttaccgtagttacctaactaacgtttctttaaaccgtaaccgtttacccgtacggttaacctacgttacccggaacggtaaacggaacctaacgttccgttagaacgtaacgtaacgaaccggtaagttcggtacgtacgtaccaccgtaaccttagttaccgttcgttacccttacc

SEQ ID NO: 25586 - DNA, 537 bp, Homo sapiens
  misc_feature: GYAE6OF02IA0EZ.45.34.D01.1.454.CMB.1.raw
  modified_base (520)..(520): a, c, t, g, unknown or other
  misc_feature (520)..(520): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtctgggggagacttggtccagtccgggggggtccctgagactctcctgtacagcctctggactcaccttgagcaattattggatgacctgggtccgccaggctccgagggaaggggctgggagtgggtggccaacataaagcaagatgggagtcgaaagaactatgtggactctgtgaagggtcggttcaccatctaccagagacaatgaccaagaattcagttcttttaggaaatggacagtctagagtataccgaagagtacggcagttatattactgctcgagagatagatagtacctagtggggtanagactatcgtggttacg

SEQ ID NO: 25587 - DNA, 1032 bp, Homo sapiens
  misc_feature: GYAE6OF02JXXXA.45.34.D01.1.454.CMB.1.raw
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctcctgtctgcatctgtaggagacgagagttaccaagttaaaaccgtttcggacccgggggtacaaaacggtttccgaaaggggtaactttaaagtttaaaggtaaaaagttggtaaaggtttaacggggtcgttacggggttaacttaccgaaggtacctaagggtaacgggtaaccccgtaacggggggggggaaccgtaccccccccccgtaaaacgttacccccgttaaggttacctttaaacgttcggggtttacggtacccgttttaccccgtaaacggggtttttaaaccgtaaaaacggggtttccgggggggttaacccctaaggtttaacccgtaaaacggggttttacccgtaaacgggggtttcgggggttaccgggggtttacggggggtttacccgttacgggggaccctaaaccggtaaacggtaaaacgtttttaccgaaacccgtttacccgttaccgtaaaccccgtaacgtttacccgaaaccgggtccccgtaaccccgtttacgggacccgtaaacgggtaaccccccgggttaaaaggttaaccgtttttttacggaacccgttaaaaccgttttaaccgttttaaaccgttggtttaaccctttaaaccgtaaacggttaaacttttttaccgaaaacgttttaacccccgtttaccgggtaaaccttaacgttttacccggggaacccgtaaaacggggtaacccctaaaggtcccgttttaggaacggtaaccgttaacccgtaaaaccgtaaaccggttaccggttacgggtaccttaccgggtaccaaaccccggttattacccgttacggtttaccttttaacccg

SEQ ID NO: 25588 - DNA, 557 bp, Homo sapiens
  misc_feature: GYAE6OF02HLAPE.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattgggggctgagcgtgggctttcctgttgctattttagaggtgtccaatgtgagatgaaagtggtggagtctgggggagacttggtccagtccgggggggtccctgagactctcctgtacagcctctggactcaccttgagcaattattggatgacctgggtccgccaggctccgagggaggggctgggagtgggtggccaacagtaaagcaagatgggagtcgaaagactagtgtggactctgtgtaagggtcggttacactatctccagagacaatgacaagattcagttacttttaggaaatggaacagtctagagactacgaagagtacggtcaagttataacttacgtgcgagagaggtataggataggttacctaaggttcggggtaagagacgtagttcgttagttacgg

SEQ ID NO: 25589 - DNA, 648 bp, Homo sapiens
  misc_feature: GYAE6OF02HPV55.45.34.D01.1.454.CMB.1.raw
  modified_base (355)..(355): a, c, t, g, unknown or other
  misc_feature (355)..(355): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccggggggtccctgagactctcctgtacacgcctctggacctcaccttgagttaattattagatgaccgtgggtccgccaggcctccgaggggaacggggctggaggtgggtcggaccaaanaataaagacaagagtgggagtacgaaagactagtgtgactcgtgtagaagggtcggttacacctatctacgagaacgaactaagtcgaccgtaaagtaacttacgtacggttttacgtttttaaggaaagttagggaactacgttgtagaagtaacgtaccggaaagtaacgtacggactaagttaattaagttaacgcgacgtacgagagtagtagaagttacggttaccgttaagggtaggggggttaacgaacggtaaccgtagtttaccggtttaggtttaggtaacgg

SEQ ID NO: 25590 - DNA, 600 bp, Homo sapiens
  misc_feature: GYAE6OF02HQRW5.45.34.D01.1.454.CMB.1.raw
  modified_base (343)..(343): a, c, t, g, unknown or other
  misc_feature (343)..(343): n is a, c, g, or t
  modified_base (573)..(573): a, c, t, g, unknown or other
  misc_feature (573)..(573): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccgggggggtccctgagactctcctgtacagcctctggactcaccttgagcaattattggatgacctgggtccgcaggctccgaggggagggctggagtgggtggaccaanataaagcaagagtgggagtacgaaagaactagtggtaggactcgtgtaggtaagggtcggttacacctatctaccagagacaagtcgaaccaagaacttctagtttacgttttaggaaatggtactagttcagagactaccggaaagtacgtaacggacgtaagttaattagttacgtgacgacgaagagtaactaggtaatacggttaccgtaaagggttgggggtaanaacggtactagttcggttagggtttag

SEQ ID NO: 25591 - DNA, 544 bp, Homo sapiens
  misc_feature: GYAE6OF02IE73R.45.34.D01.1.454.CMB.1.raw
  modified_base (340)..(340): a, c, t, g, unknown or other
  misc_feature (340)..(340): n is a, c, g, or t
  modified_base (398)..(398): a, c, t, g, unknown or other
  misc_feature (398)..(398): n is a, c, g, or t
tcagacgcgatcgacacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttggccgggccagtcagagtattagtaactggttgcctggtatcagacagaaaccgagggaaacgcccctaagctcctgctctataaggcatctagttagaagtgggtaccagtcaaggtcagcggnagtggatcgtggacagaatcactcacacatcagcacgcctagcacgcctagattagtnttttcgacttagtttacttcgtgtacagcacggtccgttccgcccgaccgtcctccgtaccgtacggtttccggggccgggggtaccgtagggtaggaggtaacgtggaacgacgtaacgtggtacgccgtcgacctacgtatccg

SEQ ID NO: 25592 - DNA, 575 bp, Homo sapiens
  misc_feature: GYAE6OF02FJT5Q.45.34.D01.1.454.CMB.1.raw
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccggggggggtccctggagactctcctgtacagcctctggactcaccttgagcaattattggatgacctgggtccgccaggctccgagggaaggggcgtgggagtggggtggccaacagtaaagcaaagagtgggagtacggaaaagaactagtggtggactctggtaggaaggggtcgttcaccatcctccagagacaatcgaccaaagaattcagtttcgtttttaggaaagttggaacagttctgagagtaccgaagacgtacggctaagttatattacgtgcgacgagagatagaagtacgtacgtaaggtggggtagagactagttacgttggttag

SEQ ID NO: 25593 - DNA, 663 bp, Homo sapiens
  misc_feature: GYAE6OF02JTDNP.45.34.D01.1.454.CMB.1.raw
  modified_base (227)..(227): a, c, t, g, unknown or other
  misc_feature (227)..(227): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtaggagacagacgttaccataactgccgganaagtcaggatattagaatgtagtagctggtatcgagacagagaccgaggggaccaccccctaactctacgtctagtggtcgtccttaccgaggttaacgaaggtcgggtacccagtctaaggttcaggtggacggtgggtctcgggacacgtagtaacttcactctacacctataccgacgtccctccgtgaccgaaccgacccgggtaaagttcgttttacggaccttaaaccgttttactttaaccgttggttaaccctaaacgtaaagttaccttttaaaccaccgttttaaccccggttagtaccgtaacgtttacccggaaccggtaaaccggtaccgtaacgttcgttaggaactaaccggtaaccaaaacggttacgttaggttaccggctttagaccctaaccagtttcccttagtttaccctaaccg

SEQ ID NO: 25594 - DNA, 570 bp, Homo sapiens
  misc_feature: GYAE6OF02FIJPY.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtctgggggagacttggtccagtcccgggggggtccctgagactctcctgtacagcctctggactcaccttgagcaattattggatgacctgggtccgccaggctccaggggaagggctgggagtggggtgccaacataaagcaagatgggagtacggaaagaactatggtaggactcgtgtggaagggtcggttacaccgatctccagacgaacaatcgaccaagtaacttacgaagtttccgtttttaggaaattggaactagtctgagagtccgaagtagtacggctaagttaatagttactgcgtacgaggagatgactagtcctaaggttggggataggaactagtcgttggtttag

SEQ ID NO: 25595 - DNA, 709 bp, Homo sapiens
  misc_feature: GYAE6OF02JFCZI.45.34.D01.1.454.CMB.1.raw
  modified_base (488)..(488): a, c, t, g, unknown or other
  misc_feature (488)..(488): n is a, c, g, or t
  modified_base (607)..(607): a, c, t, g, unknown or other
  misc_feature (607)..(607): n is a, c, g, or t
  modified_base (683)..(683): a, c, t, g, unknown or other
  misc_feature (683)..(683): n is a, c, g, or t
tcagacgcgatcgacacgaccggtgctcgatttagatcgtctgtgttgggtttgggggtctcagagaggagccttagccctggactccaaggcctttccacttggtgaccagcactggagcacagagactcacagtggaagttgggctgagcgtgggtctttccttgttgcttatttagaaggtgtacaatgtgagatagaaagtggtggagtcggtggggagtacgttcggtaccgtacgggtcccgggggggttccctaggacgtaccttccgtccgtacgtaacacgtcccttcgtcggtacctcctaccgtttgagtactaaatttgttaggtattcggaccgttcggggtacccgccgacggccttcccggaaggggaacggggccttaggggacgggttgggggtcggaccctaaacgaagtaaacgacaaaggaggtagggaacgtaacggaaaataacgttagtggtacggtaacttcgnggttaagggaacggggtttcggttaccacctagtccgtaccgaaggaacgtaacaagtcggaaccaaaggtaacttccgtagtttacgttttaagaacgttagacgtagtctagagtanaccgtaagagtacggatagttatacgttacgcgcgagagagtagtagaagtacggtaacgttagggtaggggtaanaacgtagtacgtcggttagtttacgg

SEQ ID NO: 25596 - DNA, 541 bp, Homo sapiens
  misc_feature: GYAE6OF02IH6RQ.45.34.D01.1.454.CMB.1.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
  modified_base (413)..(413): a, c, t, g, unknown or other
  misc_feature (413)..(413): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttacataacttgccggnaagtcaggatattagaaatgagttaggctggtatcagcagagaccgaggggcaccccccatcctagctatgtncttcagtanaagtgggccatcagttcagtggcggtgtcgtgacanagattcactctcacatcacgccgctgcacgccgtaagtcttttgacttaactttattactcgaccctaaanagttatatagttaagtttacgttaccgtacggtttcggaacccggaaagggacctaagggtaggaactacgaaaccgtacgtcgtagggtctacgaccacgactttcgtcgtttcttccacttccccg

SEQ ID NO: 25597 - DNA, 542 bp, Homo sapiens
  misc_feature: GYAE6OF02GOF62.45.34.D01.1.454.CMB.1.raw
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtctgggggagacttggtccagtccgggggggtccctgagactctcctgtacagcctctggactcaccttgagcaattattggatgacctgggtccgccaggctccgaggggaaggggctgggagtggggtggaccaacataaagcaagagtgggagtcgaaagactatatggactctgtgaagggtcgtcaccatctcagagacaatcgacaagaattcagtcttttaggaattaggacagtctggagtactaccggaagagtacggacagttatagttactgacgacgagagatgatagtactagtggggtagagacgtattcgtggttag

SEQ ID NO: 25598 - DNA, 657 bp, Homo sapiens
  misc_feature: GYAE6OF02FGMVW.45.34.D01.1.454.CMB.1.raw
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
tcagacgcgatcgacacgaccggtgctcgatttagatcgtctgtgttgggtttgggggcaggagtcagacccactcaggacacagcatggacatgagggtccccgttcagctcctgggctcctgctgctctggctcccaggtgccagatgtgccatccagatgacccagtctccattcnccctgtctgcatctgtagganacagagttaccattactgccggnaagtcaggatattagaatgagttaggctggtatcgagcagagaccggaggggaccaccccctaactcctagttctatggtcgtaccttaccgaggttaacaaaggtcggggtaccctatacgtaaggttcgtaggttcgggacgggttgggtactcgggacacgtaacgtaaacgtttcaccgttcctaccacctacgtccgacgcccgtccgtacgaccgaccgtaacccgtaagttactttacggaaccttaactttacttaccttgtaccttaacgtaacgttacctttaacgtaaaccttacccgtacgtactaacgttaccggaccgtaaacggacccgtaagtcgttagacgtacgtaaccgtaaacgcgttaggttaccgacgtcggacctaccgtaacgttccttacgttaccttaccgttacccg

SEQ ID NO: 25599 - DNA, 550 bp, Homo sapiens
  misc_feature: GYAE6OF02G2INQ.45.34.D01.1.454.CMB.1.raw
  modified_base (346)..(346): a, c, t, g, unknown or other
  misc_feature (346)..(346): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtcccggggggggtccctgagactctcctgtacagcctctggactcaccttgagcaattattggatgacctgggtccgccaggctccagggaagggctggagtggggtggccaanataaagcaagagtgggagtacgaaagaactatgtggactctgtgagggtcgttcacatctccagagacaatgaccaagaacttcagttcgttttaggaaattggacagtctagatacgtaccgaagtagtacggactagtaatacgttactgcgcgagagtagtgatagtcctaaggtggggtagagacgtattcgttggttag

SEQ ID NO: 25600 - DNA, 580 bp, Homo sapiens
  misc_feature: GYAE6OF02GQK6F.45.34.D01.1.454.CMB.1.raw
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (505)..(505): a, c, t, g, unknown or other
  misc_feature (505)..(505): n is a, c, g, or t
  modified_base (554)..(554): a, c, t, g, unknown or other
  misc_feature (554)..(554): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggattcgtggggggagacttggtccagtccgggggggtcctgagactctctgtacagcctntggactcaccttgagcaatttatggatgacctgggtccnccaggctccgaggggagggctgggagtgggtgaccaanataaagnaagagtggagtacgaaaagactagtggtggactcgtggtaggtaagggtcggttacaccgtatcgtaccgagagaacaagtcgaccaaagtacttcgagttcttttaggaaattggaactgtctgagctacggagagtacgatagtatagttacngaccgacgagaacgagagtaatacggttaccttaagggtacgggggtanaacggatacgttcgttagggttacgg

SEQ ID NO: 25601 - DNA, 575 bp, Homo sapiens
  misc_feature: GYAE6OF02F62CT.45.34.D01.1.454.CMB.1.raw
tcagacgcgatcgacacgaccggtgctcgatttagatcgtctgtgttgggtttgggggaggcttggtccagcctggggggtccccgagactctcctgtgcagcctctggattcagcctcagtagttattggatgagctgggtccgccaggctccagggaagggctgcagtgggtggccaacataaagccagatgtaagtgaaatatactatgtggactctgtgaggggccattcaccatctccagagacaacgccaagaactcactgtctctgcaaatgaacagcctgacatccgaggacacggctgtgtattactgtgtgagagagtggggagagggcgggtggctagttttgactacgtggggccaggggaaccctggtaccaccgtctcctcacgcctccaccgaacggcccacgtccggtcccttcccccgtggcccgccctcgcctccgaggcgccaccgtccgagcgcgacacgccgcccgtgggcctcggccgttggtaccgaacgggtaccttaccgttcccgtcgaccgttccggcgttccgtacggacggtccgggtcgtacggg

SEQ ID NO: 25602 - DNA, 564 bp, Homo sapiens
  misc_feature: GYAE6OF02HHHFF.45.34.D01.1.454.CMB.1.raw
  modified_base (551)..(551): a, c, t, g, unknown or other
  misc_feature (551)..(551): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtcccggggggggtccctgagactctcctgtacagcctctggactcaccttgagcaattattggatgacctgggtccgccaggctccaggggaaggggctgggagtgggtggccaacgataaagcaaagatagggagtacgaaaagactatggtggactctgtggaagggtcggtcactatctccagaagacaatgaccaaagaacttcgtaagttcgtttttaggaaattggaactagtctagagtagtaccgaagactacggcaagtaagtattacgtgacggacgagagatagatagtacctaagtggggtagagtanagttgtaggttag

SEQ ID NO: 25603 - DNA, 627 bp, Homo sapiens
  misc_feature: GYAE6OF02G7JNP.45.34.D01.1.454.CMB.1.raw
  modified_base (145)..(145): a, c, t, g, unknown or other
  misc_feature (145)..(145): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
  modified_base (462)..(462): a, c, t, g, unknown or other
  misc_feature (462)..(462): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattattggatgacctgggtccnccaggctccaggggaagggctggagtgggtgccaacataaaagcaagagtgggagtacgaaaagaactatgtaggactctggtgaagggtcgttacaccatctccagagacaatgaccaaagaattcagttctttttaggaaatggacagtctgagatccgaagatacggcagtatattactgcgcgagagatgaatgtacctaagtggggtagagacatctaggttgatgctttcgattgtgtgggcaacgggacaacggtcaccgtntctacngccctccaacgacggcccagttccggttacctttcccccggnggcccgacccctgtcctaccgaggacgaccacccgttaccgaagaccgcgaaccgacgcccgggtcccgagggccttacggcccgttgggtaaccgaaacggtacccgtttaaccctttcccggttacccggaacgttcccggacgtttcccgaggtacccgggg

SEQ ID NO: 25604 - DNA, 672 bp, Homo sapiens
  misc_feature: GYAE6OF02IIJYD.45.34.D01.1.454.CMB.1.raw
  modified_base (220)..(220): a, c, t, g, unknown or other
  misc_feature (220)..(220): n is a, c, g, or t
  modified_base (366)..(366): a, c, t, g, unknown or other
  misc_feature (366)..(366): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtggggganacttggtccagtcccgggggggtccctgagactctcctgtacagcctctggactcaccttgagcaattattggatgacctgggtccgccaggctccgaggggaacgggcgtggaggtgggtaggcccaacgaagtaaacgcaaagngtgggagtacgaaaagtaactagtgtagactcgtagtagtaacggggttcggttaccaccgtacgttcctccgaagacggaactaaactcggaaccctaaaggtaactttacgtacggttttacgtttttaagggaaacttacgggacctaagttcgtaggaggtaaccgttaccggaaggtaaccgtaacggtcgtaaggtttaataacgtttacgtgacgtacggaggtacgtagtacggtagttaacgttaccgttaaaggtgggggtaacgtaggtacccgaagtttccgttaggtttacgg

SEQ ID NO: 25605 - DNA, 576 bp, Homo sapiens
  misc_feature: GYAE6OF02HSWIJ.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccgggggggtccctggagactctcctgtacagcctctggactcaccttgagcaattattggatgacctgggtccgccaggctccgaggggaaggggctgggagtggggtggaccaagaataaagcaagatgggagtacgaaaagactatggtgactctgtagaagggtcgttacaccatcaccgagagacaatcgacaagacttacagtttacgttttagaaattggactagtctagaagtacgtaccgaagtatacggctaagttatattacgtgacgacgagagtaacgtgaagtacgtacgttaaggtgggggtacgagacgtaagttcgttagggttacg

SEQ ID NO: 25606 - DNA, 654 bp, Homo sapiens
  misc_feature: GYAE6OF02JJ263.45.34.D01.1.454.CMB.1.raw
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
tcagacgcgatcgacacgaccggtgctcgatttagatcgtctgtgttgggtttgggggcaggagtcagacccactcaggacacagcatggacatgagggtccccgctcagctccgtggggctcctgctgctctggcctcccgaggtgccagatgtcgccatccagatcgacccagtcctccattctccctgtctagctatctgagacgacagtacttaccatacgtgccgganagtcagatatagaatgtagtagctggtancagcagagaccgaggggaccncccccgatcgngtaccttagtcggtntccttacgtaacggttacgaaaggttcgggtaccctagtccgaaggttcaggtcgggtggtacggtgacgngtaacagtaaccttcgactcgtaaccnctataccgacgtcccgtccgtcgaccgtacggacccgtaagttaccgtttacggaaccttaacgttaacttaccttacgtacttaactaacggtttaacttaaccgttaaccttaacccgtagtaacccgttacgttaccgaaccggtaccggtaacgtaccgttacgtacggtaataaccgtaaccgaaacgtaaccgttacggtaccgtcgtacgacctaccgtactcgttccgttaccttaccg

SEQ ID NO: 25607 - DNA, 646 bp, Homo sapiens
  misc_feature: GYAE6OF02HZFEM.45.34.D01.1.454.CMB.1.raw
  modified_base (509)..(509): a, c, t, g, unknown or other
  misc_feature (509)..(509): n is a, c, g, or t
  modified_base (553)..(553): a, c, t, g, unknown or other
  misc_feature (553)..(553): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagcgtggctttccttgttgctatttagaggtgtcaatgtgagatgaagtggtggagtcgtggggagactttgccagtccggggggtcctggagactctctgtacagcctctggactcaccttgagtcaattattggatgacctgggtccgcaggctccgaggggaaggggcctggaggtgggtggccaacgataaacgcaagagtaggagtacgaaaagaactagtaggtaggacttcgtggttaggtaaaggggtcggttacaaccgtacttccgtacccaaggtaacgtaacaacgtagacctaaagtacttacgtaagtttaccgtttttaaggaattgggtaaccgtagtctaggngtaactaccggaagtaagtacggacgtagttaactagttaacgngaccgtggaacgtagacgttaagaagttacgtaacccgttaaggttacgggggtaacggtaacgaacgttacgttaccgtttagggtttaagg

SEQ ID NO: 25608 - DNA, 507 bp, Homo sapiens
  misc_feature: GYAE6OF02HK8JC.45.34.D01.1.454.CMB.1.raw
  modified_base (154)..(154): a, c, t, g, unknown or other
  misc_feature (154)..(154): n is a, c, g, or t
  modified_base (206)..(206): a, c, t, g, unknown or other
  misc_feature (206)..(206): n is a, c, g, or t
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattgggctgagcgnggtgtcctaggtgctattagagtgcatgtgagatgaagtgtgagtgtggganttgcagtccgggggtccagagctntcctgtacagccttgtcgactcaccttagnactaattattgatagctggcacgtgcncgaggaggngngngngngacanagagagagagngagagaagatagtagtagactagtagtagtagtacgtacacgactacacgaganananacgacgaagtatatagttagttagtagtagagtagtatagagtagtacgtagagagactagtagtagtagtacgacgagagagtagtagtagtacgtagtaagtaggtaggagtagtagttagtagtag

SEQ ID NO: 25609 - DNA, 580 bp, Homo sapiens
  misc_feature: GYAE6OF02JDVO4.45.34.D01.1.454.CMB.1.raw
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (467)..(467): a, c, t, g, unknown or other
  misc_feature (467)..(467): n is a, c, g, or t
  modified_base (484)..(484): a, c, t, g, unknown or other
  misc_feature (484)..(484): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattattggatgacctgggtccgccaggctccgagggaaggggctggagtgggtggccaaacataaagcaagatgggatcgaaaagaactatgtggactctggtgaagggtcgttcaccatctccagagacaatgaccaagaattcagttctttttggaaatggacagtctganatccgaagatacggcaggttaactattactgcgcgagagatgatagtctaagtggggtanagacatcgtggtttnagtgtctttcgatgtgtggggccacgggacaacggtcaccgtctcttcacgtccctccgaccaacgggcccagtccggttccttccccgtggcccnccctgcctccgaggacnccacctcgaagtacgcacacggccgtccgtggcctggcccttggtaccgaacggtacttacttcccgtacgacttccggcgtccgtaggtaccggg

SEQ ID NO: 25610 - DNA, 588 bp, Homo sapiens
  misc_feature: GYAE6OF02ITUTY.45.34.D01.1.454.CMB.1.raw
  modified_base (334)..(334): a, c, t, g, unknown or other
  misc_feature (334)..(334): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgttgctatttagaaggtgtccaatgtgagatagaaagtggtggagtcgtgggggagacttggtccaggtccggggggtcctggagtattctcctgtacagcctctggactcaccttgagcaattattggatgaccgtgggtccgcgaggcctcgaggggagggcgtggnggtgggtgaccaaacagtaaagcgaagagtggagtacggaaagaactagtgtaggactcgtggtagtaaggggtcgttacaccgatcaccgagagaacaagtcaccaagtacttcgagtttcttttaaggaatcggaactgtcgtagatacgtacgaagacgtacggacagttaactattaacgcggagcgagtagtactagaattcggaacgtaaggttcgggggtaacaggaacttagttccgttaggttag

SEQ ID NO: 25611 - DNA, 552 bp, Homo sapiens
  misc_feature: GYAE6OF02ISAI1.45.34.D01.1.454.CMB.1.raw
  modified_base (343)..(343): a, c, t, g, unknown or other
  misc_feature (343)..(343): n is a, c, g, or t
  modified_base (497)..(497): a, c, t, g, unknown or other
  misc_feature (497)..(497): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggcttccttgttgctattttagaaggtgtccaatgtgagatgaaagtggtggagtctgggggagacttggtccagtcccgggggggtccctgagactctcctgtacagcctctggactcaccttgagcaattatggatgacctgggtccgccaggctccgaggggaaggggctgggagtgggtgccaanataaagcaagagtgggagtacgaaaagactatgtggactctgtgaagggtcggtcacctatctccagagacaatcgacaagaattacagttcgtttttaggaattggactagtctgagataccgaagagtacggactaagttaatagttaacgngcggcgagagagtcgatacgtccgtaaggtggggtagtagacgagttcgtggttg

SEQ ID NO: 25612 - DNA, 713 bp, Homo sapiens
  misc_feature: GYAE6OF02IVUGU.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagtacgttggtccgaggtcccgggggggtccctggacggtactcctccgtgtacacgcctcgtggactccaccttgagtctaattattggatgaccgtcgggtcccgccgaggcctccggaaggggacgggtcgtgggtaggtcggggtacggaccgaaacgaagtaaacgacgaaaggacgtagggaagtacggaaaagtaacgtagtagtacggactcgtaggtaggtaagggttccgtactaccgtagtctacgagaagacctaagacgtacctaaagtaaacttctaacggtttacgttttaaggaaattcggtaaacgtacgttacgtaaggaacgttaacgtaccggtaaagacgttaacgggactaacggtttaagttaaccttacggtacgtacgacgtaaggtaacggtaacggtagtaacgttaacggtaaccggttaaagggttagggggtaactagtaacgttaacgttcggttaggtttagg

SEQ ID NO: 25613 - DNA, 572 bp, Homo sapiens
  misc_feature: GYAE6OF02J1NUH.45.34.D01.1.454.CMB.1.raw
  modified_base (159)..(159): a, c, t, g, unknown or other
  misc_feature (159)..(159): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
  modified_base (458)..(458): a, c, t, g, unknown or other
  misc_feature (458)..(458): n is a, c, g, or t
tcagacgcgatcgacacgaccggtgctcgatttagatcgtctgtgttgggtttgggggtcgtcagagaggagccttagccctggactccaaggccgtttccacttggtgaccagcactgagcacagaggactcacatggaattggggctgagcgtgggngttcctggtcgctattttagaggtgtccaatgtgagatgaaagtggtgagtctggggagacttggtccatccggggggtccctgagacgtctcctgtacagcctctggactcacttgagcattagtggattgactcggtcgccaggcctcgagggagggctggaggtcgggtgccgaactagtaagcgagagtggagtaccgaaaggactagtgtacggactcgtggagaggtcggtacacggatctcagngacatgactaagatanacttgtttacgagttagacgtacgtcttaggngtagtacgtagcgtaacggctaacgtataaccttagtacgtcggtacgaaggtcgtagtagaattcggtaaccgtaagttgggggtaactaggacctagttacgttggtttacg

SEQ ID NO: 25614 - DNA, 691 bp, Homo sapiens
  misc_feature: GYAE6OF02GYPNT.45.34.D01.1.454.CMB.1.raw
  modified_base (268)..(268): a, c, t, g, unknown or other
  misc_feature (268)..(268): n is a, c, g, or t
tcagacgcgatcgacacgaccggtgctcgatttagatcgtctgtgttggggtttggggggtctcagagaggagccttagccctggactccaaggcctttccacttggtgaccagcactgagcacagaggactcaccatggaattggggctggagctgggctttccttgttgctattttagaaggtgtccaatgtgagatgaaagtggtggagtcgtgggggagacgttggtccagtcccgggggggtccctgacgactctcctgtacngcctctggactcaccttgagcaattatggatgacctggtccgcaggctcgagggagggctggaggtgggtgccaagataaaggcaagagtagggagtacggaaagaactagtggtaggactcgtggtaggaaggggttcggttaccaaccctagtaccgtaccgaaggaacgaacaaagtcgaaccgtaaaggtaacttaccgtaaggtttacgtttttaacgggaaacgttagggtaaccgtacggtcctagggtaagtaacgttacccggaaaggtaacgtaaccgggtacgtaaagttaagttaacgtttaacgtcggtaccggtaccggaaggtaacggtaagtaggtaagttaaccggttaaccgttaaggtagggggggtaacgtacggtaacgtagttaccggttagggtttacgg

SEQ ID NO: 25615 - DNA, 552 bp, Homo sapiens
  misc_feature: GYAE6OF02I43GB.45.34.D01.1.454.CMB.1.raw
  modified_base (438)..(438): a, c, t, g, unknown or other
  misc_feature (438)..(438): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
  modified_base (538)..(538): a, c, t, g, unknown or other
  misc_feature (538)..(538): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtctgggggagacttggtccagtccgggggggtccctgagactctcctgtacagcctctggactcaccttgagcaattattggatgacctgggtccgccaggctccgagggaaggggctgggagtgggtggccaacataaagcaagatagggagtacgaaagaactatgtggactctgtagaagggtcgttacaccatctccagagacaatgaccaagaattctagttnttttagaaatggtacagtctgagactccggaagtatacgggnagtatatatcgcgngaggacgagtgagtacgtacgtaaggttagggggtagagacgtnttacgtggtttacg

SEQ ID NO: 25616 - DNA, 556 bp, Homo sapiens
  misc_feature: GYAE6OF02I8WFW.45.34.D01.1.454.CMB.1.raw
  modified_base (280)..(280): a, c, t, g, unknown or other
  misc_feature (280)..(280): n is a, c, g, or t
  modified_base (385)..(385): a, c, t, g, unknown or other
  misc_feature (385)..(385): n is a, c, g, or t
  modified_base (434)..(434): a, c, t, g, unknown or other
  misc_feature (434)..(434): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccaaatgtgacatccagatgacccagtctccttccaccctgtctgcatctgtaggagacagagtcaccatccacttgccggccagtcagagtattagtaactggttggcctggtatcagcagaaaccagggaaacnccctaagctcctgctctaataggctatctaagtttagaagtgggtcccatcaagttcagtcgcagtgatcgtgggacagaattcgactctcacatcagcagcctnctagcctgacttgtatttgactaacctttatactcgtaccaactagtanagttaataagtttaacgttccgtaagtttaccggacgtaacgggtacctaaagggtacggaaaacttacggaaaacgttacgtaacggttggacttacggacctaaccgtagttccgttacg

SEQ ID NO: 25617 - DNA, 624 bp, Homo sapiens
  misc_feature: GYAE6OF02H4U58.45.34.D01.1.454.CMB.1.raw
  modified_base (216)..(216): a, c, t, g, unknown or other
  misc_feature (216)..(216): n is a, c, g, or t
tcagacgcgatcgacacgaccggtgctcgatttagatcgtctgtgttgggtttgggggggtctcagagaggagccttagccctggactccaaggcctttccacttggtcgaccagcactcgagcacagaggactcaccatggaattggggctgagcgtggcttctagttgctattttagagtgtcatgtgagatgaagtggtggagtcgtgggganacttggtccagtccggggggtcctggacgactctcctgtacagcctcgtggacctctaccttgagacattatggaactagtaccgtcggtaccgcccgagtcctaccgagggtaacgggtcgtaggacggttgggtacgaccctaaagaagtaaagacgtaaggaggtgggaacgtacgaaagaacgttagtaggtacggactgtagtcggtaagggtcgtacacctagtactaccgagtacgacaagtcgacgaagtactacgtagttactttaggtaatacgacgtagtactagtagtaacgttacgtaagtaatacggacgtaagtaagttactacgtacgacgtcgaggagtatagtaagtacgtacgtaaggtacgggtaacacgtacgtattacgtgttacg

SEQ ID NO: 25618 - DNA, 716 bp, Homo sapiens
  misc_feature: GYAE6OF02H3KQE.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagtacgtttggtccaaggttcccgggggggtccctggagtacgtctccgtgtacgacgcctactggaccttcaccctttggaagactaattacgttggagtcgtaccgtgggtcccgaccgaggtcctacccgaaggggaacggggtctagggaggtggggtacggacccaaacgaagtaaaacgcgaaaggacggtagggagtaaccggaaaataaacgtagtacggtaggaccttgttaggtaggtaacgggggttccgtaactaccgaacttccgtaccgaagtaacgaactaaacgtgtaaccgaaagtaacttcgtacgtttaccgttttaagggtaaatacggtaacgtaagtctaaggtaacgaacttaacccggaagtaacgaacggacgtaagttaacgtaattaaccgtagtaccggacgtaacggtaagagttagacgtaacggtaaccgttaggtggggtaaggacgaatagttcgtgggttaacg

SEQ ID NO: 25619 - DNA, 745 bp, Homo sapiens
  misc_feature: GYAE6OF02ID7U9.45.34.D01.1.454.CMB.1.raw
  modified_base (173)..(173): a, c, t, g, unknown or other
  misc_feature (173)..(173): n is a, c, g, or t
  modified_base (187)..(187): a, c, t, g, unknown or other
  misc_feature (187)..(187): n is a, c, g, or t
  modified_base (520)..(520): a, c, t, g, unknown or other
  misc_feature (520)..(520): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctcgtggcctcccgaggtgccagatgtcgccatccagatcgaccngtctcattctcctntctgctatctggagtacgatagtacttaccaagttaacgtcggaccgggactaacggtcgaacggtattaacgttaaggtaaaacgttggtaaaggttacggcgttacggtataccgaggtacgaacggacggaaccgggacggggacccctacccccgtacttaccgtacgtacttgtacggtcgttaccgttaaccggtaagttaacggaacggttccggaccctagtaccggtaagttcgtagggtcgggacggttcgtcgacgggactaacgtaagttaccttcctaacgttcctaccactacgtccggtaacccgtcccgtcgtacgngaaccggtaacgtaatttacgtttagaaacccttaacgtttgtaacgtcgttaaaccgttaaacgagttttaacttaacccgttacttaacccgggtagttaacgttaccggttaaccgaaaccggtaaaggtaccctaaggtttccgaacgttaccgataaacccggtaaactacggttggttaaccgcgtactaccggtaactccgtttattccgtcttacgg

SEQ ID NO: 25620 - DNA, 646 bp, Homo sapiens
  misc_feature: GYAE6OF02FLAWF.45.34.D01.1.454.CMB.1.raw
  modified_base (218)..(218): a, c, t, g, unknown or other
  misc_feature (218)..(218): n is a, c, g, or t
  modified_base (262)..(262): a, c, t, g, unknown or other
  misc_feature (262)..(262): n is a, c, g, or t
  modified_base (447)..(447): a, c, t, g, unknown or other
  misc_feature (447)..(447): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctggctttccttgtgctattttagaaggtgtccaatgtgagatgaaagtggtggagtcgtggggganacgttggtccaggtccgggggggtccctgagctctccgtgtacncgctctggactcacttgagctaattatggatgaccgtggtacccgccgaggtcctccgaaggggacggggcgtacgggaggttcgggtacgggaccaaaccgtaagtaaaacgcaaaggagtgggaagttacgaaagtaactagtggtacggacttcgtaggtacgtaagggtccgttacacctntacctccgagagaacaatcgaccaagtaacttcgacgtttacgttttacgtaaagttgaactacggtctaggaacgtaacaccggaacgaagtacggactaacgtacgttaattacgtagacgtcgaacggtagtaagtgtactaacggttacgtaaacggttagggggaacgtaagaccgtagttacgttaggtttag

SEQ ID NO: 25621 - DNA, 838 bp, Homo sapiens
  misc_feature: GYAE6OF02H37U4.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcacatggaattgggctgagctgggctttctgtgctattttagaaggtgtccatgtgagatgaaagtggtggagtcgtgggggagtacgttggtccagtccgggggggtccctggagactctcctgtacagcctcgtggactccaaccttggagtacaattagttggatcgtaccgtcgggtccgccgaggcctaccgaggggaagggccgtaggaggtcggggtcggtaccgaaactaagtaaaaggacgaaaaggacggttaggggacgtaacggaaaagtaactagttaggtagggtacttcggttagggttacgggtaaacgggggttcggtttacccgaaccgttaacgttcccgtacccgtaacgggtaaacgaacgaaacgttaccgggaaacccgtaaaaggttaactttaccgtaaacggtttttcccggtttttttaaaggggaaaacgttacggggtaaccgttaaagttaccggttaaggtaacggtaaccgtaacccggtaaacggtacgtaaccgggtaacgtaaacggtttaacgttaaacgtttaacgttacgggtaccggtacgggtaaccggtaaggtaacgttaacggtaacgtttaaacgggtttaaccccggttaaagggggttacggggggttaacgggaaacggttaaccggttaacgtttacgggttttaccggggtttaaaggg

SEQ ID NO: 25622 - DNA, 692 bp, Homo sapiens
  misc_feature: GYAE6OF02GY34W.45.34.D01.1.454.CMB.1.raw
  modified_base (221)..(221): a, c, t, g, unknown or other
  misc_feature (221)..(221): n is a, c, g, or t
  modified_base (308)..(308): a, c, t, g, unknown or other
  misc_feature (308)..(308): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgcttattttagaaggtgtccaatgtgagatgaaagtggtggagtcgtggggganacttggtccagtccggggggtccctgagactctcctgtacagcctcgtggactcaccttgagcaattatggatcgacctgggtcccnccgaggctaccgaggggaggggctgggagtgggtggacccaataacgtaaaggcaaaggagtagggaagtacggaaaagactaagtggtaggaccttgtaggttaggaaagggttccggttacaaccgtatacctccgaaggacgaactaagtcgaacctaagaactttacgaggtttacgtttttaaggaaacgttacggtaaccgtaggttactacggtaagacgttaaccgaaagtaacgtaacggtactaagttaacttaagtttaccgtacggtaccgtacggaaggtaaggtaacttaggtaacgttaacggttaaccgttaaagggttagggggtaacgtaagggttaaaccgtagtttaccggttaggtttaacgg

SEQ ID NO: 25623 - DNA, 721 bp, Homo sapiens
  misc_feature: GYAE6OF02JS6GF.45.34.D01.1.454.CMB.1.raw
  modified_base (264)..(264): a, c, t, g, unknown or other
  misc_feature (264)..(264): n is a, c, g, or t
tcagacgcgatcgacacgaccggtgctcgatttagatcgtctgtgttgggtttgggggttcgtcagagaggagccttagccctggactccaaggcctttccacttggtgaccagcactgagcacagaggactcaccatggaattggggctgagctgggctttccttgttgcttatttagaggtgtccaatgtgtagatagaagtggtaggagtcgtgggggagacttggtccaggtcccggggggtacctggagactctccgtntacgagcctacgtggactccaccgttgacgactaacttagttaggattagtaccggtggtccccgacgtaggccgtacccggaaggggaaggggtccgtaggggtacgggtgggggtaccggaccaaacgaagttaaaacggaccgaaggtaggtagggaagtacggaaaaggtactaaggttcggtaggaccttgtagggtacgggtaaggggtttcgtacgaccagtacgtaccgagacgaacagtacgacgaagtagttatacgttgtttaagtaagttacggacgtattacggtgtaacggtacgtacccgaaggtaacgacggtagtaacgtttaatacggtttaacgacgggacgtacggtacgaacggtaaggtagttaagttaccgttaaggtaacggggttaggggtaacggacggtaaccttaggttacccggtttaggtttaacgg

SEQ ID NO: 25624 - DNA, 716 bp, Homo sapiens
  misc_feature: GYAE6OF02HGJOC.45.34.D01.1.454.CMB.1.raw
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttcctgttgctattttagaaggtgtccaatgtgagatgaaagtggtggagtcgtgggggagacgttggtccaggtccggggggtcctgagtactctcctgtacagcctcgtggactcacttgacgctaattagttggatcgaccgtgggtcccgaccgaggcctacggaggggaaggggcgtaggggaggtcggggtccggaccaaacgtaagtaaacggtacaaacgggtagtaggggtaacggtaacggtaaaaaggtaacgttaagttggtacggtacttagttggttaacggggtaaggggttccgttacctaaccgtacttcccgtaccgaaggaacgaaactaagttacgaaccgtaaagtaacgttttcgtaaacggtttttcggttttaaaggaacgggttagtaaccgttacggtctaggtacgtaacgtaaccgaaggtagtacggtaccttagttaactactaggtacgacggtacgaggtactagtaacgtaggtaacgtacgtaaggggtacggtaaggacctaacggtacgttggttaggtacg

SEQ ID NO: 25625 - DNA, 679 bp, Homo sapiens
  misc_feature: GYAE6OF02FZAR2.45.34.D01.1.454.CMB.1.raw
  modified_base (220)..(220): a, c, t, g, unknown or other
  misc_feature (220)..(220): n is a, c, g, or t
  modified_base (264)..(264): a, c, t, g, unknown or other
  misc_feature (264)..(264): n is a, c, g, or t
  modified_base (322)..(322): a, c, t, g, unknown or other
  misc_feature (322)..(322): n is a, c, g, or t
  modified_base (616)..(616): a, c, t, g, unknown or other
  misc_feature (616)..(616): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtggggganacttcggtcctacggtccggggggtccctgacgctctctgtacngcctctggactccaccgttgacgtactaatttattggagtcgtaccgtcggggtcccnccgacggcctaccggagggggaacggggccgtaggggacggttggggtacggaccgaaaccagtaaacggcaaaggtagtacgggtaagtacgaaaagtaacgtaagtggtacggtacttacgtaggtagggtaacggggttccgttccaaccgtacgtccgtaacccgaagaacgaccgaagtacgacctaaacggtaattacgaacgttttacttttaggaacgtacggactagttctagacgtacgtaacgagtaacgtacgactaagtattaacgttcgtacggtaccgngaagtagtacagtaagtacgtacgttaagggtacggggtaacaggtctaacgttgttgttacg

SEQ ID NO: 25626 - DNA, 734 bp, Homo sapiens
  misc_feature: GYAE6OF02HIA3O.45.34.D01.1.454.CMB.1.raw
  modified_base (343)..(343): a, c, t, g, unknown or other
  misc_feature (343)..(343): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagcgtgggtctttccttgttgcttattttagaaggtgtccaatgtgagatagaaagtggtggagtcgtgggggatacgttggtccgaggttcccgggggggtccctggacgtacctcctcccgtgtaccacgtccttcgtcggaccttcctaccgttgacgactaaatttagttggatcgtaccgtcgggtccnccgaggtcctaccggaggggaacgggcgtgggacggtgggtacggacctaacgaagtaaacgacgaaagagtagggagtaacggaaaagtaacgtagttggtacggtacttcgtagggtaggtacgggttccggttaccaccgtctccgtaccgaaggtaacgtaacgaacgtcgaacgtaaagtaacttccgtaaggtttttccgtttaaaggtaagtacggtactaacggttcgtaagacggtacgttaccggaaagtaccgtacggactaagtttacgtacttacgtaggaccgtaggaacgtaggtagtaggtaattaaccgggttaaccgttaaggggttacggggttaagaaccggtacgttaacgtttacggttggtttaacgg

SEQ ID NO: 25627 - DNA, 817 bp, Homo sapiens
  misc_feature: GYAE6OF02HKLVA.45.34.D01.1.454.CMB.1.raw
tcagacgcgatcgacacgaccggtgctcgatttagatcgtctgtgttgggtttggggtctcagagaggagccttagccctggactccaaggcctttccacttggtgaccagcactgagcacagaggactcacatggaattgggctgagctgggtctttccttgttgcttattttagaaggtgtccaatgtgagtatagaaagtggtggagtcggtgggggagtacgttggtacctacggttcccgggggggttccctggaacggtaccttccgttccgttcgtaaccgacggtcccgttcgtacggtacctaccgtacccgtttaggaacggtaacctaaacgtttaagtttaggggacgtaccggtaacccggttccgggggttaccccgacccggtaacggtcccgttaacccgggaagggggaaccggggtacggtaggggacggttcggggggtacggacccgtaaacgaaacgtaaagacgaaaaggtagtagggtaacggtaacgaaaagtaaacttaggtacggtacggacttcgtagtaggggtaacgggttcggttaaccaaccgtaccttcgtaccgtaaggaaacgtaacgaaagtacggaaactaaacggtaactttaacgtacggttttaacgttttaaagggtaaagttaacggtaacgttaacgttccgtacggtaagtaaccggttacgaaacggtagtaccggtaattacgttaatacgttcgtagacggagaacggagacttaggtactaacggttactaagggtagggtaacgtgtaactagtttccgtaggttacgg

SEQ ID NO: 25628 - DNA, 498 bp, Homo sapiens
  misc_feature: GYAE6OF02F472N.45.34.D01.1.454.CMB.1.raw
  modified_base (102)..(102): a, c, t, g, unknown or other
  misc_feature (102)..(102): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (344)..(344): a, c, t, g, unknown or other
  misc_feature (344)..(344): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (373)..(375): a, c, t, g, unknown or other
  misc_feature (373)..(375): n is a, c, g, or t
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
  modified_base (493)..(493): a, c, t, g, unknown or other
  misc_feature (493)..(493): n is a, c, g, or t
tcagacgcgatcgacacgaccggtgctcgatttagatcgtctgtgttgggtttgggggagtcagacccagtcaggacacagcatggacatgagggtccccgntcagctcctggggctcctgctgctctggctcccaggtgccaaatgtgacactccagtatgacccagtcctccttccaccctgtctgcatctgtaggagacagagtcaccatcacttggccggcagtcagagtattagtactggttggcctggtatcagacagaaaccgaggaaacnccctaagctccngctntatagcatctagttagaagtgggtccatcgaagtcagcggcagtgatcgnggacagatcgactcncactncancacgcnnncgctgntgtattgntagttctctntcngcgagtccgtccgccgacgccnctcctacggttccgggacggggacgagggtcggagagtacgacgacgtagtggtcgaccgcgccacgtnttccg

SEQ ID NO: 25629 - DNA, 790 bp, Homo sapiens
  misc_feature: GYAE6OF02I8VE9.45.34.D01.1.454.CMB.1.raw
  modified_base (143)..(143): a, c, t, g, unknown or other
  misc_feature (143)..(143): n is a, c, g, or t
  modified_base (148)..(148): a, c, t, g, unknown or other
  misc_feature (148)..(148): n is a, c, g, or t
  modified_base (654)..(654): a, c, t, g, unknown or other
  misc_feature (654)..(654): n is a, c, g, or t
tcagacgcgatcgacacgaccggtgctcgatttagatcgtctgtgttggggtttgggggcaggagtcagacccactcaggacacagcatggacatgagggtcccgctcagctcctgggctcctgctgctctggctccgaggtnccagntgtgccatccagatcgaccagttctccattcctcctgtctacgctatctggtaggacacagtacgttaccgaattaccgttggacccgggtataacgtccgaagggtacttaacgttaaggtaaagttaggtaacggtttaacggcgttacgggtataccgaggtacgaacggacggaaccgggtacgggggacccgtacccccccgtacgttacccgttacgttaccggttacggttcgggttacgtaccgtttacccggtaacggttaacggtaaacggttacggggtaccctacgtacgtaacggttacgtaggtcggtcgggttcggtacggagggtctaacgtataaacttccgaccgtacctaccgtaccgtacgtaacccgtacgtcccggtacccgtacgtcccggtaacgtacccggttaaacgttacgttttaccggaaacctttaaccgtttaaacggtttacccaaccggtaccctaaacgtaacgtacgttanacgtttagtttaccgttacccggtacgttacgggaccgtaaacggaacgggtaacgtaacgggtaactaacggtaacggtaaccgtggtacgtcgttaaccgactacgtgttaccctgtaccttacgacgttcccg

SEQ ID NO: 25630 - DNA, 933 bp, Homo sapiens
  misc_feature: GYAE6OF02IMORA.45.34.D01.1.454.CMB.1.raw
  modified_base (227)..(227): a, c, t, g, unknown or other
  misc_feature (227)..(227): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagcgtgggtctttccttagtgcttaattttagaaggttgtccaatgtgagatagaaagtggtggagtcgtaggggganacgttggtccacggttcccggggggtccctggacgacctctccgtgtacacgcctcgtggtaacctcctaccgtttggacgacctaaatttacgtttgggaaacttcggtaacccgttgggggttcccccgaccgtacgggtcccttaccgggaacgggggaaacgggggtccgttaaggggacggggttcgggggttacgggacccccaaaagtaaacgttaaaaacggaccgaaaaaggtaggtacggggtaacgtaacgggtaaaaaacggtaacctaaggttcgggttaagggtaacccgtttacggttaacgggtttaacggaaacggggggggttttacccgtttaaccctaacccgggtaactttaccgttaaccggaaacggtaacggaaacgtaacgtacgggtaaacctaaagggttaacctttaacggttacgtttaaccgtttttttaaggggaaaaactttcgggtaaaccgttaaggtttaccggtaacgaaacggttaccgttaaaccgggtaaacgttaaacgggtaacccggtaacgtaaacgtttaaacgttaaacgttttaaaacgacggttaccccgaggaacggttaaagtgaaacggtttaaagttacccggttaacggttaaaccgggttgggggttaaaccgtaaggtaaccgttaacgttacggtttacgggttttaacgg

SEQ ID NO: 25631 - DNA, 680 bp, Homo sapiens
  misc_feature: GYAE6OF02JUNZ3.45.34.D01.1.454.CMB.1.raw
  modified_base (193)..(193): a, c, t, g, unknown or other
  misc_feature (193)..(193): n is a, c, g, or t
  modified_base (348)..(348): a, c, t, g, unknown or other
  misc_feature (348)..(348): n is a, c, g, or t
  modified_base (623)..(623): a, c, t, g, unknown or other
  misc_feature (623)..(623): n is a, c, g, or t
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgtgctattttagaaggtgtcaatgtganatgaaagtggtggagtcgtgggggagtacttggcctagtccggggggtccctgaggactcgtcctgtacagcctgtcggactccgaccttgagctaattagttggatcggccgtcgggtcccgcgacggctccggaaggggacgggtcgtagggnggtcggggtcggaccaaacgtagtaaacgcgaaggagtaggggactaaggaaacgtaacgtaagtcggtacggtaacgtcgtaggtacgggtaaacggggttcggttacctaactcgtacgttaaccgagacgtaaacgagtacgactaacgtacgttacgttacgtttaccgtttaggtaacgttacggtacgtaacgtcgtagaggtaacgtacgaaggtaacgtacgacgtaacgttacgtacgttacgtagtacgtaggacggtaacggtntagtagtaacgtaccgtaagggtaggttacggagtaccgacgttagttagtttacgg

SEQ ID NO: 25632 - DNA, 821 bp, Homo sapiens
  misc_feature: GYAE6OF02JP89G.45.34.D01.1.454.CMB.1.raw
  modified_base (218)..(218): a, c, t, g, unknown or other
  misc_feature (218)..(218): n is a, c, g, or t
  modified_base (774)..(774): a, c, t, g, unknown or other
  misc_feature (774)..(774): n is a, c, g, or t
tcagacgcgatcgacacgaccggtgctcgatttagatcgtctgtgttgggttgggggtctcagagaggagcctagccctggactccaaggcctttccacttggtgaccagcactgagcacagaggactcacactggacttggggcttgagtcgtggtctttccttggttgaccgttatttttagaaggtcggtccaagtgtgtagagtagaaggtggnggagtccgtggggactagttcggtccacggtacccgggggggtccctaggacgtaccgtccgttccgttagttaccgacggtacccttacgtagggtaccgttaccgtacccgtttaggtaaacgggtcctaaaacgtttaacggttaggtacgttaccggtacccggttacgggggtaccccgtacccggtaccggtaccccgttaccggtaagggggtaacggggtacgttaccgggtacggggttacgggtaccggtaaccgaaacccggtaaagttaaaccggaccgtaaacggtacggttaaggtacgtaccggaaaagtaaccgttggttacgtacggtaccgttacgttcggtaacggttaacgggggtccttaacgtaccggtaccgttaacggtaccggttaaacggacgtaaacgacgttacggaccgttaaacggactttaccggtaagtttacggtttaagtaacgtacgtagtacgtacgagtacgacgtacgtatacgtagccgttaagtacgtatacggttcacgcgaagtcgtagtacgngttaaccgtgtaaggcggtaggaacgtcgtaggtaccgttggttacg

SEQ ID NO: 25633 - DNA, 926 bp, Homo sapiens
  misc_feature: GYAE6OF02GBPCM.45.34.D01.1.454.CMB.1.raw
tcagacgcgatcgacacgaccggtgctcgatttagatcgtctgtgttgggtttggggggagtcagacccactcaggacacagcatggacatgagggtccccgctcagctccgtggggctcctgctgctctggctcccaggtcgccagatgtgccatccgagactacgaccccagtcctccactttcctccctgtctgctatcgtaggtaggagacgaaggtacgttaacctaagttaacgttcggacccggggtacgaacggttacgaaggtaacttaagttaaaaggtaaaagttggttaaaggtttagggtaccggtttagggttaataccgtacggaccgaaacggtaaccggaacccgggaacggggggaccccgaaccccccccgtaaaccgttaccccgttaggttaaccgttacggtcgggttccgttaccgtttaaccgtaaccggggtttaaaccggtaaacggggtttcccggggtaccctacggtaaccggtaacggtttaccgtagggttcggggtacggggttcggggttacggttacggaccgtaaaacgtaaaggttaaccctttacaacccgtttaccgtaacccaccctactacccggaccgtaccccggtccgacggaaccgtaccggaacccgttaagtttacgtttaacaccttaacgtttaattaccgtagtttaactaaccgtaaagtttacctttaaaccgttaaccctttaccggtaccgtaacgttacccggttaacccgggaccgtaaaaccggggtacctaacggttacccgtaagggaaccttaacgtaaaccggttaaaccggtacggtttagggtaccggtaacccggttaccgtacccgtaaccgttaccgtttaccggttcttttaccccgtttacttaccccgtttacccccg

SEQ ID NO: 25634 - DNA, 629 bp, Homo sapiens
  misc_feature: GYAE6OF02FNFOP.45.34.D01.1.454.CMB.1.raw
  modified_base (270)..(270): a, c, t, g, unknown or other
  misc_feature (270)..(270): n is a, c, g, or t
  modified_base (353)..(353): a, c, t, g, unknown or other
  misc_feature (353)..(353): n is a, c, g, or t
  modified_base (396)..(396): a, c, t, g, unknown or other
  misc_feature (396)..(396): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattggggctgagctgggctttccttgttgctattttagaaggtgtccaatgtgagatgaaaagtggtggagtcgtgggggagacgttggtccagtccgggggggtcccctgagactctcctgtacagcctntggactcaccttgagcaattacttggatgacctgggtccgccagggctccgagggaacgggcgtggaggtgggtggcccaaanagtaaagcgaagtagtggagtacgaaagaactatgtaggactntgtggaacgggtcggttacaaccgtatcgtacagaagacgaatcgaccgtaaagacttacagtttacgttttaggaaattcgggaactacggttactaggaagtacgtacccggaagtaacgtaacggaccgttaagtaacttagttaaccgtggaccggtacgaagtagtataggtagttaacgtaccttaaaggtgggggtaagaacggacgtacgttacgtggtttacgg

SEQ ID NO: 25635 - DNA, 838 bp, Homo sapiens
  misc_feature: GYAE6OF02GKQEZ.45.34.D01.1.454.CMB.1.raw
tcagacgcgatcgacacgaccggtgctcgatttagatcgtctgtgttgggtttgggggtctcagagaggagccttagccctggactccaaggccctttccacttggtgaccagcactgagcacagaggactcaccatggaattggggctgagcgtggtctttcctgtgctatttagagtgtcaatgtgagatgtaaagtggtcggagtcggtggggggaatcgtttggtcccgaggtcccgggggggtccctgacgtacctccgtcctagtacacgcctcgtcggactcctaccgttgagtctaaatttacgtggatcggaccgtgggtcccgccgacggccgtaccggaagggggtacgggccgttagggtacggtcggggtcgaacctaaacgaagttaaaggacaaaggtcggtagggtaagtaacgtaaaacgaaacgttgttacggggtaggtaaccttgttaagggttacgggaaaggggggtttcccgttaaccgaaccgtaaccttcggtaaaccgtaacgggaacgaaccgttaaacggtacgaaaaccgtaaacggttaacctttaacgggttaacgtttaacggtttttaaacgggtaaacgtttaaccggtaacttaagggtccgtttaaggaacggttaacggttaaacccggtaaaaggtcccgttaaaccggggttaacctaaggttttaaaacctacgttttaaccggacgaaccggggttacgaaggtaacgtaggttaaccgtagttaaccggtttaaccggtagggtaccggggggttaagtaaaccgtagggtttaccgtttagggttggtttaacgg

SEQ ID NO: 25636 - DNA, 850 bp, Homo sapiens
  misc_feature: GYAE6OF02I5A9S.45.34.D01.1.454.CMB.1.raw
  modified_base (291)..(291): a, c, t, g, unknown or other
  misc_feature (291)..(291): n is a, c, g, or t
tcagacgcgatcgacacgaccggtgctcgatttagatcgtctgtgttgggtttgggggtctcagagaggagccttagccctggacctccaaggcctttccacttggtgaccagcactgagcacagaggacctcaccataggaagttggggctgagcgtgggtcctttccttgtgtcttatttagaaggtgtccaagtgtgagatagaaaggtggtaggaggttcggtgggggacgtacgttcggtccgaggttcccgggggggtccctggacgtacctctaccgtcgtacncgtcctcgtacggactctaccttgacgactaagtttacgttggacgttaccgtacccgttcggggtccccgtaacccgacggtccgttaccggaacggggaacggggtccggtggggtaaggggttcggggtacgggtaacccgtaaaacgtaaaccggttaaaacggaccgtaaaaggtaggttagggggaaacgttaaacggggaaaaacgttaaaccgtttatacggggttaacgggtaaccttacgtaccgggttaaggggtaaccggggttacccggttttaccaacgttaccgtacccgttaaccgacggtaacgtaaacaacggttaaccgaaaccgaaacgtttagttaaccctttaggtttaacccgttttttaaagggaaaccgttcgggtaaactacgggttacttaaccgggaagttacccgtaacggtaaacggacgtttaaccgacgttaagtaacgtacttaagggtccgagtacgagtagtaagtggaattacggttaacgtaacggggtacggtaggacgttctaacgttcgggttgtacgg

SEQ ID NO: 25637 - DNA, 863 bp, Homo sapiens
  misc_feature: GYAE6OF02JH8R3.45.34.D01.1.454.CMB.1.raw
  modified_base (149)..(149): a, c, t, g, unknown or other
  misc_feature (149)..(149): n is a, c, g, or t
  modified_base (168)..(168): a, c, t, g, unknown or other
  misc_feature (168)..(168): n is a, c, g, or t
tcagacgcgatcgacacgaccggtgctcgatttagatcgtctgtgttgggtttgggggtctcagagaggagccttagccctggactccgaaggcctttccacttggtgaccagcactgagcacagaggactcacatggagttgggctgngcgtggtctttcttgttgnttatttagaggtcgtacatgtgagatagtaagtggtaggtagttcggtaggggtacgtacggttcggtccgtacgggtcccggggggttcctaggtacgtaccttccgttccgtagtacgacgtccttcgtacggtacctacctaccgtagtacgtacttaacgtttagtggtacgttaccggtaccgttccggggtaccgtacccggacggtaccgtacgggtaagggggaacgggtcggttacgggtcgggttacgggtaccggaacctaaacgtaaaggtaaacggtaagaaacggtacgggtaacgggtaacgttaaacggaaaaagttacgtagttacggtaacgtaccgttacgtaacggggttaacgggtaacgggtttcccggttaaccgaacccgtttaaccggtttccgtaaaccggtaaacggtaaacccggtaaccgtaaaccggttaccgaaaacggtttaaacgttaaaccggttttacgtttaaacggtttttaccggtttttaaacggaaaggttacgtaacgtcgttaacgaggtaaccgttaagaaccggtaaggtacgtacgtaacgttacgttattaaccgttgacgtagacgtaacggagtacggttagtaaccttaggtaacggttacgggaacgggtttagaaccgttatttaacggttggtttagtaacgg

SEQ ID NO: 25638 - DNA, 974 bp, Homo sapiens
  misc_feature: GYAE6OF02HDS4Z.45.34.D01.1.454.CMB.1.raw
tcagacgcgatcgacacgaccggtgctcgatttagatcgtctgtgttgggttggggggtctcagagaggagccttagccctggactccaaggcctttccacttggtgaccagcactgagcacagaggactcaccatggaattggggctgagctgggtctttccttgttgcttattttagaaggtgtccaagtgtagagtatggtaaagtggtgggacgtcggtagggggagtacgttggtaccgacggttcccgggggggtccctggacgacctccgttacctacgtacacgtccttcgtaggtacctcctacccgttaggacgtacctaaatttagtacggtagtacggtacccggttcggggttaccccgaccgtacgggtccctaccgggtaaggggacggggtacgtcggggtaagggtcggggtacggtaccgaacgtaacgttaaacggactaacggaagttcggggaaacggttaaccggaaaacgttaaaccgtacggttacgggttaacggtaaccgttccgggtttaacggtaaccggggttaacggggtttaacccggttacccgtaacccttaacggtttacccgtaaccccggtaaaggttaaacccgtaaacgtaaacgtttaccggaacccgttaaaaacggttacggtttaaccggtaaccgtttttaaccgggttttaaaacggaacgggtttacgtaaacggttaccggttacggttaacgggtaaacggtacccgttaaacccggggttaaaggtaacccgttaaccggggttaaccgttaacggtttaaaccgtttaaacggttaccctaagggccccgggttaacgtacgggtaaaccgtttaggtaaccggttaaaggttacccgggttaacccgggttaaacgggttttcggggggaaaacttacggtaacccggttttagtttaccccggggtttggttttaaacccggg

SEQ ID NO: 25639 - DNA, 796 bp, Homo sapiens
  misc_feature: GYAE6OF02GSH6I.45.34.D01.1.454.CMB.1.raw
tcagacgcgatcgacacgaccggtgctcgatttagatcgtctgtgttgggtttggggggtctcagagaggagccttagcccctggactccaaggcctttccacttggtgaccagcactgagcacagaggactcaccatggaagttggggctgagcgtgggtctttccttgttgcttattttagaaggtgtccaatgtgagatagtaaagtggtggagtcgtgggggagtacgttgggtccgtacggtcccgggggggtcctcggacgtaccttccttccgttagtaccgacgtccctactaacggtacctcctacctttaggaggtcttaaagttagtttaggaattcggtaccccggttcggggttacccgccggaccggtaccgtacccggaacggggggaacggggtcggtaggggtacgggttcgggggtacgggaacccaaacgtaaagtaaaacggacgaaaggtaagtagggaacggttaaacggaaaaacggtaacgttagttaggtcggtaacgttccgtaggggttacgggtaacggggtttccgttaacccgaaccgtacgtacccgtacccgtaagaaccgtaacgtaaactcggaaaccgtaaacgttaacgttacgttaacgttttggtttttaacggaagttacggtaacgtgttacgtagaacgtacgtaacgagtacgtaacgtcgtaattaagtttacgttaagtcgacggacggtagagtacgtagtacttacggttacgtagggtacgggtagtagtactagttagttggtttacg

SEQ ID NO: 25640 - DNA, 655 bp, Homo sapiens
  misc_feature: GYAE6OF02IZ5KR.45.34.D01.1.454.CMB.1.raw
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
  modified_base (365)..(365): a, c, t, g, unknown or other
  misc_feature (365)..(365): n is a, c, g, or t
  modified_base (391)..(391): a, c, t, g, unknown or other
  misc_feature (391)..(391): n is a, c, g, or t
  modified_base (429)..(429): a, c, t, g, unknown or other
  misc_feature (429)..(429): n is a, c, g, or t
  modified_base (571)..(571): a, c, t, g, unknown or other
  misc_feature (571)..(571): n is a, c, g, or t
  modified_base (597)..(597): a, c, t, g, unknown or other
  misc_feature (597)..(597): n is a, c, g, or t
tcagacgcgatcgacacgaccggtgctcgatttagatcgtctgtgttgggtctgggggagacttggtccagtcccggggggggtccctgagactctcctgtacagcctctggactccaccttgagctaattattggatgaccgtgggtcccgccaggcctccgaggggaaggggctggagtgggtggccaanataaagcaaagngtgggagtagaaaagactagtgtggacctntggtcggaagggtcgttcacatcgtcagagactaatcggaccaagtattctagtttcgttttaagaagtcgataggtcaganatccgaanagtacgacagttattgtacctggccgtagaaggtagaagtnaagtacgtaacgttaggtaggggtanaacggtatagttgttcggtttaacgttctcttacggtnttggtgggcggggacctaccgggagtaccggtactaccgtcttctcgtacgtcctacgtaccgacggtcctaacgttccgttaccccgtcccggtcgccctacccgcgtacctcggaccgtaccgccttccgaccgtacggngtccaacgtcgccggaccctcgggcncggtaccgtcgtaaccgtacgttactcccgtaccgtacgtcgtaccctcggtctcggg

SEQ ID NO: 25641 - DNA, 799 bp, Homo sapiens
  misc_feature: GYAE6OF02IOJ6K.45.34.D01.1.454.CMB.1.raw
  modified_base (767)..(767): a, c, t, g, unknown or other
  misc_feature (767)..(767): n is a, c, g, or t
tcagacgcgatcgacacgaccggtgctcgatttagatcgtctgtgttgggttgggggtctcagagaggagccttagccctggactccaaggcctttccacttggtgaccagcactgagcacagaggactcaccatggaattggggctgagcgtgggtctttccttgttgctattttagaaggtgtacatgtgagatgaagtggtggagtcgtggggagtacgttggtccgtacggtcccgggggggtcccctggtacggtaccttccgttccgtacggttaacgtacggtcccttcgtacgggtaccttaccgtaccccgttgaggtacctaaagtttagttacgggtacttacggacccgttccggggttcccgacccgtacgggtacccgttaccggaacgggggtaacggggtccggtagggtacgggtcggggtacggaacccgtaaaaccgtaagttaaacggaccggtaaagtacgggtagggtaacggtaacggaaaacgtacgttaagtcggtacggtaacttcgtaggtacggtaacgggtccggttacaccgtagtccacgtaaggacacgtaagtcggaactaagtaagttcgtaggtttacgtttaggtaaactaggtaacctaggttacacggtaagtacgtacggtaaactcgtaaccggacgttaacgttaagttacgtaaccgtgtacccggaagtacggaagttaacggtacggtagttaaccggttacgttaagggttacgggggtaanacggtaacgtacgtttcgggttagttaaccgg

SEQ ID NO: 25642 - DNA, 810 bp, Homo sapiens
  misc_feature: GYAE6OF02GM1X4.45.34.D01.1.454.CMB.1.raw
tcagacgcgatcgacacgaccggtgctcgatttagatcgtctgtgttggggtttggggggtctcagagaggagccttagccctggactccaaggcctttccacttggtgaccagcactgagcacagaggactcaccatggaattggggctgagctgggctttccttgttgcttattttagaaggtgtaccaatgtgagatagaaagtggtggagtcgtagggggagtacgttggtccaggtcccggggggtcctgagactcctcctgtacacgtcctcgtcggtactccaccgttggaacgacgtaatttagttggaatcggtaccgttcggggtacccgccgacgggtcctacggaagggggaacgggccgtaggggacggttcgggggtcggaacccaaagtaacgtaaaacggccgaaaggtacgttagggaacggtaacgaaaaagtaccgttagttacggtggaaccttcgtaggtacgggtaacggggttccggttaaccgacccgttaactacccgtaccgaaaggtaacgtaaaccgtaataccggtaaccgaaaagttaaacgtttccgtaagttttaaccggtttttaaggaaacggttcgggttaaccctaaggttcttaacggaacggttaaccgtaccggtaaaacgtacggttacggaccgttaaagttactttaacggttaaccgccgggtacggtacgtaacggaggtaaggttaacgtcggttaacccgttacggttaaggggtaacggggttacgtaaccggtactacggtttcgggtttaggtttaaccgg

SEQ ID NO: 25643 - DNA, 674 bp, Homo sapiens
  misc_feature: GYAE6OF02JENZE.45.34.D01.1.454.CMB.1.raw
  modified_base (328)..(328): a, c, t, g, unknown or other
  misc_feature (328)..(328): n is a, c, g, or t
  modified_base (573)..(573): a, c, t, g, unknown or other
  misc_feature (573)..(573): n is a, c, g, or t
tcagacgcgatcgacacgaccggtgctcgatttagatcgtctgtgttgggtttgggggtctcagagaggagccttagccctggactccaaggcctttccacttggtgaccagcactgagcacagaggactcaccatggaattgggctgagctgggctttccttgttgctattttagaagtgtccaatgtgagatgaaagtggtggagtcgtagggggagtacgttggtccaggttcccgggggggtccctggagactctcctgtacacgccctcgtcggactcctaccgttgacgtactaattgttaggatcgtaccgtgggtacccncgacgtcctccggagggaggggacctgggacggttgggtcggaccaaacgtaataaacgacaaaggtacgtagggacgtacgaaaagtacgtagtaggtacgtactagtggtagtacggggtcgttaccgtacaacgttccgtacgaagtaagtaacagtcgacctaaagttacttcgtagtttacgtttaaggaaactggtaacctaggttacaggtaactacgtacggaagtaacgaccggtntaagttattacgtagcggtaccgagaagagtacgttacgtaacgttacggtaaccgtaagggttacggggtacgaagttacggacgtttagttggtttacg

SEQ ID NO: 25644 - DNA, 767 bp, Homo sapiens
  misc_feature: GYAE6OF02HD5YX.45.34.D01.1.454.CMB.1.raw
tcagacgcgatcgacacgaccggtgctcgatttagatcgtctgtgttgggtttgggggtctcagagaggagccttagccctggacctccaaggcctttccacttggtgaccagcactgagcacagaggactcaccatggaattggggctgagctgggtcttttccttgttgcttattttagaggtgtccaatgtgagatagaaaggtggtggagtcgtgggggagtacgttggtccgacggtcccggggggtccctgacgactcctcctgtaccacgtcctcgtcggacctcctaccttgagtactaatttagttggatcggtaccggtcgggtcccgccgacggccgtaccggagggggaggggcgtgggagggtcggggtacggaccaaacgtaacgtaaacggacgtaaaggtaggtaggggtaaggtaaaccgaaaggtaaacttaagttggtacggtaccgtgttagggtagggtaaacggggttccggttacccgaaccgtaccgtccgtacccgtaaggtacgaacctaagtacgaaccgtaaagttaacgtttactaacggtttttcggttttaacggtaaaagtcggtaaccgtaaggttcgtaacggtagtaacccgttaacggaagtaaccgtaaccggtattaaacgttaattaacgtaccgtgacccggaggaagtagtgttaagtacgttaaccgttaacggttagggtagggggtaactaaccgggtaacttacggttcggtttaggttagg

SEQ ID NO: 25645 - DNA, 682 bp, Homo sapiens
  misc_feature: GYAE6OF02HIJSR.45.34.D01.1.454.CMB.1.raw
tcagacgcgatcgacacgaccggtgctcgatttagatcgtctgtgttgggtttggggggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccgagtcccgggggggtccctggagactcctcccgtgtacagcctctggtacctccacctttgacgactaatttattggaattcgaccgtgggtccgccgaggcctccggaggggaacgggcgtgggaggtgggtggaccaaacagttaaaagcgaaagagtagggagtacgaaaagtaactagtaggtcggtacttcgtggtacggtaacggggtttcggttaccaacccgtactccgtaccaaggtaacgaacgtaagtacgaccgtaaagtaatttacgtagtttacgtttttaagggaaagttagggaactaggtaccttaggagtacgtaccggaagaacgtacgactaagttataaagttcgtagaccgagaggtagtacgtaggtagtacgttaaccgtaagggttacggggttaaggacgtaacgttagttaccggttgtttacgg

SEQ ID NO: 25646 - DNA, 878 bp, Homo sapiens
  misc_feature: GYAE6OF02HUP3S.45.34.D01.1.454.CMB.1.raw
  modified_base (147)..(147): a, c, t, g, unknown or other
  misc_feature (147)..(147): n is a, c, g, or t
tcagacgcgatcgacacgaccggtgctcgatttagatcgtctgtgttgggtttgggggagacttggtccagtccgggggggtccctgagactctcctgtacagcctctggactcaccttgagcaattattggatgaccctgggtccnccgaggctccgaggggaagggctggagtgggtggccaacataaagcaagagtgggagtacgaaaagtaactagtggtacggacttcgtaggtagggtaacgggttccgttaccaacctacttcccgtaccgaagaagaacctaagtcgaaccgtaaagtacttacgtacgttttcgtttttaaggaaagtaggaactagttcgagtagtacgtaccggaaagtagtaccggacgtagttaattactttaacgtcggccgtacgacgaagtactggtaattacggttaccgtaaaggggtagggggtactaagaacctatttcgttagggtttacgagttcggtttacgttttacggtagtttcgggttacgggtaccgggggtacccgtaacgggggtaaccgtaacccggggtaccgtacccggtttcctttaccgtttaaccgacccgttacccctaacccggaaacccggtaaaccggggccccttaccgttaccccggtttccccgtttaccccggtacggttaaccccgtcccgtacgtacccgtccggtaaccggaccggtacccgacccgtacggaccgtacgaaccggtacgacggggtcccgtcccggtacggggtcctaccggttcccggtaggtaacccggtaaccggtttaacccttcccgtttacccggttaccggttaccgtacccgggttcgttacccgggttacgggacccgggg

SEQ ID NO: 25647 - DNA, 164 bp, Homo sapiens
  misc_feature: GYAE6OF01D8L50.25.36.D03.1.454.CMB.1.raw
  modified_base (163)..(164): a, c, t, g, unknown or other
  misc_feature (163)..(164): n is a, c, g, or t
tcagactgtacagtcacgaccggtgctcgattagctgcgtcacgatctctcttggtattcggcggaggaccaagctgaccgtcctaagtcagccaaggctgccctcggtcactctgttccgcctcctcactgtacagtctgagcggctggcaaggcgcatagnn

SEQ ID NO: 25648 - DNA, 319 bp, Homo sapiens
  misc_feature: GYAE6OF01CMHE5.25.36.D03.1.454.CMB.1.raw
  modified_base (223)..(223): a, c, t, g, unknown or other
  misc_feature (223)..(223): n is a, c, g, or t
  modified_base (293)..(293): a, c, t, g, unknown or other
  misc_feature (293)..(293): n is a, c, g, or t
  modified_base (300)..(319): a, c, t, g, unknown or other
  misc_feature (300)..(319): n is a, c, g, or t
tcagactgtacagtcacgaccggtgctcgatttagctgcgtcacgagtctctcttgggatagaagttattcgagcaggcacacaacagaggcagttccagaattcactctcaccatcagcagcctgcagcctgatgtattttgcaacttattactgccaataatataataattattcgaccacgttttggccaggggaccaaggtggagatcaaacgaactgnggctgcacctatctgtcttcatccttcccgccatctagaactgtacagtctgagcgggctaggcaaggcncagtagnnnnnnnnnnnnnnnnnnnn

SEQ ID NO: 25649 - DNA, 107 bp, Homo sapiens
  misc_feature: GYAE6OF01D8536.25.36.D03.1.454.CMB.1.raw
  modified_base (107)..(107): a, c, t, g, unknown or other
  misc_feature (107)..(107): n is a, c, g, or t
tcagactgtacagtcacgaccggtgctcgatttagctgcgtcacgatctctcctggtcaaggactacttccactgtacagtctgagcgggctggcaaggcgcatagn

SEQ ID NO: 25650 - DNA, 292 bp, Homo sapiens
  misc_feature: GYAE6OF01CWCZQ.25.36.D03.1.454.CMB.1.raw
  modified_base (291)..(292): a, c, t, g, unknown or other
  misc_feature (291)..(292): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcgcatagnn

SEQ ID NO: 25651 - DNA, 294 bp, Homo sapiens
  misc_feature: GYAE6OF01DRH5D.25.36.D03.1.454.CMB.1.raw
  modified_base (290)..(294): a, c, t, g, unknown or other
  misc_feature (290)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttcccgccatctgaactgtacagtctgagcgggctggcaaggcgcatagnnnnn

SEQ ID NO: 25652 - DNA, 108 bp, Homo sapiens
  misc_feature: GYAE6OF01DQ51J.25.36.D03.1.454.CMB.1.raw
  modified_base (107)..(108): a, c, t, g, unknown or other
  misc_feature (107)..(108): n is a, c, g, or t
tcagactgtacagtcacgaccggtgctcgatttagctgcgtcacgatctctcctggtcaaggactacttccactgtacagtctgagcgggctggcaaggcgcatagnn

SEQ ID NO: 25653 - DNA, 290 bp, Homo sapiens
  misc_feature: GYAE6OF01CNB6J.25.36.D03.1.454.CMB.1.raw
  modified_base (288)..(290): a, c, t, g, unknown or other
  misc_feature (288)..(290): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttccgcatctgaactgtacagtctgagcgggctggcaaggcgcatagnnn

SEQ ID NO: 25654 - DNA, 307 bp, Homo sapiens
  misc_feature: GYAE6OF01B3OWN.25.36.D03.1.454.CMB.1.raw
  modified_base (290)..(307): a, c, t, g, unknown or other
  misc_feature (290)..(307): n is a, c, g, or t
tcagactgtacagtcacgaccggtgctcgatttagctgcgtcacgagttcgtctcttgggagtagaagttattcagcaggcacacaacagaggcagttccagaattcactctcaccatcagcagcctgcagcctgatgatttgcaacttatactgccaacaatataataattattcgacactttggccaggggaccaaggtggagatcaaacgaactgtggctgcaccatctgtcttcatcttcccgcatctgaactgtacagtctgagcgggctggcaaggcgcatagnnnnnnnnnnnnnnnnnn

SEQ ID NO: 25655 - DNA, 328 bp, Homo sapiens
  misc_feature: GYAE6OF01AFRDM.25.36.D03.1.454.CMB.1.raw
  modified_base (292)..(292): a, c, t, g, unknown or other
  misc_feature (292)..(292): n is a, c, g, or t
  modified_base (298)..(302): a, c, t, g, unknown or other
  misc_feature (298)..(302): n is a, c, g, or t
  modified_base (304)..(328): a, c, t, g, unknown or other
  misc_feature (304)..(328): n is a, c, g, or t
tcagactgtacagtcacgaccggtgctcgatttagctgcgtcacgatcgtctcttgggatagaagttattcagcaggcacacaaccagaggcagttccagattcactctcaccatcagcaggcctgcagcctgatgattttgcaacttattactgccaacgaatataataattacttcgaccacttttggccaggggaccaaggtcggagatcaaacgtactgtggctgcaccatctgtccttcatcttcccgccatctgaactgtacagtctgagcgggctggcaagggcncatagnnnnntnnnnnnnnnnnnnnnnnnnnnnnnn

SEQ ID NO: 25656 - DNA, 295 bp, Homo sapiens
  misc_feature: GYAE6OF01C2P87.25.36.D03.1.454.CMB.1.raw
  modified_base (290)..(295): a, c, t, g, unknown or other
  misc_feature (290)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctggcaaggcgcatagnnnnnn

SEQ ID NO: 25657 - DNA, 327 bp, Homo sapiens
  misc_feature: GYAE6OF01CIICD.25.36.D03.1.454.CMB.1.raw
  modified_base (306)..(327): a, c, t, g, unknown or other
  misc_feature (306)..(327): n is a, c, g, or t
tcagactgtacagtcacgaccggtgctcgatttagctgcgtcacggaagtctctcttgggatagaagttattcaggcaggcacaccaacagaggcagttccagaattcactctcaccatcagcagccctggcagccttgatgattttgcaacttattacctgcctaacaatataagtaattattcgaccacttttggccaggggaccaaggtggagatcaaacgaactagtggactgcaccatactgtcttcatccttccgccatctgaactgtacagtctgagcgggctggcaaggcgcagtagnnnnnnnnnnnnnnnnnnnnnn

SEQ ID NO: 25658 - DNA, 310 bp, Homo sapiens
  misc_feature: GYAE6OF01DB4XG.25.36.D03.1.454.CMB.1.raw
  modified_base (295)..(310): a, c, t, g, unknown or other
  misc_feature (295)..(310): n is a, c, g, or t
tcagactgtacagtcacgaccggtgctcgatttagctgcgtcacgatctctcgttgggatagaagttattcagcaggcacacaacagaggcagttccagaattcactctcaccatcagcagcctgcagcctgatgattttgcaacttattacctgccaacaatataataattattcgaccacttttggccaggggaccaaggtggagatacaaacgaactgtggctgcaccatctgtcttcatcttccgccatctagaactgtacagtctagagcgggctggcaaggcgcatagnnnnnnnnnnnnnnnn

SEQ ID NO: 25659 - DNA, 306 bp, Homo sapiens
  misc_feature: GYAE6OF01AIBO8.25.36.D03.1.454.CMB.1.raw
  modified_base (289)..(289): a, c, t, g, unknown or other
  misc_feature (289)..(289): n is a, c, g, or t
  modified_base (295)..(306): a, c, t, g, unknown or other
  misc_feature (295)..(306): n is a, c, g, or t
tcagactgtacagtcacgaccggtgctcgatttagctgcgtcacgatctctcttgggatagaagttattcagcaggacacacaacagaggcagttcccagaattcactctcaccatcagcagcctgcagcctgatgattttgcaacttattactgccaacaatataataattattcgaccacttttggccaggggaccaaggtggagatcaaacgaactgtggctgcaccatctgtcttcatccttcccgccatctgaactgtacagtctgagcgggctgggcaaggcncatagnnnnnnnnnnnn

SEQ ID NO: 25660 - DNA, 291 bp, Homo sapiens
  misc_feature: GYAE6OF01CT1V7.25.36.D03.1.454.CMB.1.raw
  modified_base (287)..(291): a, c, t, g, unknown or other
  misc_feature (287)..(291): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacactttggccaggggaccaaggtggagatcaaacgaactgtggctgcaccatctgtcttcatcttccgcatctgaactgtacagtctgagcgggctggcaaggcgcatagnnnnn

SEQ ID NO: 25661 - DNA, 298 bp, Homo sapiens
  misc_feature: GYAE6OF01A1KCQ.25.36.D03.1.454.CMB.1.raw
  modified_base (291)..(298): a, c, t, g, unknown or other
  misc_feature (291)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcgcatagnnnnnnnn

SEQ ID NO: 25662 - DNA, 294 bp, Homo sapiens
  misc_feature: GYAE6OF01D0WGU.25.36.D03.1.454.CMB.1.raw
  modified_base (291)..(294): a, c, t, g, unknown or other
  misc_feature (291)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcgcatagnnnn

SEQ ID NO: 25663 - DNA, 292 bp, Homo sapiens
  misc_feature: GYAE6OF01CJ1ZA.25.36.D03.1.454.CMB.1.raw
  modified_base (289)..(292): a, c, t, g, unknown or other
  misc_feature (289)..(292): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttccgccatctgaactgtacagtctgagcgggctggcaaggcgcatagnnnn

SEQ ID NO: 25664 - DNA, 292 bp, Homo sapiens
  misc_feature: GYAE6OF01B2LIC.25.36.D03.1.454.CMB.1.raw
  modified_base (288)..(292): a, c, t, g, unknown or other
  misc_feature (288)..(292): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccagggaccaaggtggagatcaaacgaactgtggctgcaccatctgtcttcatcttcccgcatctgaactgtacagtctgagcgggctggcaaggcgcatagnnnnn

SEQ ID NO: 25665 - DNA, 296 bp, Homo sapiens
  misc_feature: GYAE6OF01AOW5S.25.36.D03.1.454.CMB.1.raw
  modified_base (291)..(296): a, c, t, g, unknown or other
  misc_feature (291)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcgcatagnnnnnn

SEQ ID NO: 25666 - DNA, 293 bp, Homo sapiens
  misc_feature: GYAE6OF01DHH5Y.25.36.D03.1.454.CMB.1.raw
  modified_base (269)..(269): a, c, t, g, unknown or other
  misc_feature (269)..(269): n is a, c, g, or t
  modified_base (290)..(293): a, c, t, g, unknown or other
  misc_feature (290)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttccgccatctgaactgtacagtctgancgggctggcaaggcgcatagnnnn

SEQ ID NO: 25667 - DNA, 327 bp, Homo sapiens
  misc_feature: GYAE6OF01DM0XS.25.36.D03.1.454.CMB.1.raw
  modified_base (302)..(302): a, c, t, g, unknown or other
  misc_feature (302)..(302): n is a, c, g, or t
  modified_base (304)..(327): a, c, t, g, unknown or other
  misc_feature (304)..(327): n is a, c, g, or t
tcagactgtacagtcacgaccggtgctcgatttagctgcgtcacgagtacgtcggtcttgggatagaagttattcagcaggcacacaacagaggcagttccagtaattccacctctccaccatcagcagcctgcagcctgatgattttgcaacttattactgccaacaatataataattacttcgaccactttggccaggggaccaagtgagatcaaacgactgtgctgcaccatctgtcttcatcttcccgccaatctgaactcgtacacgtctgagcgggactggacaaggcgctatagncnnnnnnnnnnnnnnnnnnnnnnnn

SEQ ID NO: 25668 - DNA, 296 bp, Homo sapiens; identical to SEQ ID NO: 25665
  misc_feature: GYAE6OF01CDH5X.25.36.D03.1.454.CMB.1.raw
  modified_base (291)..(296): a, c, t, g, unknown or other
  misc_feature (291)..(296): n is a, c, g, or t

SEQ ID NO: 25669 - DNA, 322 bp, Homo sapiens
  misc_feature: GYAE6OF01E1L1T.25.36.D03.1.454.CMB.1.raw
  modified_base (297)..(322): a, c, t, g, unknown or other
  misc_feature (297)..(322): n is a, c, g, or t
tcagactgtacagtcacgaccggtgctcgatttagctgcgtcacgagtctctcttgggatagaagttattcagcaggcacacaacagaggcagttccagaattcactctcaccatcagcagcctgcagcctgatgattttggcaacttattactgccaacaatataataattattcgaccacttttggccaggggaccaacgggtggagagtcaaacgaactgtggctgcaccatctgtcttcatcttcccgcatctgaactgtacagtctgagcgggctgggccaaggcgcatagnnnnnnnnnnnnnnnnnnnnnnnnnn

SEQ ID NO: 25670 - DNA, 296 bp, Homo sapiens
  misc_feature: GYAE6OF01AL026.25.36.D03.1.454.CMB.1.raw
  modified_base (284)..(284): a, c, t, g, unknown or other
  misc_feature (284)..(284): n is a, c, g, or t
  modified_base (290)..(296): a, c, t, g, unknown or other
  misc_feature (290)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaggcncatagnnnnnnn

SEQ ID NO: 25671 - DNA, 301 bp, Homo sapiens
  misc_feature: GYAE6OF01BOQX1.25.36.D03.1.454.CMB.1.raw
  modified_base (254)..(254): a, c, t, g, unknown or other
  misc_feature (254)..(254): n is a, c, g, or t
  modified_base (292)..(301): a, c, t, g, unknown or other
  misc_feature (292)..(301): n is a, c, g, or t
tcagactgtacagtcacgaccggtgctcgatttagctgcgtcacgatcgtctcttgggatagaagttattcagcaggcacacaacagaggcagttccagaattccactctcaccatcagcagcctgcagcctgatgattttgcaacttattactgccaacaatataataattattcgaccactttggccaggggaccaaggtgagatcaaacgaactgtggctgcaccattctgtcttcatcttcccgccatcngaactgtacagtctgagcgggctggcaaggcgcatagnnnnnnnnnn

SEQ ID NO: 25672 - DNA, 291 bp, Homo sapiens
  misc_feature: GYAE6OF01CK0NO.25.36.D03.1.454.CMB.1.raw
  modified_base (288)..(291): a, c, t, g, unknown or other
  misc_feature (288)..(291): n is a, c, g, or t
tcagactgtacagtcacgaccggtgctcgatttagctgcgtcacgatctctcttgggatagaagttattcagcaggcacacaacagaggcatttccagaattcactctcaccatcagcagcctgcagcctgatgattttgcaacttattactgccaacaatataataattattcgacctacttttggccaggggaccaaggtggagatcaaacgaactgtggctgcaccatctgtctcatctccgcatctgaactgtacagtctgagcgggctggcaaggcgcatagnnnn

SEQ ID NO: 25673 - DNA, 107 bp, Homo sapiens; identical to SEQ ID NO: 25649
  misc_feature: GYAE6OF01AUFPV.25.36.D03.1.454.CMB.1.raw
  modified_base (107)..(107): a, c, t, g, unknown or other
  misc_feature (107)..(107): n is a, c, g, or t

SEQ ID NO: 25674 - DNA, 486 bp, Homo sapiens
  misc_feature: GYAE6OF01CTYK6.25.36.D03.1.454.CMB.1.raw
  modified_base (474)..(486): a, c, t, g, unknown or other
  misc_feature (474)..(486): n is a, c, g, or t
tcagactgtacagtcacgaccggtgctcgatttagctgcgtcacgatctctcttgggcagtccaggggagggcctgaagtgggtcggcctcatgagaccgagggcctctggagggacagtggagcatgacgcgtctctgatgggcaggttcagcctctcaagggacgactctaaagccatcgcctatctgcaaatgaccagcctgacagtcgaagactcagccatctattatgtgcgagactgcctgtctctgattcggggacttattggacgaactacttcacttattcccacatggacgttttggggcaaggggaccacggtcatcgtctctccacctccaccaagggcccatcggtcttccccctggccaccctcctccaagacgcacctctggggcacgacgcggccctgggctgcctggtcaaggctacttccactgtacagtctgagcggctggcaaggcgcatacgnnnnnnnnnnnnn

SEQ ID NO: 25675 - DNA, 313 bp, Homo sapiens
  misc_feature: GYAE6OF01DS7YX.25.36.D03.1.454.CMB.1.raw
  modified_base (299)..(313): a, c, t, g, unknown or other
  misc_feature (299)..(313): n is a, c, g, or t
tcagactgtacagtcacgaccggtgctcgatttagctgcgtcacgatctcgtcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctagcaccatctgtcttcgatcttcccgcctatctgaactgtacagtctgagcgggctcggacaagggcgcaatagnnnnnnnnnnnnnnn

SEQ ID NO: 25676 - DNA, 293 bp, Homo sapiens
  misc_feature: GYAE6OF01D07S5.25.36.D03.1.454.CMB.1.raw
  modified_base (290)..(293): a, c, t, g, unknown or other
  misc_feature (290)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttcccgcatctgaactgtacagtctgagcgggctggcaagggcgcatagnnnn

SEQ ID NO: 25677 - DNA, 293 bp, Homo sapiens
  misc_feature: GYAE6OF01CW60C.25.36.D03.1.454.CMB.1.raw
  modified_base (288)..(293): a, c, t, g, unknown or other
  misc_feature (288)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttccgcatctgaactgtacagtctgagcgggctggcaaggcgcatagnnnnnn

SEQ ID NO: 25678 - DNA, 296 bp, Homo sapiens
  misc_feature: GYAE6OF01A44WY.25.36.D03.1.454.CMB.1.raw
  modified_base (290)..(296): a, c, t, g, unknown or other
  misc_feature (290)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctggcaaggcgcatagnnnnnnn

SEQ ID NO: 25679 - DNA, 296 bp, Homo sapiens; identical to SEQ ID NO: 25665
  misc_feature: GYAE6OF01AP72R.25.36.D03.1.454.CMB.1.raw
  modified_base (291)..(296): a, c, t, g, unknown or other
  misc_feature (291)..(296): n is a, c, g, or t

SEQ ID NO: 25680 - DNA, 290 bp, Homo sapiens
  misc_feature: GYAE6OF01C9QSI.25.36.D03.1.454.CMB.1.raw
  modified_base (281)..(281): a, c, t, g, unknown or other
  misc_feature (281)..(281): n is a, c, g, or t
  modified_base (287)..(290): a, c, t, g, unknown or other
  misc_feature (287)..(290): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattatcgacactttggccaggggacaaggtggagatcaaacgaactgtggctgcaccatctgtcttcatcttcccgccatctgaactgtacagtctgagcgggctggcaaggcncatagnnnn

SEQ ID NO: 25681 - DNA, 222 bp, Homo sapiens
  misc_feature: GYAE6OF01DCR0W.25.36.D03.1.454.CMB.1.raw
  modified_base (221)..(222): a, c, t, g, unknown or other
  misc_feature (221)..(222): n is a, c, g, or t
tcagactgtacagtcacgaccggtgctcgatttagctgcgtcacgatctctcttggggccagggttccctggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnn

SEQ ID NO: 25682 - DNA, 298 bp, Homo sapiens
  misc_feature: GYAE6OF01DOSR0.25.36.D03.1.454.CMB.1.raw
  modified_base (293)..(298): a, c, t, g, unknown or other
  misc_feature (293)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgaccaacaatataataattattcgacctactttggccaggggaccaaggtggagatacaaacgaactgtggctgcaccatctgtctcatccttccgccatctgaactgtacagtctgagcgggctggcaaggcgcatagnnnnnn

SEQ ID NO: 25683 - DNA, 298 bp, Homo sapiens
  misc_feature: GYAE6OF01A0LKC.25.36.D03.1.454.CMB.1.raw
  modified_base (295)..(298): a, c, t, g, unknown or other
  misc_feature (295)..(298): n is a, c, g, or t
tcagactgtacagtcacgaccggtgctcgatttagctgcgtcacgatctcgtcttgggatagaagttattcagcaggcacacaacagaggcagttccagaattcactctcaccatcacgcagcctgcagcctgatgattttgcaacttattactgccaacaatataataattattcgacctacttttggcctaggggaccaaggtggagatcaaacgaactgtggctgcaccatctgtcttcatcttcccgccatctgaactgtacagtctgagcgggctggcaaggcgcatagnnnn

SEQ ID NO: 25684 - DNA, 175 bp, Homo sapiens
  misc_feature: GYAE6OF01DL16K.25.36.D03.1.454.CMB.1.raw
  modified_base (172)..(175): a, c, t, g, unknown or other
  misc_feature (172)..(175): n is a, c, g, or t
tcagactgtacagtcacgaccggtgctcgatttagctgcgtcacgatctctcttgggtattcggcggagggaccaagctgaccgtcctaagtcagcccaaggctgccccctcggtcactctgttcccgccctcctcactgtacagtctgagcgggctggcaaggcgcatagnnnn

SEQ ID NO: 25685 - DNA, 478 bp, Homo sapiens
  misc_feature: GYAE6OF01BFRVB.25.36.D03.1.454.CMB.1.raw
  modified_base (473)..(478): a, c, t, g, unknown or other
  misc_feature (473)..(478): n is a, c, g, or t
tcagactgtacagtcacgaccggtgctcgatttagctgcgtcacgatctctcttgggcagtccaggggagggcctgaagtgggtcggcctcatgagaccgagggcctctggagggacagtggagcatgacgcgtctctgatgggcaggttcagcctctcaagggacgactctaaagccatcgcctatctgcaaatgaccagcctgacagtcgaagactcagccatctattattgtgcgagactgcctgtctctgattcggggacttattggacgaactacttcacttattcccacatggacgttttggggcaaggggaccacggtcatcgtctcctccacctccaccaagggcccatcggtcttccccctggcaccctcctccaagacgcacctctggggcacagcggccctgggctgcctggtcaggactacttccactgtacagtctgagcgggctggcaaggcgcatagnnnnnn

SEQ ID NO: 25686 - DNA, 292 bp, Homo sapiens
  misc_feature: GYAE6OF01CWPY9.25.36.D03.1.454.CMB.1.raw
  modified_base (290)..(292): a, c, t, g, unknown or other
  misc_feature (290)..(292): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttcccgccatctgaactgtacagtctgagcgggctggcaaggcgcatagnnn

SEQ ID NO: 25687 - DNA, 500 bp, Homo sapiens
  misc_feature: GYAE6OF01AYP02.25.36.D03.1.454.CMB.1.raw
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggagcgtggtccagcctgggagtccctgagactctcctgtgaagcctctggatttagttcagtggttctggcatgcactgggtccgcaggctcgaggcaaggggccgagtggtggcagttatagcacatgatggaagttcngaatattangcagactccgtgaaggccattcaccatctccagagacaattcccggaatattgtagtacttaggaatggtcagcctgagagtcgaggactcggctcgtgtattctgtgacgtagagtgggagtggtgtaagg

SEQ ID NO: 25688 - DNA, 296 bp, Homo sapiens; identical to SEQ ID NO: 25665
  misc_feature: GYAE6OF01ACK7R.25.36.D03.1.454.CMB.1.raw
  modified_base (291)..(296): a, c, t, g, unknown or other
  misc_feature (291)..(296): n is a, c, g, or t

SEQ ID NO: 25689 - DNA, 171 bp, Homo sapiens
  misc_feature: GYAE6OF01DI05E.25.36.D03.1.454.CMB.1.raw
  modified_base (171)..(171): a, c, t, g, unknown or other
  misc_feature (171)..(171): n is a, c, g, or t
tcagactgtacagtcacgaccggtgctcgatttagctgcgtcacgatctctcttgggtattcggcggagggaccaagctgaccgtcctaagtcagcccaaggctgcccctcggtcactctgttcccgccctcctcactgtacagtctgagcgggctggcaaggcgcatagn

SEQ ID NO: 25690 - DNA, 296 bp, Homo sapiens
  misc_feature: GYAE6OF01DEBFW.25.36.D03.1.454.CMB.1.raw
  modified_base (289)..(296): a, c, t, g, unknown or other
  misc_feature (289)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatacaaacgaactgtggctgcaccatctgtcttcatcttccgcatctgaactgtacagtctgagcgggctggcaggcgcatagnnnnnnnn

SEQ ID NO: 25691 - DNA, 295 bp, Homo sapiens
  misc_feature: GYAE6OF01BKLRM.25.36.D03.1.454.CMB.1.raw
  modified_base (291)..(295): a, c, t, g, unknown or other
  misc_feature (291)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcgcatagnnnnn

SEQ ID NO: 25692 - DNA, 372 bp, Homo sapiens
  misc_feature: GYAE6OF01ATGR3.25.36.D03.1.454.CMB.1.raw
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (309)..(310): a, c, t, g, unknown or other
  misc_feature (309)..(310): n is a, c, g, or t
  modified_base (312)..(372): a, c, t, g, unknown or other
  misc_feature (312)..(372): n is a, c, g, or t
tcagactgtacagtcacgaccggtgctcgatttagctgcgtcacgattcgtctcttgggatagaagttattcagcaggcacacaacacgaggcagttcccagaagttcactctcaccatcagcagcctgcagcctgatgattttgcaacttattactgccaacaatactaataattattcgaccacttttggcccaggggaccaaggtcggagatcaaacgaactgtaggctgcaccatcctgtacttcatcttcccgccatcctggaactgtacagtctgancgggntggcaaggcgcatagnangcnngnnnnnnnnnnnnnnnnnnnnnnnnnnnnnnnnnnnnnnnnnnnnnnnnnnnnnnnnnnnnn

SEQ ID NO: 25693 - DNA, 316 bp, Homo sapiens
  misc_feature: GYAE6OF01DJ3I2.25.36.D03.1.454.CMB.1.raw
  modified_base (297)..(316): a, c, t, g, unknown or other
  misc_feature (297)..(316): n is a, c, g, or t
tcagactgtacagtcacgaccggtgctcgatttagctgcgtcacgatctctcttgggatagaagttattcagcaggccacacaacagaggcagttccagaattcactctcaccatcagcagcctgcagcctgatgattttcgctaacttattactgaccaacaatataataattattcgaccacttttggaccaggggaccaaggtggagatcaaacgactgtggctgcaccatctgtcttcatcttcccgccatctgaactgtacagtctgagtcgggtctggcaaggcgcatagnnnnnnnnnnnnnnnnnnnn

SEQ ID NO: 25694 - DNA, 293 bp, Homo sapiens
  misc_feature: GYAE6OF01BMDGB.25.36.D03.1.454.CMB.1.raw
  modified_base (290)..(293): a, c, t, g, unknown or other
  misc_feature (290)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctggcaaggcgcatagnnnn

SEQ ID NO: 25695 - DNA, 292 bp, Homo sapiens
  misc_feature: GYAE6OF01C3G83.25.36.D03.1.454.CMB.1.raw
  modified_base (290)..(292): a, c, t, g, unknown or other
  misc_feature (290)..(292): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctggcaaggcgcatagnnn

SEQ ID NO: 25696 - DNA, 302 bp, Homo sapiens
  misc_feature: GYAE6OF01AUAKS.25.36.D03.1.454.CMB.1.raw
  modified_base (290)..(302): a, c, t, g, unknown or other
  misc_feature (290)..(302): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaacgaactgtggctgcaccatctgtcttcatcttcccgccatctgaactgtacagtctgagcgggctggcaaggcgcatagnnnnnnnnnnnnn

SEQ ID NO: 25697 - DNA, 293 bp, Homo sapiens
  misc_feature: GYAE6OF01B004Z.25.36.D03.1.454.CMB.1.raw
  modified_base (289)..(293): a, c, t, g, unknown or other
  misc_feature (289)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtgagatcaaacgaactgtggctgcaccatctgtcttcatcttcccgccatctgaactgtacagtctgagcgggctggcaaggcgcatagnnnnn

SEQ ID NO: 25698 - DNA, 294 bp, Homo sapiens; identical to SEQ ID NO: 25662
  misc_feature: GYAE6OF01CU7D4.25.36.D03.1.454.CMB.1.raw
  modified_base (291)..(294): a, c, t, g, unknown or other
  misc_feature (291)..(294): n is a, c, g, or t

SEQ ID NO: 25699 - DNA, 294 bp, Homo sapiens
  misc_feature: GYAE6OF01B87JH.25.36.D03.1.454.CMB.1.raw
  modified_base (290)..(294): a, c, t, g, unknown or other
  misc_feature (290)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtgagatcaaacgaactgtggctgcaccatctgtcttcatcttcccgccatctgaactgtacagtctgagcgggctggcaaggcgcatagnnnnn

SEQ ID NO: 25700 - DNA, 371 bp, Homo sapiens
  misc_feature: GYAE6OF01DVKYQ.25.36.D03.1.454.CMB.1.raw
  modified_base (318)..(321): a, c, t, g, unknown or other
  misc_feature (318)..(321): n is a, c, g, or t
  modified_base (323)..(371): a, c, t, g, unknown or other
  misc_feature (323)..(371): n is a, c, g, or t
tcagactgtacagtcacgaccggtgctcgatttagctgcgtcacgagttcgtctcttgggatagaagttattcagccaggcacacaacagaggcagttccagaattcactcttcaccatcagcagcctgcagccgtgatgattttgcgaacgttattactgccgaacaatattaattaaatttattacgacctacttttggcctaggggaccaaggtggagatcaaacgaactgtaggctgccaccatctgtcttcatccttcccgaccatcctgaactgtacagtactgacgcgggctgggacaaggcgcaagtagnnnntnnnnnnnnnnnnnnnnnnnnnnnnnnnnnnnnnnnnnnnnnnnnnnnnn

SEQ ID NO: 25701 - DNA, 302 bp, Homo sapiens
  misc_feature: GYAE6OF01B8UE7.25.36.D03.1.454.CMB.1.raw
  modified_base (290)..(302): a, c, t, g, unknown or other
  misc_feature (290)..(302): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcggctggcaaggcgcatagnnnnnnnnnnnnn

SEQ ID NO: 25702 - DNA, 297 bp, Homo sapiens
  misc_feature: GYAE6OF01CXZF3.25.36.D03.1.454.CMB.1.raw
  modified_base (291)..(297): a, c, t, g, unknown or other
  misc_feature (291)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcgcatagnnnnnnn

SEQ ID NO: 25703 - DNA, 297 bp, Homo sapiens
  misc_feature: GYAE6OF01C1USB.25.36.D03.1.454.CMB.1.raw
  modified_base (291)..(297): a, c, t, g, unknown or other
  misc_feature (291)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatccttccgccatctgaactgtacagtctgagcgggctggcaaggcgcatagnnnnnnn

SEQ ID NO: 25704 - DNA, 292 bp, Homo sapiens
  misc_feature: GYAE6OF01CS72Q.25.36.D03.1.454.CMB.1.raw
  modified_base (289)..(292): a, c, t, g, unknown or other
  misc_feature (289)..(292): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgatttgcaacttattactgccaacaatataataattattcgaccactttggccaggggaccaaggtggagatacaaacgaactgtggctgcaccatctgtcttcatcttccgccatctgaactgtacagtctgagcgggctggcaaggcgcatagnnnn

SEQ ID NO: 25705 - DNA, 297 bp, Homo sapiens
  misc_feature: GYAE6OF01BBH6C.25.36.D03.1.454.CMB.1.raw
  modified_base (285)..(285): a, c, t, g, unknown or other
  misc_feature (285)..(285): n is a, c, g, or t
  modified_base (291)..(297): a, c, t, g, unknown or other
  misc_feature (291)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcncatagnnnnnnn

SEQ ID NO: 25706 - DNA, 299 bp, Homo sapiens
  misc_feature: GYAE6OF01EALBH.25.36.D03.1.454.CMB.1.raw
  modified_base (285)..(285): a, c, t, g, unknown or other
  misc_feature (285)..(285): n is a, c, g, or t
  modified_base (292)..(299): a, c, t, g, unknown or other
  misc_feature (292)..(299): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttcccgccatctgaactgtacagtctgagcgggctggcaagggcncgatagnnnnnnnn

SEQ ID NO: 25707 - DNA, 295 bp, Homo sapiens
  misc_feature: GYAE6OF01CMO3W.25.36.D03.1.454.CMB.1.raw
  modified_base (289)..(295): a, c, t, g, unknown or other
  misc_feature (289)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttccgccatctgaactgtacagtctgagcggctggcaaggcgcatagnnnnnnn

SEQ ID NO: 25708 - DNA, 302 bp, Homo sapiens
  misc_feature: GYAE6OF01CRHN6.25.36.D03.1.454.CMB.1.raw
  modified_base (294)..(302): a, c, t, g, unknown or other
  misc_feature (294)..(302): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtgagatacaaacgaactgtggactgcaccatctgtcttcatccttcccgcatcctgaactgtacagtctgaggcgggctggcaaggcgcatagnnnnnnnnn

SEQ ID NO: 25709 - DNA, 296 bp, Homo sapiens; identical to SEQ ID NO: 25665
  misc_feature: GYAE6OF01EKP7D.25.36.D03.1.454.CMB.1.raw
  modified_base (291)..(296): a, c, t, g, unknown or other
  misc_feature (291)..(296): n is a, c, g, or t

SEQ ID NO: 25710 - DNA, 315 bp, Homo sapiens
  misc_feature: GYAE6OF01C4BJ9.25.36.D03.1.454.CMB.1.raw
  modified_base (278)..(278): a, c, t, g, unknown or other
  misc_feature (278)..(278): n is a, c, g, or t
  modified_base (293)..(293): a, c, t, g, unknown or other
  misc_feature (293)..(293): n is a, c, g, or t
  modified_base (298)..(315): a, c, t, g, unknown or other
  misc_feature (298)..(315): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgcaacttattactgccaacaatataataattattcgacctacttttggccaggggaccgaaggtggagatacgaaacggaactgtggctgcaccatctgtcttcattccttcccgccatctgaactgtacagtctagngcggctgcaaggctnatagnnnnnnnnnnnnnnnnnn

SEQ ID NO: 25711 - DNA, 577 bp, Homo sapiens
  misc_feature: GYAE6OF01CPREP.25.36.D03.1.454.CMB.1.raw
  modified_base (303)..(303): a, c, t, g, unknown or other
  misc_feature (303)..(303): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtgtccccaggagggacagtcactctcacctgtgcttccagcgctgggtcagtcaccagtgagaaccatccaaaactggttccagcagaaacctggacaaccacccagggcactgatttanggtgacaaactaaaaaacactacttggaacccctcgcccggttctcacggctccctcgttggggcaaagctgccctgacactgtcagactgtgcagcctggaggacgagggctagacctaccactgcctgctctcctctgggtggtgcgtttgggtgtttacgggcggacgggacctaaacgtcggtaacccgtccgtggggtccaacggtaccccgaagggtcccgtccgtccccccgtgggtaccctaaccgttccgtcggtttcccccccg

SEQ ID NO: 25712 - DNA, 294 bp, Homo sapiens
  misc_feature: GYAE6OF01CEYFS.25.36.D03.1.454.CMB.1.raw
  modified_base (289)..(294): a, c, t, g, unknown or other
  misc_feature (289)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccagggaccaaggtgagatcaaacgaactgtggctgcaccatctgtcttcatcttcccgccatctgaactgtacagtctgagcgggctggcaaggcgcatagnnnnnn

SEQ ID NO: 25713 - DNA, 296 bp, Homo sapiens; identical to SEQ ID NO: 25678
  misc_feature: GYAE6OF01BR8UF.25.36.D03.1.454.CMB.1.raw
  modified_base (290)..(296): a, c, t, g, unknown or other
  misc_feature (290)..(296): n is a, c, g, or t

SEQ ID NO: 25714 - DNA, 326 bp, Homo sapiens
  misc_feature: GYAE6OF01BM51J.25.36.D03.1.454.CMB.1.raw
  modified_base (318)..(326): a, c, t, g, unknown or other
  misc_feature (318)..(326): n is a, c, g, or t
tcagactgtacagtcacgaccggtgctcgatttagctgcgtcacgatctctcttgggatagaagttattcagcaggcacacaacagaggcagttccagaattcactcctcaccatcagcagcctgcagcctgatgtattttgactaactttattactgaccaaacaataataaattaattattcgacctacttttcggaccgaggggaccaagggtggagatacaaacgaactgtggctgcaccatctgtcttcattccttcccgctatctagaactgtacagtctggacggcgggtctggacgaaggcgcaagtagnnnnnnnnn

SEQ ID NO: 25715 - DNA, 307 bp, Homo sapiens
  misc_feature: GYAE6OF01A42GG.25.36.D03.1.454.CMB.1.raw
  modified_base (293)..(307): a, c, t, g, unknown or other
  misc_feature (293)..(307): n is a, c, g, or t
tcagactgtacagtcacgaccggtgctcgatttagctgcgtcacgatctctcttgggatagaagttattcagcaggcacacaacagaggcagttccgagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaacctgtacagtctgagcgggctggcaaggcgcatagnnnnnnnnnnnnnnn

SEQ ID NO: 25716 - DNA, 294 bp, Homo sapiens; identical to SEQ ID NO: 25699
  misc_feature: GYAE6OF01CHRY5.25.36.D03.1.454.CMB.1.raw
  modified_base (290)..(294): a, c, t, g, unknown or other
  misc_feature (290)..(294): n is a, c, g, or t

SEQ ID NO: 25717 - DNA, 505 bp, Homo sapiens
  misc_feature: GYAE6OF01CASNS.25.36.D03.1.454.CMB.1.raw
  modified_base (405)..(405): a, c, t, g, unknown or other
  misc_feature (405)..(405): n is a, c, g, or t
  modified_base (427)..(427): a, c, t, g, unknown or other
  misc_feature (427)..(427): n is a, c, g, or t
  modified_base (442)..(442): a, c, t, g, unknown or other
  misc_feature (442)..(442): n is a, c, g, or t
  modified_base (499)..(499): a, c, t, g, unknown or other
  misc_feature (499)..(499): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaatagtttgctactggtaccagcagctcccagaaaccggccccaagctcctcatctataggaatgatcagcggccctcagggatacctgaccgattctctggctcgaagtctggctcctcggcctccctggccatcagtcgggctccggtccgaggatgaggctgaatnttactgtgctagtttggatgcngtctgagtggtccgnggtgtcggcggaggacagctgccgtcaggtcagcccaaggcctcgccccctcggtcncgtccg

SEQ ID NO: 25718 - DNA, 289 bp, Homo sapiens
  misc_feature: GYAE6OF01DZXT6.25.36.D03.1.454.CMB.1.raw
  modified_base (286)..(289): a, c, t, g, unknown or other
  misc_feature (286)..(289): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacactttggccaggggaccaaggtgagatcaaacgactgtggctgcaccatctgtcttcatcttcccgcatctgaactgtacagtctgagcgggctggcaaggcgcatagnnnn

SEQ ID NO: 25719 - DNA, 301 bp, Homo sapiens
  misc_feature: GYAE6OF01CWXM8.25.36.D03.1.454.CMB.1.raw
  modified_base (220)..(220): a, c, t, g, unknown or other
  misc_feature (220)..(220): n is a, c, g, or t
  modified_base (289)..(289): a, c, t, g, unknown or other
  misc_feature (289)..(289): n is a, c, g, or t
  modified_base (292)..(301): a, c, t, g, unknown or other
  misc_feature (292)..(301): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttatactgaccaacaatataataattattcgacctactttggccgagggaccaaggtggagatacaaacgaactgnggctgcacatctgtctcatccttcccgcatctagaacctgacagtctgagtcgggctggcaaggcgcanagnnnnnnnnnn

SEQ ID NO: 25720 - DNA, 494 bp, Homo sapiens
  misc_feature: GYAE6OF01DZC5F.25.36.D03.1.454.CMB.1.raw
  modified_base (202)..(202): a, c, t, g, unknown or other
  misc_feature (202)..(202): n is a, c, g, or t
  modified_base (301)..(301): a, c, t, g, unknown or other
  misc_feature (301)..(301): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggcgagtcagggcattagcaattattagcctggtatcaaacagaaaccgagggagagttcctaagctcctgatctangctgcctcctacgttacactcagggtcccattctcggttcaggcgcagtgaatcgtgggaacagagttcactctcactatcagcagcctgcagcctagaagattggttgtactaactttattactgtaacaaaagttataatactcgtccctctcacgtttcggacgggtaggaacagggtagagtgtaaacg

SEQ ID NO: 25721 - DNA, 297 bp, Homo sapiens; identical to SEQ ID NO: 25702
  misc_feature: GYAE6OF01E2BCV.25.36.D03.1.454.CMB.1.raw
  modified_base (291)..(297): a, c, t, g, unknown or other
  misc_feature (291)..(297): n is a, c, g, or t

SEQ ID NO: 25722 - DNA, 523 bp, Homo sapiens
  misc_feature: GYAE6OF01EX2YT.25.36.D03.1.454.CMB.1.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (400)..(400): a, c, t, g, unknown or other
  misc_feature (400)..(400): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccggcgagtcagggcattagcaattatttagcctggtatcaacagaaaccagggagagttcctaagctccngatctatgctgcctccacgttacactcgacgggtcccatctcgtcagcgcagtgaatcgtagggacagacgttcactctacactatcagcagcctgcacgctgaagtnttagttagaccttaattacttactagtaacaaaagttataaactacgtccgtacccctacttacctaccgtttacgggaccgggtaacggggtaacctaagggtacggagtaacgtaaaccgg

SEQ ID NO: 25723 - DNA, 295 bp, Homo sapiens
  misc_feature: GYAE6OF01DKJRG.25.36.D03.1.454.CMB.1.raw
  modified_base (288)..(295): a, c, t, g, unknown or other
  misc_feature (288)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattatcgacactttggccaggggaccaaggtggagatcaaacgaactgtggctgcaccatctgtcttcatcttcccgccatctgaactgtacagtctgagcgggctggcaaggcgcatagnnnnnnnn

SEQ ID NO: 25724 - DNA, 670 bp, Homo sapiens
  misc_feature: GYAE6OF01BVVV9.25.36.D03.1.454.CMB.1.raw
  modified_base (182)..(182): a, c, t, g, unknown or other
  misc_feature (182)..(182): n is a, c, g, or t
  modified_base (185)..(185): a, c, t, g, unknown or other
  misc_feature (185)..(185): n is a, c, g, or t
  modified_base (301)..(301): a, c, t, g, unknown or other
  misc_feature (301)..(301): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcgtggtttcgcgtagctcttaagaggtntcntgtcaggtgcacgtggtggagtgtgggggagcgttggtccaggcctgggacggtccctggagctctccgtagtcgaagtcctagtggtaattttaggtttcaggttcggttttcgnggactagtcgccgtacggtccggtcccgacgacggtcctaccggagggacggacgggggtccggtaggttgggtacggacgtaaggttacgacgacaacgtagtaggtagttaggtaactttcgtaagtaaattagttagccggtactacggtaccgtacggtacggtaacgggtccttaacttaccgaacctacttccgacgaagaacgtaaccgtaaccgttaccggtaaattagtttacgtaagttaaccggttaaggtaacgttcggtaaccacgtacgtaaggtagtacggtacggacgtcgtacggtcgttcgtagttactacggtgtacgacggtaagtggtagggtagttggtaaggtacg

SEQ ID NO: 25725 - DNA, 297 bp, Homo sapiens; identical to SEQ ID NO: 25702
  misc_feature: GYAE6OF01C6PQM.25.36.D03.1.454.CMB.1.raw
  modified_base (291)..(297): a, c, t, g, unknown or other
  misc_feature (291)..(297): n is a, c, g, or t

SEQ ID NO: 25726 - DNA, 296 bp, Homo sapiens
  misc_feature: GYAE6OF01ADZSB.25.36.D03.1.454.CMB.1.raw
  modified_base (290)..(296): a, c, t, g, unknown or other
  misc_feature (290)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcggctggcaaggcgcatagnnnnnnn

SEQ ID NO: 25727 - DNA, 295 bp, Homo sapiens
  misc_feature: GYAE6OF01AFFFG.25.36.D03.1.454.CMB.1.raw
  modified_base (290)..(295): a, c, t, g, unknown or other
  misc_feature (290)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttccgccatctgaactgtacagtctgagcgggctggcaaggcgcatagnnnnnn

SEQ ID NO: 25728 - DNA, 294 bp, Homo sapiens
  misc_feature: GYAE6OF01ECWXX.25.36.D03.1.454.CMB.1.raw
  modified_base (281)..(281): a, c, t, g, unknown or other
  misc_feature (281)..(281): n is a, c, g, or t
  modified_base (287)..(294): a, c, t, g, unknown or other
  misc_feature (287)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatctccgcatctgaactgtacagtctgagcggctggcaaggcncatagnnnnnnnn

SEQ ID NO: 25729 - DNA, 299 bp, Homo sapiens
  misc_feature: GYAE6OF01D7L9T.25.36.D03.1.454.CMB.1.raw
  modified_base (291)..(299): a, c, t, g, unknown or other
  misc_feature (291)..(299): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcgcatagnnnnnnnnn

SEQ ID NO: 25730 - DNA, 294 bp, Homo sapiens
  misc_feature: GYAE6OF01D13OU.25.36.D03.1.454.CMB.1.raw
  modified_base (267)..(267): a, c, t, g, unknown or other
  misc_feature (267)..(267): n is a, c, g, or t
  modified_base (289)..(294): a, c, t, g, unknown or other
  misc_feature (289)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctactttggccgaggggaccaaggtggagatacaaacgaactgtggctgcaccatctgtcttcatcctccgcatctgaactgtacagtcngagcggctggcaaggcgcatgnnnnnn

SEQ ID NO: 25731 - DNA, 294 bp, Homo sapiens
  misc_feature: GYAE6OF01ATGNL.25.36.D03.1.454.CMB.1.raw
  modified_base (289)..(294): a, c, t, g, unknown or other
  misc_feature (289)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcacatctgtcttcatcttcccgcatctgaactgtacagtctgagcgggctggcaaggcgcatagnnnnnn

SEQ ID NO: 25732 - DNA, 298 bp, Homo sapiens
  misc_feature: GYAE6OF01BBUJ8.25.36.D03.1.454.CMB.1.raw
  modified_base (269)..(269): a, c, t, g, unknown or other
  misc_feature (269)..(269): n is a, c, g, or t
  modified_base (290)..(298): a, c, t, g, unknown or other
  misc_feature (290)..(298): n is a, c, g, or t
tcagactgtacagtcacgaccggtgctcgatttagctgcgtcacgatctcgtcttgggatagaagttattcagcaggcacacaacagaggcagttccagaattcactctcaccatcagcagcctgcagcctgatgattttgcaacttattactgccaacaatataataattattcgaccacttttggccaggggaccaaggtgagatcaaacgaactgtggctgcaccatctgtcttcatcttcccgcatctgaactgtacagtctgancgggctggcaaggcgcatagnnnnnnnnn

SEQ ID NO: 25733 - DNA, 298 bp, Homo sapiens; identical to SEQ ID NO: 25661
  misc_feature: GYAE6OF01AMIIZ.25.36.D03.1.454.CMB.1.raw
  modified_base (291)..(298): a, c, t, g, unknown or other
  misc_feature (291)..(298): n is a, c, g, or t

SEQ ID NO: 25734 - DNA, 293 bp, Homo sapiens
  misc_feature: GYAE6OF01ALNRC.25.36.D03.1.454.CMB.1.raw
  modified_base (290)..(293): a, c, t, g, unknown or other
  misc_feature (290)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtgtctgcaccatctgtcttcatcttcccgcatctgaactgtacagtctgagcgggctggcaaggcgcatagnnnn

SEQ ID NO: 25735 - DNA, 295 bp, Homo sapiens; identical to SEQ ID NO: 25691
  misc_feature: GYAE6OF01DTAXY.25.36.D03.1.454.CMB.1.raw
  modified_base (291)..(295): a, c, t, g, unknown or other
  misc_feature (291)..(295): n is a, c, g, or t

SEQ ID NO: 25736 - DNA, 490 bp, Homo sapiens
  misc_feature: GYAE6OF01B3XGW.25.36.D03.1.454.CMB.1.raw
  modified_base (266)..(266): a, c, t, g, unknown or other
  misc_feature (266)..(266): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
  modified_base (467)..(467): a, c, t, g, unknown or other
  misc_feature (467)..(467): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggagcgtggtccagcctgggagtccctgagactctcctgtgaagcctntggatttagtttcagtggttctggcatgcacgtgggtccgccaggctccgaggcaaggggccgagtggttggcagttanagcacatgatggaattcngaatatatgcagactcgtgaaggcatcacatctcaganacactccgaanttgtgtactggaatggtcagcctagagagtcgaggactcggctctgtattcgtgngcgagagtgggagtggtagtagg

SEQ ID NO: 25737 - DNA, 293 bp, Homo sapiens
  misc_feature: GYAE6OF01AE3HQ.25.36.D03.1.454.CMB.1.raw
  modified_base (288)..(293): a, c, t, g, unknown or other
  misc_feature (288)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatctccgcatctgaactgtacagtctgagcgggctggcaaggcgcatagnnnnnn

SEQ ID NO: 25738 - DNA, 293 bp, Homo sapiens
  misc_feature: GYAE6OF01C50KR.25.36.D03.1.454.CMB.1.raw
  modified_base (290)..(293): a, c, t, g, unknown or other
  misc_feature (290)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttcccgccatctgaactgtacagtctgagcgggctggcaaggcgcatagnnnn

SEQ ID NO: 25739 - DNA, 518 bp, Homo sapiens
  misc_feature: GYAE6OF01BQBJB.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattattagcctggtatcaacagaaaccgagggagagttcctaagctcctgatctatgctgcctccacgttacactcagggtcccatctcggtcagcggcagtgatcgtgggacagagttcactctcactatcagcacgcctgcacgcctagaagtattgttagacttaacttattactagtaactaaaagttataaacttaccgtcgtccccttctcctaccgtttcgggaccgggtaacgggacccgtaaagggtcggaagtagtaaacccgg

SEQ ID NO: 25740 - DNA, 578 bp, Homo sapiens
  misc_feature: GYAE6OF01C8RHX.25.36.D03.1.454.CMB.1.raw
  modified_base (518)..(518): a, c, t, g, unknown or other
  misc_feature (518)..(518): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtccgtcggggaccccccgggcaggagggtctccatctcttgttctgggagcagctccgacgtcggaaattaagtttgtctactggtaccagcagctcccagaaccgccccaagctcctcatctataggaatgatcagccggcctcaggactacctgaccgatttctctggctcgtaagtctggcctccgtccggcctccccgtggccctatcgaggtcggccgttcccgggtccgagggatggaggtcttagaaattattacgtgtcgtcgtaggtttgggatcgccgtagtcgtggagttcggtcccggtaggttcggttcgggngggtaacgggacccgaaggtcctacggtacccgtaccgtaggtccacggcccgtaacggg

SEQ ID NO: 25741 - DNA, 855 bp, Homo sapiens
  misc_feature: GYAE6OF01B0M98.25.36.D03.1.454.CMB.1.raw
  modified_base (201)..(201): a, c, t, g, unknown or other
  misc_feature (201)..(201): n is a, c, g, or t
tcagactgtacagtcacgaccggtgctcgatttagctgcgtcacggagtctctcttggggagagaaggacacggattcaaggacaatactccaggccatggccggcctccctcgtcctcctcaccctcctcactcactgtgcacggtctgggccagtctgtgctgacctcacgccacctcacgtgtcgtcgggaccccggnacggtacgggtcctccgaattccgtcgtttcgttctggggaatctacgtccgtcccggacgtacggtaaattaaggtttcgtacgttaacgttggttaaccaaggtcgtacgtcctacccgaacggaaaacccggccccaaaggtcccttacctacacttaccgtaagttacgggaactcgaacttaccgacggtcccggtaccccttaggtaacgggtaaccttacccggtcgtaaccgtaacgtttccgtcgtcgggtcctacgggtaacgttcgtaccggtccttacccggtaccgggtaccctttccccggtacggtaccccttacgttacccggtaacggggtttccgggtaccccgtttaccccgggggttaaccgggtaacgggtaacgttacggggtaaacgggttacctttaacggttaaacgtttacctttttaaccggtacggtttacgtaccggttaacgggttttacgggaactttccggtacccgttacggttccgtaggtaacggtttccgggtaccggtacgggttacgggttaccgggaacgggaacgggtaccgaggtccgtacggtaacccggtacgtacgggtcaccggtaccgtaacggtccttcccggtaccccgttggtccctccgttccg

SEQ ID NO: 25742 - DNA, 297 bp, Homo sapiens
  misc_feature: GYAE6OF01AO3W5.25.36.D03.1.454.CMB.1.raw
  modified_base (290)..(297): a, c, t, g, unknown or other
  misc_feature (290)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatctcccgccatctgaactgtacagtctgagcgggctggcaaggcgcatagnnnnnnnn

SEQ ID NO: 25743 - DNA, 295 bp, Homo sapiens; identical to SEQ ID NO: 25656
  misc_feature: GYAE6OF01BR2YO.25.36.D03.1.454.CMB.1.raw
  modified_base (290)..(295): a, c, t, g, unknown or other
  misc_feature (290)..(295): n is a, c, g, or t

SEQ ID NO: 25744 - DNA, 544 bp, Homo sapiens
  misc_feature: GYAE6OF01EOKX6.25.36.D03.1.454.CMB.1.raw
  modified_base (206)..(206): a, c, t, g, unknown or other
  misc_feature (206)..(206): n is a, c, g, or t
  modified_base (340)..(340): a, c, t, g, unknown or other
  misc_feature (340)..(340): n is a, c, g, or t
  modified_base (397)..(397): a, c, t, g, unknown or other
  misc_feature (397)..(397): n is a, c, g, or t
tcagactgtacagtcacgaccggtgctcgatttagctgcgtcacgatctctcttgggggcagcagtctctctcagtcaggacacagcatggacatgagggtccctgctcagctcctgggactcctgctgctctggcctcccaggtaccagctgtgacatccagatcgacccagtcctccttccttcctgtctgcatctggtggganacagagtcaccatcacttggccggcgagtcaggacattaccaattatttagcctggtatcaacacaaaccaggaaataccctaagcctcctgatctattctgcatccaccttgcagtccagggtcccatcctcncttcagcggctagtgatcgtgggacagtatttcagtctacaccatctagcacgcctncgacgccgtagaagtattctgacctaaccttattaacttcgtaactaacttaaatttaacggtaacttaccccttcttacccgttcccgttacggaccgggtacggaaacccgtacgggtagtagaactaacgaaacgtaaaccggg

SEQ ID NO: 25745 - DNA, 296 bp, Homo sapiens
  misc_feature: GYAE6OF01DT4VT.25.36.D03.1.454.CMB.1.raw
  modified_base (290)..(296): a, c, t, g, unknown or other
  misc_feature (290)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaaggtggagatcaaacgaactgtggctgcaccatctgtcttcatcttcccgcatctgactgtacagtctgagcgggctggcaaggcgcatagnnnnnnn

SEQ ID NO: 25746 - DNA, 314 bp, Homo sapiens
  misc_feature: GYAE6OF01BPITN.25.36.D03.1.454.CMB.1.raw
  modified_base (255)..(255): a, c, t, g, unknown or other
  misc_feature (255)..(255): n is a, c, g, or t
  modified_base (296)..(314): a, c, t, g, unknown or other
  misc_feature (296)..(314): n is a, c, g, or t
tcagactgtacagtcacgaccggtgctcgatttagctgcgtcacgatctctcgttgggatagaagttattcagcaggcacacaacagaggcagttccagaattcactctcaccatcagcagcctgcagcctgatgattttgcaacttattactgccaacaatataataattattcgacacttttggccaggggaccaaggtggagatcaaacgtaactgtaggctgacaccatctgtcttcatcttcccgcatcngaactgtacagtctgagcgggctggctaaggcgcagtacgnnnnnnnnnnnnnnnnnnn

SEQ ID NO: 25747 - DNA, 294 bp, Homo sapiens
  misc_feature: GYAE6OF01D29U8.25.36.D03.1.454.CMB.1.raw
  modified_base (290)..(294): a, c, t, g, unknown or other
  misc_feature (290)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctggcaaggcgcatagnnnnn

SEQ ID NO: 25748 - DNA, 298 bp, Homo sapiens; identical to SEQ ID NO: 25661
  misc_feature: GYAE6OF01BAT2D.25.36.D03.1.454.CMB.1.raw
  modified_base (291)..(298): a, c, t, g, unknown or other
  misc_feature (291)..(298): n is a, c, g, or t

SEQ ID NO: 25749 - DNA, 297 bp, Homo sapiens
  misc_feature: GYAE6OF01B9194.25.36.D03.1.454.CMB.1.raw
  modified_base (284)..(284): a, c, t, g, unknown or other
  misc_feature (284)..(284): n is a, c, g, or t
  modified_base (290)..(297): a, c, t, g, unknown or other
  misc_feature (290)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaggcncatagnnnnnnnn

SEQ ID NO: 25750 - DNA, 357 bp, Homo sapiens
  misc_feature: GYAE6OF01ANFD7.25.36.D03.1.454.CMB.1.raw
  modified_base (294)..(297): a, c, t, g, unknown or other
  misc_feature (294)..(297): n is a, c, g, or t
  modified_base (299)..(299): a, c, t, g, unknown or other
  misc_feature (299)..(299): n is a, c, g, or t
  modified_base (301)..(302): a, c, t, g, unknown or other
  misc_feature (301)..(302): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (311)..(357): a, c, t, g, unknown or other
  misc_feature (311)..(357): n is a, c, g, or t
tcagactgtacagtcacgaccggtgctcgatttagctgcgtcacgagtctctcttgggatagaagttattcagccaggcacacaacagaggcagttccagaattcactctcaccatcagcagcctgcagcctgatgattttgcaacttattactgccaacaatataataattattcgaccacttttggccagggaccaaggtggagatcaaacgaactgtggctgcaccatctgtcttcatcttcccgcatctgaacctgtacagtctgagcggggctggcaaggcgcatacgnnnnancnngntancngnnnnnnnnnnnnnnnnnnnnnnnnnnnnnnnnnnnnnnnnnnnnnnn

SEQ ID NO: 25751 - DNA, 503 bp, Homo sapiens
  misc_feature: GYAE6OF01BKRN1.25.36.D03.1.454.CMB.1.raw
  modified_base (202)..(202): a, c, t, g, unknown or other
  misc_feature (202)..(202): n is a, c, g, or t
tcagactgtacagtcacgaccggtgctcgatttagctgcgtcacgatctctcttgggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccggcgagtcaggacattaccaattatttagcctggtatcaacacaaaccagggaaagtccctaagctcctgatctattctgcatccaccttgcagtcaggggtcccatctcgcttcagcggcagtggatctgggacagatttcagtctcaccatccaccgcctgcagcctgacgatcttgacaacttattactgtacaaactatcacagtcgtccccgtactacgttttcggcccgacggggacccacgtaggtacgaaccgtacaaagggaacctacggg

SEQ ID NO: 25752 - DNA, 297 bp, Homo sapiens; identical to SEQ ID NO: 25702
  misc_feature: GYAE6OF01EZNZE.25.36.D03.1.454.CMB.1.raw
  modified_base (291)..(297): a, c, t, g, unknown or other
  misc_feature (291)..(297): n is a, c, g, or t

SEQ ID NO: 25753 - DNA, 506 bp, Homo sapiens
  misc_feature: GYAE6OF01AY0D0.25.36.D03.1.454.CMB.1.raw
  modified_base (200)..(200): a, c, t, g, unknown or other
  misc_feature (200)..(200): n is a, c, g, or t
  modified_base (340)..(340): a, c, t, g, unknown or other
  misc_feature (340)..(340): n is a, c, g, or t
tcagactgtacagtcacgaccggtgctcgatttagctgcgtcacgatctctcttgggggcagcagtctctctcagtcaggacacagcatggacatgagggtccctgctcagctcctgggactcctgctgctctggctcccaggtaccagctgtgacatccagatgacccagtctccttcttctgtctgcatctgtggganacagagtcaccatcacttgccggcgagtcaggacattaccaattattagcctggtatcaacacaaaccagggaaagtccctaagctcctgatctattctgctatccaccttgcagtcaggggtccatctcgcttcagcgnacgtgatcgtgggacagatttcagtctcaccatccaaccggctcgcacgctgacgatcttgctaacttattactgtacaaactatacactagtcgtaccccgtactaggttttacggccaacggggtaccaacgagttacggaacctacgaaaacggtactacggg

SEQ ID NO: 25754 - DNA, 298 bp, Homo sapiens
  misc_feature: GYAE6OF01AI06A.25.36.D03.1.454.CMB.1.raw
  modified_base (292)..(298): a, c, t, g, unknown or other
  misc_feature (292)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatccttcccgccatctgaactgtacagtctgagcgggctggcaaggcgcatagnnnnnnn

SEQ ID NO: 25755 - DNA, 309 bp, Homo sapiens
  misc_feature: GYAE6OF01DAR54.25.36.D03.1.454.CMB.1.raw
  modified_base (302)..(309): a, c, t, g, unknown or other
  misc_feature (302)..(309): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtatttgactaacttattactgaccaaacaataataataattattcgacctactttggccgagggaccaaggtggagatacaaacgaactgtggctgcaccatctgtctcatccttcccgcatctagaactgtacagtctgaggcgggctggacaagggcgcaagtagnnnnnnnn

SEQ ID NO: 25756 - DNA, 513 bp, Homo sapiens
  misc_feature: GYAE6OF01DADY0.25.36.D03.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (327)..(327): a, c, t, g, unknown or other
  misc_feature (327)..(327): n is a, c, g, or t
  modified_base (415)..(415): a, c, t, g, unknown or other
  misc_feature (415)..(415): n is a, c, g, or t
  modified_base (475)..(475): a, c, t, g, unknown or other
  misc_feature (475)..(475): n is a, c, g, or t
  modified_base (500)..(500): a, c, t, g, unknown or other
  misc_feature (500)..(500): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaatagttgtctactggtaccagcagctccagaaccggccccaagctcctcatctataggaatgatcagccggcctnaggatacctgaccgattctctggctcgaagtctggcctccgtccggccctcccgtggccctatccaggtcgggcctccggtccgaggntggagctagaatattctgtgctaggttggatcgctagtctgagtggccgtaggtgtcggnggaggcagctcgaccgtcgtagtcncgcccgtaacggg

SEQ ID NO: 25757 - DNA, 331 bp, Homo sapiens
  misc_feature: GYAE6OF01EGGEB.25.36.D03.1.454.CMB.1.raw
  modified_base (296)..(297): a, c, t, g, unknown or other
  misc_feature (296)..(297): n is a, c, g, or t
  modified_base (299)..(331): a, c, t, g, unknown or other
  misc_feature (299)..(331): n is a, c, g, or t
tcagactgtacagtcacgaccggtgctcgatttagctgcgtcacgatctcgtcttgggatagaagttattcagcaggcacacaacgagaggcagttccagaattcactctcaccatcagcagccttgccagccctgatggacttttgcaacttattactgccaacaatataataattattcgaccactttggccaggggaccaaggtggagatacaaacgaactgtggcctgcaccatctgtctcatctccgcatctgaactgacagtctgagcgggctggcaagggcgcatagcnncnnnnnnnnnnnnnnnnnnnnnnnnnnnnnnnnn

SEQ ID NO: 25758 - DNA, 502 bp, Homo sapiens
  misc_feature: GYAE6OF01ESNHY.25.36.D03.1.454.CMB.1.raw
  modified_base (191)..(191): a, c, t, g, unknown or other
  misc_feature (191)..(191): n is a, c, g, or t
  modified_base (389)..(389): a, c, t, g, unknown or other
  misc_feature (389)..(389): n is a, c, g, or t
  modified_base (496)..(496): a, c, t, g, unknown or other
  misc_feature (496)..(496): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaatagtttgctactggtaccagcagctcccagaaacggccccaagctcctcatctataggaatgatcagcggccctcagggatacctgaccgattctctggctcgaagtctggctcctcggccctccctggccatcagtggctccggtcgaggntgagctgaatattactgtgcagtttggatgcagtctgagtggtccgaggtgttcggcggagggaccaggctggccgtcgtaggtcagcccaggctcgcccctggtcncgtccg

SEQ ID NO: 25759 - DNA, 296 bp, Homo sapiens
  misc_feature: GYAE6OF01CTULQ.25.36.D03.1.454.CMB.1.raw
  modified_base (291)..(296): a, c, t, g, unknown or other
  misc_feature (291)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtggagatcaaacgaactgtggctgcaccatctgtcttcatcttccgccatctgaactgtacagtctgagcgggctggcaaggcgcatagnnnnnn

SEQ ID NO: 25760 - DNA, 295 bp, Homo sapiens; identical to SEQ ID NO: 25691
  misc_feature: GYAE6OF01BDFMG.25.36.D03.1.454.CMB.1.raw
  modified_base (291)..(295): a, c, t, g, unknown or other
  misc_feature (291)..(295): n is a, c, g, or t

SEQ ID NO: 25761 - DNA, 300 bp, Homo sapiens
  misc_feature: GYAE6OF01CQKVM.25.36.D03.1.454.CMB.1.raw
  modified_base (291)..(300): a, c, t, g, unknown or other
  misc_feature (291)..(300): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgaagatgttgcaacttattactgtacaaaaatttgacagtgacccgtggatgttcggccagggaccaaggtggacatcaaacgaactgtggctgcaccatctgtcttcattcttcccgcatctgaactgtacagtctgagcgggctggcaaggcgcatagnnnnnnnnnn

SEQ ID NO: 25762 - DNA, 295 bp, Homo sapiens; identical to SEQ ID NO: 25691
  misc_feature: GYAE6OF01CA1DT.25.36.D03.1.454.CMB.1.raw
  modified_base (291)..(295): a, c, t, g, unknown or other
  misc_feature (291)..(295): n is a, c, g, or t

SEQ ID NO: 25763 - DNA, 477 bp, Homo sapiens
  misc_feature: GYAE6OF01A62XO.25.36.D03.1.454.CMB.1.raw
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (422)..(422): a, c, t, g, unknown or other
  misc_feature (422)..(422): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (470)..(470): a, c, t, g, unknown or other
  misc_feature (470)..(470): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggcgagtcagggcattagcaattatttagcctggtatcaaacagaaaccaggagagttcctaaagctcctgatctatgctgcctccacgttacactcagggtcccatctcggttcagcggcagtgaatctgggacagagttcacgtctnactancagcagcctgcagcctgaagatgttgactaacttattactagtanaaaagtataatactncccctntcacttcggacgtacggacgaagtggngataacg

SEQ ID NO: 25764 - DNA, 295 bp, Homo sapiens; identical to SEQ ID NO: 25691
  misc_feature: GYAE6OF01A3336.25.36.D03.1.454.CMB.1.raw
  modified_base (291)..(295): a, c, t, g, unknown or other
  misc_feature (291)..(295): n is a, c, g, or t

SEQ ID NO: 25765 - DNA, 299 bp, Homo sapiens; identical to SEQ ID NO: 25729
  misc_feature: GYAE6OF01DC4CP.25.36.D03.1.454.CMB.1.raw
  modified_base (291)..(299): a, c, t, g, unknown or other
  misc_feature (291)..(299): n is a, c, g, or t

SEQ ID NO: 25766 - DNA, 297 bp, Homo sapiens
  misc_feature: GYAE6OF01CICDX.25.36.D03.1.454.CMB.1.raw
  modified_base (292)..(297): a, c, t, g, unknown or other
  misc_feature (292)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatacaaacgaactgtggctgcaccatctgtcttcatcttcccgccatctgaactgtacagtctgagcgggctggcaaggcgcatagnnnnnn

SEQ ID NO: 25767 - DNA, 474 bp, Homo sapiens
  misc_feature: GYAE6OF01A9W9D.25.36.D03.1.454.CMB.1.raw
  modified_base (445)..(445): a, c, t, g, unknown or other
  misc_feature (445)..(445): n is a, c, g, or t
  modified_base (470)..(474): a, c, t, g, unknown or other
  misc_feature (470)..(474): n is a, c, g, or t
tcagactgtacagtcacgaccggtgctcgatttagctgcgtcacgatctctcttgggcagtccaggggagggcctgaagtgggtcggcctcatgagaccgagggcctctggagggacagtggagcatgacgcgtctctgatgggcaggttcagcctctcaagggacgactctaaagccatcgcctatctgcaaatgaccagcctgacagtcgaagactcagccatctattattgtgcgagactgcctgtctctgatttcggggacttattggacgaactactttcacttattcccacatggacgtttggggcaaggggaccacggtcatcgtctcctccacctccaccaagggcccatcggtcttccccctggccaccctcctccaagacgcacctctggggcacagcgccctgggctgcctggcaaggctacttccactgtacngtctgagcggctgcaggcgcatagnnnnn

SEQ ID NO: 25768 - DNA, 294 bp, Homo sapiens; identical to SEQ ID NO: 25662
  misc_feature: GYAE6OF01BPOJF.25.36.D03.1.454.CMB.1.raw
  modified_base (291)..(294): a, c, t, g, unknown or other
  misc_feature (291)..(294): n is a, c, g, or t

SEQ ID NO: 25769 - DNA, 293 bp, Homo sapiens
  misc_feature: GYAE6OF01C7FMZ.25.36.D03.1.454.CMB.1.raw
  modified_base (238)..(238): a, c, t, g, unknown or other
  misc_feature (238)..(238): n is a, c, g, or t
  modified_base (288)..(293): a, c, t, g, unknown or other
  misc_feature (288)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgtacaaaaatttgacagtgacccgtggatgttcggcccagggaccaaggtggacatcaaacgaactgtggctgcaccatctgtctnatctccgccatctgactgtacagtctgagcgggctggcaaggcgcatagnnnnnn

SEQ ID NO: 25770 - DNA, 293 bp, Homo sapiens
  misc_feature: GYAE6OF01CIQ96.25.36.D03.1.454.CMB.1.raw
  modified_base (291)..(293): a, c, t, g, unknown or other
  misc_feature (291)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcgcatagnnn

SEQ ID NO: 25771 - DNA, 488 bp, Homo sapiens
  misc_feature: GYAE6OF01AUTA9.25.36.D03.1.454.CMB.1.raw
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagactgtacagtcacgaccggtgctcgatttagctgcgtcacgatctctcttggggcagaagtctctctcagtcaggacacagcatggacatgagggtccctgctcagctcctgggactcctgctgctctggctcccagataccagatgtgacgtccagatgacccagtctccatcctccctgtctgcatctgttgagacagaatcagcatcacttgccggcgagtcaggcattagcaattattagcctggtatcaacagaaaccagggagagttcctaagctcctgatctatgctgcctccacgttacactcagggtcccatctcgttcagcggcagtgaatcgtgggacagacgttcactctacactatcagcagcctgcagctgaacntgtgntaacttactatagtacaaaagttataatacctgtacccctctcctacgtttccggacggtaacgggaccctaagggtcgaagagtaaccg

SEQ ID NO: 25772 - DNA, 556 bp, Homo sapiens
  misc_feature: GYAE6OF01CK9UJ.25.36.D03.1.454.CMB.1.raw
tcagactgtacagtcacgaccggtgctcgatttagctgcgtcacgatctctcttggggtctggcgccaggggtcccttccaatatcagcaccatggcctggactcctctctttctgttcctcctcacttgctgccccagggtccaaatctcagactgtggtgactcaggagccctcactgactgtgtccccaggagggacagtcactctcacctgtgcttccagcgctgggtcagtcaccagtgagaaccatccaaactggttccagcagaaacctggacaaccacccagggcactgatttatggtgacaaactaaaaaacactacttcggacccctgcccggttctcgacggctccctccgttggggcaaagctagccctgacactgtcagatgtgcagccgtgacggacgaggctagactaccacgtcgcctgctcctccgttcgtcggtggtcgtcgtttgggtcgttcgggcggacgggacaacgtcgaccgtcgtcgggtcacgcccgaacggcctacgccccgtcgtaccaccgttcgtccgttcccccg

SEQ ID NO: 25773 - DNA, 376 bp, Homo sapiens
  misc_feature: GYAE6OF01DSI83.25.36.D03.1.454.CMB.1.raw
  modified_base (315)..(315): a, c, t, g, unknown or other
  misc_feature (315)..(315): n is a, c, g, or t
  modified_base (318)..(320): a, c, t, g, unknown or other
  misc_feature (318)..(320): n is a, c, g, or t
  modified_base (322)..(326): a, c, t, g, unknown or other
  misc_feature (322)..(326): n is a, c, g, or t
  modified_base (328)..(330): a, c, t, g, unknown or other
  misc_feature (328)..(330): n is a, c, g, or t
  modified_base (332)..(376): a, c, t, g, unknown or other
  misc_feature (332)..(376): n is a, c, g, or t
tcagactgtacagtcacgaccggtgctcgatttagctgcgtcacgattcttcgtcttgggattagaagttattcagcaggcacacaacagaggcaagttaccagaattcactctcaccatcagcagcctgcacgcctgagtgattttcgcaacttattactgccaacaataagtaaataagttaacttcgacctacgttttggaccgaggggaccaaggtcggagactacaaaacgaactgtggctgcaccgatctgtcttcatccttccgccatctgaactggacagtctgagcggctggcgaagcgcagtagnatnnngnnnnncnnnannnnnnnnnnnnnnnnnnnnnnnnnnnnnnnnnnnnnnnnnnnnn

SEQ ID NO: 25774 - DNA, 292 bp, Homo sapiens
  misc_feature: GYAE6OF01CWVOS.25.36.D03.1.454.CMB.1.raw
  modified_base (287)..(292): a, c, t, g, unknown or other
  misc_feature (287)..(292): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacactttggccaggggaccaaggtggagatcaaagaactgtggctgcaccatctgtcttcatcttcccgccatctgaactgtacagtctgagcggctggcaaggcgcatagnnnnnn

SEQ ID NO: 25775 - DNA, 172 bp, Homo sapiens
  misc_feature: GYAE6OF01B2OUT.25.36.D03.1.454.CMB.1.raw
  modified_base (172)..(172): a, c, t, g, unknown or other
  misc_feature (172)..(172): n is a, c, g, or t
tcagactgtacagtcacgaccggtgctcgatttagctgcgtcacgatctctcttgggtattcggcggagggaccaagctgaccgtcctaagtcagcccaaggctgccccctcggtcactctgttcccaccctcctcactgtacagtctgagcgggctggcaaggcgcatagn

SEQ ID NO: 25776 - DNA, 297 bp, Homo sapiens; identical to SEQ ID NO: 25702
  misc_feature: GYAE6OF01BABHP.25.36.D03.1.454.CMB.1.raw
  modified_base (291)..(297): a, c, t, g, unknown or other
  misc_feature (291)..(297): n is a, c, g, or t

SEQ ID NO: 25777 - DNA, 294 bp, Homo sapiens; identical to SEQ ID NO: 25699
  misc_feature: GYAE6OF01AXRZV.25.36.D03.1.454.CMB.1.raw
  modified_base (290)..(294): a, c, t, g, unknown or other
  misc_feature (290)..(294): n is a, c, g, or t

SEQ ID NO: 25778 - DNA, 296 bp, Homo sapiens
  misc_feature: GYAE6OF01DX70G.25.36.D03.1.454.CMB.1.raw
  modified_base (289)..(296): a, c, t, g, unknown or other
  misc_feature (289)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtctcatcttcccgccatctgaactgtacagtctgagcgggctggcaaggcgcatagnnnnnnnn

SEQ ID NO: 25779 - DNA, 556 bp, Homo sapiens
  misc_feature: GYAE6OF01AQ0I2.25.36.D03.1.454.CMB.1.raw
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcgggtgagggtctcctgtaaggtctccggaagcagtgtgttcgtcagacatacactcacctgggtccggcaggcctctggactgggcctgaggtgggtgggaacatcaaccgccacgccggaacaacgagaggtcgcacgatcagtttcagggcaggacgtctaccgttttccgtaggactaacgtccgacgggcgcaagtatacagtgaactctacaatcgacctgcgtagtttcgacgacgacggtccgtatattacgtgtgcgagaaagtacgtccgtgtacctagaaacgtcgacgacgtcgtacggacctccggaccccggtggggacccgg

SEQ ID NO: 25780 - DNA, 298 bp, Homo sapiens
  misc_feature: GYAE6OF01BV198.25.36.D03.1.454.CMB.1.raw
  modified_base (291)..(298): a, c, t, g, unknown or other
  misc_feature (291)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggcctaggggaccaaggtggagatcaaacgaactgtggactgcaccatctgtcttcatcttcccgcatctgaactgtacagtctgagcggctggcaaggcgcatagnnnnnnnn

SEQ ID NO: 25781 - DNA, 293 bp, Homo sapiens; identical to SEQ ID NO: 25770
  misc_feature: GYAE6OF01CNBVT.25.36.D03.1.454.CMB.1.raw
  modified_base (291)..(293): a, c, t, g, unknown or other
  misc_feature (291)..(293): n is a, c, g, or t

SEQ ID NO: 25782 - DNA, 326 bp, Homo sapiens
  misc_feature: GYAE6OF01B86A1.25.36.D03.1.454.CMB.1.raw
  modified_base (297)..(297): a, c, t, g, unknown or other
  misc_feature (297)..(297): n is a, c, g, or t
  modified_base (304)..(305): a, c, t, g, unknown or other
  misc_feature (304)..(305): n is a, c, g, or t
  modified_base (307)..(326): a, c, t, g, unknown or other
  misc_feature (307)..(326): n is a, c, g, or t
tcagactgtacagtcacgaccggtgctcgatttagctgcgtcacgaagtctctcttgggatagaagttattcagcaggcacacaacagaggcagttccagaattcactctcaccatcagcagcctgcagcctgatgattttgcaactatactgcaacatataataatattcgaccacttttggcctaggggaccaaggtggaagatacaaaacgaactgtggctgcaaccatctgtacttcaatccttcccgccaatctgaaacctggtaccagtcctgagtcgggctggcaaggcncataggnntnnnnnnnnnnnnnnnnnnnn

SEQ ID NO: 25783 - DNA, 349 bp, Homo sapiens
  misc_feature: GYAE6OF01EYI4S.25.36.D03.1.454.CMB.1.raw
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (310)..(315): a, c, t, g, unknown or other
  misc_feature (310)..(315): n is a, c, g, or t
  modified_base (317)..(349): a, c, t, g, unknown or other
  misc_feature (317)..(349): n is a, c, g, or t
tcagactgtacagtcacgaccggtgctcgatttagctgcgtcacggtagtctcgtcttgggatagaagttattcagcaggcacacaacagaggcagttccagaattcactctcaccatcagcagcctgcagccttgatgtatttttgctaacttattactgccaacaatataataattattcgacctacttttggccaggggaccaaggtcgggagatacaaacgactgtggctgccaccatcgtgtcttcatccttcccgcatctgaactgtacagttcngacgcgggctgggcaagggcncatagttnnnnnncnnnnnnnnnnnnnnnnnnnnnnnnnnnnnnnnn

SEQ ID NO: 25784 - DNA, 590 bp, Homo sapiens
  misc_feature: GYAE6OF01EF2Y5.25.36.D03.1.454.CMB.1.raw
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcaactggtggagtcgtgggggaggcttggtacagcctggcacggcccctgagactctcctgtgcagcctgtggattcactttgatgtattatgccatgcacgtcgggtccgcaagctacgaggggacggcctggagtgggtctcgaggttattaggtggaataggtggagcgtagtaggctagtggcggtacttcgtggtacggaacgggcctaagttccaacctattcctaccgagaacgaaccaacgacccaaacggtaacctcccgtagtacgtaccgtacgaactaaagtacgaactacgtactacggagacgtcgtaggaggaccgtaccggttccgttagttaacgttacgtagtagtaaacttaaaagtttacgttaacgg

SEQ ID NO: 25785 - DNA, 524 bp, Homo sapiens
  misc_feature: GYAE6OF01DZOXC.25.36.D03.1.454.CMB.1.raw
  modified_base (386)..(386): a, c, t, g, unknown or other
  misc_feature (386)..(386): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggaagcagtgtgttcgtcagacatacactcacctgggtccggcaggcctctggaactgggcctgagtgggtggacaatacgaccgccacgccggaacaacagagtcgcacatcagtttcagggcagagtcaccttttccgnggacaagtccacgggcgcagtatacatgaatctcaatgactgcgtatttgcggacacggccgtatattactgtgacgagaaagagtccgtagcctacaaaacgtcgaacagctggcctccgaccccgtggggacccgg

SEQ ID NO: 25786 - DNA, 300 bp, Homo sapiens
  misc_feature: GYAE6OF01B5JRC.25.36.D03.1.454.CMB.1.raw
  modified_base (286)..(286): a, c, t, g, unknown or other
  misc_feature (286)..(286): n is a, c, g, or t
  modified_base (291)..(300): a, c, t, g, unknown or other
  misc_feature (291)..(300): n is a, c, g, or t
tcagactgtacagtcacgaccggtgctcgatttagctgcgtcacgatcgtcctacttgggactagaagttattcacgcaggcacacaacagaggcagttccagaattcactctcaccatcagcagcctgcagcctgatgattttgcaacttattactgccaacaatataataattattcgaccacttttggccaggggaccaaggtgagatcaaacgaactgtggctgcaccatctgtcttcatcttccgcatctgaactgtacagtctgagcggctggcaaggcncatgnnnnnnnnnn

SEQ ID NO: 25787 - DNA, 296 bp, Homo sapiens
  misc_feature: GYAE6OF01BO14C.25.36.D03.1.454.CMB.1.raw
  modified_base (290)..(296): a, c, t, g, unknown or other
  misc_feature (290)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatccttcccgcatctgaactgtacagtctgagcggctggcaaggcgcatagnnnnnnn

SEQ ID NO: 25788 - DNA, 295 bp, Homo sapiens; identical to SEQ ID NO: 25656
  misc_feature: GYAE6OF01B7N9N.25.36.D03.1.454.CMB.1.raw
  modified_base (290)..(295): a, c, t, g, unknown or other
  misc_feature (290)..(295): n is a, c, g, or t

SEQ ID NO: 25789 - DNA, 314 bp, Homo sapiens
  misc_feature: GYAE6OF01BAWZZ.25.36.D03.1.454.CMB.1.raw
  modified_base (251)..(251): a, c, t, g, unknown or other
  misc_feature (251)..(251): n is a, c, g, or t
  modified_base (289)..(314): a, c, t, g, unknown or other
  misc_feature (289)..(314): n is a, c, g, or t
tcagactgtacagtcacgaccggtgctcgatttagctgcgtcacgatcgtctcttgggatagaagttattcagcaggcacacaacagaggcagttccagaattcactctcaccatcagcagcctgcagcctgatgattttgcaacttattactgccaacaatataataattatcgaccacttttgccagggaccaaggtgagatacaaacgtaactgtggctgcaccatctgtcttcatcttcccgcatcngactgtacagtctgagcggctggcaaggcgcagtacgnnnnnnnnnnnnnnnnnnnnnnnnnn

SEQ ID NO: 25790 - DNA, 294 bp, Homo sapiens; identical to SEQ ID NO: 25747
  misc_feature: GYAE6OF01DH5ST.25.36.D03.1.454.CMB.1.raw
  modified_base (290)..(294): a, c, t, g, unknown or other
  misc_feature (290)..(294): n is a, c, g, or t

SEQ ID NO: 25791 - DNA, 601 bp, Homo sapiens
  misc_feature: GYAE6OF01CBVZV.25.36.D03.1.454.CMB.1.raw
  modified_base (371)..(371): a, c, t, g, unknown or other
  misc_feature (371)..(371): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggagcagctccgacgtcggaaatagttgtctactggtaccagcagctccagaaaccgccccaagctcctcatctataggatgatcagcggccctgaagggactacctgaccgtattctcgtggctcgaagtctggcctccgtcggccctcccgnggccatcgaggtcggctccggtcgaggatggacggctagtaatattacgtgtgtcgtaggtttgggatcgccgtagtcgtggtacgggttcggtaccggtacgggttcggttcggggacgggaacgggaaccgtaaggtccgtacggtacccggttaccgtagggtccgaaccggtccccgaaacgggtcccgtaccggtccccccgttcggtcccgtaccgttccccgg

SEQ ID NO: 25792 - DNA, 521 bp, Homo sapiens
  misc_feature: GYAE6OF01BOEKX.25.36.D03.1.454.CMB.1.raw
  modified_base (431)..(431): a, c, t, g, unknown or other
  misc_feature (431)..(431): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggagcgtggtccagcctgggagtccctgagactctcctgtgaagcctctggatttagttcagtggttctggcatgcacgtgggtccgccaggcctccgagggcaaggggccggagtggttggcagttatagcacatgatggaagttctagaatattatgcagactccgtgaagggccattcaccatcctccagacgacaacttcccggaactnttgtgttacttaggaaatgggtacagtcctgagagtcgaggactcgggctcgtgtattcgtgtgcgagacgtgggaggttggtagtacgg

SEQ ID NO: 25793 - DNA, 695 bp, Homo sapiens
  misc_feature: GYAE6OF01BFO7D.25.36.D03.1.454.CMB.1.raw
  modified_base (228)..(228): a, c, t, g, unknown or other
  misc_feature (228)..(228): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggnagtcgagggctattagactaatttattagcctaggtatacaacgaacgaaacggagggacgtacgttaccgaacgtccttcgtagtactacttagcgtacctccgtacccttaccgtaaccgttacaccgtaccgggtacccgggttaccctacgttccggttaccggttacgacggtccggtacgtaaggtacgtaacgttcgggtacgggaaccgtagttacggtttacccacgttctactaacttcacgacgacctacgtctcgaccacgtacgtaagaagtagttaggttacaaaccgttttaaactttcgttaaaccgttaagtaaaaccgttaaaagttaacttaaacttcccggtttacccctaccctttacgttaacccggtttacccgggttacgggggaccgggttaaaccgggaacccggttaaggggtaacggtaaccgtaacgttaaaaccggg

SEQ ID NO: 25794 - DNA, 302 bp, Homo sapiens
  misc_feature: GYAE6OF01EI2K6.25.36.D03.1.454.CMB.1.raw
  modified_base (295)..(302): a, c, t, g, unknown or other
  misc_feature (295)..(302): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaaacaataataataattattcgaccactttggccaggggaccaaaggtggagatacaaaacgaactgtggctgcaccatctgtcttcatcttcccgccatctgaactgtacagtctgagcgggctggcaaggcgcatagnnnnnnnn

SEQ ID NO: 25795 - DNA, 293 bp, Homo sapiens
  misc_feature: GYAE6OF01CKOHK.25.36.D03.1.454.CMB.1.raw
  modified_base (290)..(293): a, c, t, g, unknown or other
  misc_feature (290)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttgccaggggaccaaggtggagatcaaacgaactgtggctgcaccatctgtcttcatcttcccgccatctgaactgtacagtctgagcgggctggcaaggcgcatagnnnn

SEQ ID NO: 25796 - DNA, 754 bp, Homo sapiens
  misc_feature: GYAE6OF01DDFTG.25.36.D03.1.454.CMB.1.raw
  modified_base (249)..(249): a, c, t, g, unknown or other
  misc_feature (249)..(249): n is a, c, g, or t
tcagactgtacagtcacgaccggtgctcgatttagctgcgtcacgatctctcgttgggggcagaagtctctctcagtcaggacacagcatggacatgagggtccctgctcagctccgtgggactcctgctgctctggctcccagactaccagatgtgacgtccagactcgacccagtcctccactccctcctgtcctgctattcgtggtaggaagacagaatcgagtctactcgtacgttcggccgggngacgtcgaggactaagttagacttaagtttacgttacgtccgtaggtaactaccgaaacgaacggtaaaccgagggtaactacgttaccgtaacgccttaccgtagtacttactagtcgtccgttaccggtacccttaccgtaacggtttaacccgaccggtttaccgggtaaccgggttcccctaaggtttcccgttaccgggttaccgacggtccggtacgtaaggttacggtaaaccgttcgggtaacgggaacctacggttaccgttaccctaaccgttacctacgtaactacgtacgacggacctacgccgtcggactacgggaccgtagtaacgtcgttacggtactaaccgttaagtttaacttacgtaacgttaaacgttaaaacgttactaaaccttacccgtccccgttaccccttacgttcccggttaaccgggttccggggaaacggttacggggaaaccggttaagggtaccggaaactaacggtaaaccgg

SEQ ID NO: 25797 - DNA, 600 bp, Homo sapiens
  misc_feature: GYAE6OF01COREL.25.36.D03.1.454.CMB.1.raw
  modified_base (200)..(200): a, c, t, g, unknown or other
  misc_feature (200)..(200): n is a, c, g, or t
  modified_base (423)..(423): a, c, t, g, unknown or other
  misc_feature (423)..(423): n is a, c, g, or t
tcagactgtacagtcacgaccggtgctcgatttagctgcgtcacgatctctcttggggcagaagtctctctcagtcaggacacagcatggacatgagggtccctgctcagctcctgggactcctgctgctctggctcccagataccagatgtgacgtccagatgacccagtctccatcctcctgtctgcatctgttgganacagatcagcatcacgttgccggcgtagtcgagggtcattagactaatttattacgcctaggttaacacaaacgaacgaaaaccgaggagagttacctaagctacctgactactaatgctcgcctacctacgttacacgttcgaacgggtcctagtcgttcggtacaaggcggactaggtacgaactcgtacggactagtacgttacacttctactaacttanacgagccgaacgtcctacggactacgaccgttaagaaggtacttacgggttactaacttaactttaattaccgtaagttaacgaaaaagtattaaacctaacgtccgtaccccttacttacgtaccggtttacggacggtaacgggaaccgtaagggtacgaaagtataaaacccgg

SEQ ID NO: 25798 - DNA, 691 bp, Homo sapiens
  misc_feature: GYAE6OF01AP338.25.36.D03.1.454.CMB.1.raw
  modified_base (213)..(213): a, c, t, g, unknown or other
  misc_feature (213)..(213): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtgtccgtcggggacccccgggnaggagggtcctccattctcttgttcgtgggagcagcctccgacgtacggtaagttaagtttagttcgtacgtacggtaccgacgcgacgcctacccgaaccgaacccggaccccgaaccgacctcctccactactactaggtaagtagtatacgacgccggcccgtcgacggacgtaccgtacgtaccgtactctcgtcgtctacggggggggggggtactcgtcgtccgtccgtccgtccgtcccgtcgccgtacgtcgtacggtcggtccggtccggtccggacgggtacggtacggacggtcgtacgtaagttacgttacgttacgtcgtacgtaggtttacgggtacgtacgtccgtacggtacgtacggtacggtcggtccggtacgggttacgggttcgggtacgggacgggtaccggacggtacgtacggtaccggtaccggtacggtaccggtaccggacccggtaccgg

SEQ ID NO: 25799 - DNA, 296 bp, Homo sapiens
  misc_feature: GYAE6OF01EF7A6.25.36.D03.1.454.CMB.1.raw
  modified_base (291)..(296): a, c, t, g, unknown or other
  misc_feature (291)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgactgtggctgcaccatctgtcttcatcttcccgccatctgaactgtacagtctggagcgggctggcaaggcgcatagnnnnnn

SEQ ID NO: 25800 - DNA, 524 bp, Homo sapiens
  misc_feature: GYAE6OF01E1I9V.25.36.D03.1.454.CMB.1.raw
  modified_base (316)..(316): a, c, t, g, unknown or other
  misc_feature (316)..(316): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgtctactggtaccagcagctcccagaaacggccccaagcctcctcatctataggaatgatcagcggccctnagggatacctgaccgattctctggctcgaagtctgctcctcggcctccctggccatcagtggctccggtcgaggatgagctagaatattactgtgcgtagttggatgcagtcgtgagtggtcgtaggtcgtcggcggagggaccaagcgtaggtccgtcgtacggtcacggcccaaggtcctacgcccccgtcggtcctacgttcccg

SEQ ID NO: 25801 - DNA, 670 bp, Homo sapiens
  misc_feature: GYAE6OF01CL7VW.25.36.D03.1.454.CMB.1.raw
  modified_base (426)..(426): a, c, t, g, unknown or other
  misc_feature (426)..(426): n is a, c, g, or t
tcagactgtacagtcacgaccggtgctcgatttagctgcgtcacgatctctcgttggggggggtcacaagaggcagcgctctcgggacgtctccacatggcctgggctctgctgctcctcactctcctcactcaggacacgacgggtcctcgggcccagtctgccgtgactcagcctgcctccgtgtcgtcgggtctccgtggacagtcgactcacctattcctgcacgtggactcacgcactgattgttgacgtaggtttattacgtttgtcctccgtacgtaaccaaacgaaccacccgaacggaaccaaaaccgtaccccctaaattactactatttagacgaacggtacccaacgtaacggccggtaccctagacggttactttacaacgtcgtccttcgcgtcggcttacaagtcaggacncgaccgaccgtcccgtacctagtaacctacgttccgtacggtcgggtacctaccggaggtccgtaggacgggtacgaggtctagtaatttacttacgtcgtacttaacgtctaagtaacgtacgaacctaacactaacctaaactaaccgttcccgttacgtaccggtaccggtacgggaaccgtaccgggtaccgtaccggtccgtacgggaccaccgggaacccgccggtaacccaaccccg

SEQ ID NO: 25802 - DNA, 298 bp, Homo sapiens
  misc_feature: GYAE6OF01C6GWW.25.36.D03.1.454.CMB.1.raw
  modified_base (292)..(298): a, c, t, g, unknown or other
  misc_feature (292)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatctcccgccatctgaactgtacagtctggagcgggctggacaaggcgcatagnnnnnnn

SEQ ID NO: 25803 - DNA, 572 bp, Homo sapiens
  misc_feature: GYAE6OF01C0HVF.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtcctccatcctccctgtctgcatctgttggagacagaatcagcatcacttggccggcgagtcgagggcattagactaattatttagcctggtatacaacaagaaccgaggagagttacctaagctctgatctatcgctcgcctaccacgttacacgtcgacgggtcccagttcgtcggttcacggcgcagtagtaagtcgtcgggactagtacgttctactctacactatctagcacgcctcgcacgtctagaagtagttgttagtacttaactttacgttacttaaggtaaccttaaaagttaacttaacgttaccgtccgttacccccttacgttaccgttaccggtttccgggacgggtacgggtaaccggtaagggtacggaagtaacgtaaaccgg

SEQ ID NO: 25804 - DNA, 294 bp, Homo sapiens
  misc_feature: GYAE6OF01EI0F6.25.36.D03.1.454.CMB.1.raw
  modified_base (290)..(294): a, c, t, g, unknown or other
  misc_feature (290)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctaactgtacagtctgagcgggctggcaaggcgcatagnnnnn

SEQ ID NO: 25805 - DNA, 576 bp, Homo sapiens
  misc_feature: GYAE6OF01A9MG9.25.36.D03.1.454.CMB.1.raw
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtgtccccaggagggacagtcactctcacctgtgcttccagcgctgggtcagtcaccagtgagaaccatccaaactggttccagcagaacctggacaaccacccagggcactgatttatggtgacaactaaaaacactacttaggacccctgcccggttctcaggctccctccgttgggggcaaagctgccctgacactgtcagatgtgcagcctgaggacgaggctgactaccactgcctgcctctcctcgtgggtggtgtcgtttggggtgtttcgggacgggtacgggaacctaaacgttcggacccggttccgtggggtaccacgggtccccgaaagggcccgtaccggtccccccgtcgggtacccaccgttccgtccgttccccccgg

SEQ ID NO: 25806 - DNA, 291 bp, Homo sapiens
  misc_feature: GYAE6OF01BUNZW.25.36.D03.1.454.CMB.1.raw
  modified_base (289)..(291): a, c, t, g, unknown or other
  misc_feature (289)..(291): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcggctggcaaggcgcatagnnn

SEQ ID NO: 25807 - DNA, 298 bp, Homo sapiens
  misc_feature: GYAE6OF01CC48N.25.36.D03.1.454.CMB.1.raw
  modified_base (293)..(298): a, c, t, g, unknown or other
  misc_feature (293)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatacaaacgaactgtggctgcaccatctgtcttcatccttcccgccatctgaactgtacagtctgagcgggctggcaaggcgcatagnnnnnn

SEQ ID NO: 25808 - DNA, 708 bp, Homo sapiens
  misc_feature: GYAE6OF01EPQPV.25.36.D03.1.454.CMB.1.raw
  modified_base (195)..(195): a, c, t, g, unknown or other
  misc_feature (195)..(195): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagcccaccctcagtgtctcggggacccccgggnaggagggtctccatctcttgttctgggagcagctccgacgtcggaaatagtttgctactggtaccagcagcctacccagaaaccggccccaagcctcctcatctataggaatgatcagccggccctgagggatacctgaccgtattcctcgtggctacggaagtcgtggcctccgtccggccctcccgtggccctagtcgaggtcgggcctcccgggtaccggaggtagtggacgggtcttaggtaaacttagtttacgtggtgtaccgttagggttttcgggattcggacccgtaggttccgtgggtaaggttccgggttacccggtacggggtttccgggttaccggggaccggggtaaacgggaacccgtaaagggtcccgttaccgggtaacccccggtttacccggttaacgggttacccgaccgggtaacccccggtaaacggggttcccccgttacccgggtccccccccggtttacgggttaccccgtacccgtttacccccggg

SEQ ID NO: 25809 - DNA, 308 bp, Homo sapiens
  misc_feature: GYAE6OF01CC19O.25.36.D03.1.454.CMB.1.raw
  modified_base (295)..(308): a, c, t, g, unknown or other
  misc_feature (295)..(308): n is a, c, g, or t
tcagactgtacagtcacgaccggtgctcgatttagctgcgtcacgatctcgtcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatccttcccgccatctgaactgtacagtctggacgcgggctggcaaggcgcatagnnnnnnnnnnnnnn

SEQ ID NO: 25810 - DNA, 295 bp, Homo sapiens; identical to SEQ ID NO: 25691
  misc_feature: GYAE6OF01B1WWP.25.36.D03.1.454.CMB.1.raw
  modified_base (291)..(295): a, c, t, g, unknown or other
  misc_feature (291)..(295): n is a, c, g, or t

SEQ ID NO: 25811 - DNA, 302 bp, Homo sapiens
  misc_feature: GYAE6OF01DK6BD.25.36.D03.1.454.CMB.1.raw
  modified_base (296)..(302): a, c, t, g, unknown or other
  misc_feature (296)..(302): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatacaaacgaactgtggctgcaccatctgtcttcatccttcccgccatctagaacctgtacagtctgaggcgggctggcaaggcgcatagnnnnnnn

SEQ ID NO: 25812 - DNA, 299 bp, Homo sapiens
  misc_feature: GYAE6OF01DMSHC.25.36.D03.1.454.CMB.1.raw
  modified_base (294)..(299): a, c, t, g, unknown or other
  misc_feature (294)..(299): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgccaacaatataataattattcgacctactttggccaggggaccaagggtggagatacaaacgaactgtggctgcaccatctgtcttcatcttcccgccatctgaactgtacagtctgagcgggctggcaaggcgcatagnnnnnn

SEQ ID NO: 25813 - DNA, 319 bp, Homo sapiens
  misc_feature: GYAE6OF01EQ5VP.25.36.D03.1.454.CMB.1.raw
  modified_base (297)..(319): a, c, t, g, unknown or other
  misc_feature (297)..(319): n is a, c, g, or t
tcagactgtacagtcacgaccggtgctcgatttagctgcgtcacgagtctctcttgggatagaagttattcagcaggcacacaacagaggcagttccagaattcactctcaccatcagcagcctgcagcctgatgattttgcaacttattactgccaacaatactaataattattacgaccacttttggccaggggaccaaggtggagtatcaaacgaactgtaggcctagcaccatctgtcttcatcttacccgcatctgaactgtacgtctgagcggctggcaaggccgcatagnnnnnnnnnnnnnnnnnnnnnnn

SEQ ID NO: 25814 - DNA, 516 bp, Homo sapiens
  misc_feature: GYAE6OF01A5YEW.25.36.D03.1.454.CMB.1.raw
  modified_base (411)..(411): a, c, t, g, unknown or other
  misc_feature (411)..(411): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattattagcctggtatcaacagaaaccagggagagttacctaagctcctgatctatgctgcctccacgttacactcacgggtcccatctcggttcagcggcagtgaatcgtggacagtagttcactctacactactcagcacgcctcgcacgcgtagaagtatgttnacgttaacttacttacgtagtaactaaaagtattaactactccgtccccttactccttacgttccgggacggtacggaacgtaagggtaggtagagtaaacccgg

SEQ ID NO: 25815 - DNA, 296 bp, Homo sapiens
  misc_feature: GYAE6OF01AJKI0.25.36.D03.1.454.CMB.1.raw
  modified_base (286)..(286): a, c, t, g, unknown or other
  misc_feature (286)..(286): n is a, c, g, or t
  modified_base (292)..(296): a, c, t, g, unknown or other
  misc_feature (292)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatccttcccgccatctgaactgtacagtctgagcgggctggcaaggcncatagnnnnn

SEQ ID NO: 25816 - DNA, 295 bp, Homo sapiens
  misc_feature: GYAE6OF01DE2OU.25.36.D03.1.454.CMB.1.raw
  modified_base (238)..(238): a, c, t, g, unknown or other
  misc_feature (238)..(238): n is a, c, g, or t
  modified_base (290)..(295): a, c, t, g, unknown or other
  misc_feature (290)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttnatcttccgccatctgaactgtacagtctgagcgggctggcaaggcgcatagnnnnnn

SEQ ID NO: 25817 - DNA, 298 bp, Homo sapiens
  misc_feature: GYAE6OF01ERVKQ.25.36.D03.1.454.CMB.1.raw
  modified_base (293)..(298): a, c, t, g, unknown or other
  misc_feature (293)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaagggcgcagtagnnnnnn

SEQ ID NO: 25818 - DNA, 301 bp, Homo sapiens
  misc_feature: GYAE6OF01B2RFU.25.36.D03.1.454.CMB.1.raw
  modified_base (295)..(301): a, c, t, g, unknown or other
  misc_feature (295)..(301): n is a, c, g, or t
tcagactgtacagtcacgaccggtgctcgatttagctgcgtcacgatctctcttgggatagaagttattcagcaggcacacaacagatgcagttccagaattcactctcaccatcagcagcctgcagcctgatgattttgcaacttattactgccaacaatataataattattcgacctactttggccaaggggaccaaggtggagatacaaacgaactgtggctgcaccatctgtcttcatccttcccgccatctgaactgtacagtctggagcgggctggcaaggcgcatagnnnnnnn

SEQ ID NO: 25819 - DNA, 299 bp, Homo sapiens
  misc_feature: GYAE6OF01DMFNM.25.36.D03.1.454.CMB.1.raw
  modified_base (252)..(252): a, c, t, g, unknown or other
  misc_feature (252)..(252): n is a, c, g, or t
  modified_base (293)..(299): a, c, t, g, unknown or other
  misc_feature (293)..(299): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctactttggccaggggaccaaggtggagatacaaacgaactgtggctgcaccatctgtctcatctcccgccatcngaactgtacagtctgagtcgggctggacgaaggcgcatagnnnnnnn

SEQ ID NO: 25820 - DNA, 577 bp, Homo sapiens
  misc_feature: GYAE6OF01BPK09.25.36.D03.1.454.CMB.1.raw
  modified_base (442)..(442): a, c, t, g, unknown or other
  misc_feature (442)..(442): n is a, c, g, or t
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgctaggttattactttgtctcctggtaccaacaacacccaggacaaacgccccctaaacttatacatttatgacggaccacgtaacgccggtaccctcgaggtacgtttactaagtccgtcttctctcggtcctaccaagtctggcacgcacggccctccctgacaacttctcgtcgggcctccgaggcctaggaggtacgngtctgtatttactactgcctactacattacgacgacactactaccaactaaccgtcccgtacgttccggaccgtagggacccgtagggtccctaccggtccgtggacccaccggaccaaccggcccctaaacccg

SEQ ID NO: 25821 - DNA, 741 bp, Homo sapiens
  misc_feature: GYAE6OF01EX21D.25.36.D03.1.454.CMB.1.raw
  modified_base (317)..(317): a, c, t, g, unknown or other
  misc_feature (317)..(317): n is a, c, g, or t
tcagactgtacagtcacgaccggtgctcgatttagctgcgtcacgagtctctcttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcaactggtggagtcgtgggggagcttggtacagcctggcaggcccctgagactctcctgtgcagcctctggacttcacctttgactgatttatgcctatgcacgtcgggtccgnaagctaccgagggaacggcctggacgtgggtctcgtaggttattaggttaggaattagggtaggtagacgtaagttacggcttaagtggaccgggtaacttcgtgttagggaaacgggtccgtaacgtttccaacccgtaagttcccttacccgaaaggtaaccggtaaccctaaacccggtaacccgaaaacggtaaacccctttccccgttaagggttaaccttacccggttacggaacccggttaaagggttaccgggaaaccgttacggtaccgtaaccggtaacccgaaacccgtttaggaaccgttaaccggaaccccgttaccccgggttaccgttttaacggttaaaccgtttttaaggtttaccgggttaagggtttaacggggttaaaacgggtttccggggttttaaacgggg

SEQ ID NO: 25822 - DNA, 619 bp, Homo sapiens
  misc_feature: GYAE6OF01CEEYL.25.36.D03.1.454.CMB.1.raw
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
tcagactgtacagtcacgaccggtgctcgatttagctgcgtcacgatctctcgttgggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgcactggactcagcactgatgttgcaggttattacttgtctcatggtaccaacaacacccaggccaaaacgcccccaaaattatctattttanacgaggccaactaacgcggccctanaggtagtttcaatcgctttcnctggctcaagtctggcagcacggcctcctgacaatctacgtcgggctaccgaggccgtaggaaggaccggaaggtctacggtaatttacgtttaacgtcggtaccttaacttaccgtaagttaacgttacgggaacctaactaacttaacctaaaccgtaaaaccgttcccgttaccgtttacccgggaccgttacgggacccgtaacgggtcccaaccggttcccgtacgggttaccgaccgtacccgaagtaaccccccg

SEQ ID NO: 25823 - DNA, 296 bp, Homo sapiens
  misc_feature: GYAE6OF01A7O65.25.36.D03.1.454.CMB.1.raw
  modified_base (292)..(296): a, c, t, g, unknown or other
  misc_feature (292)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctggagcgggctggcaaggcgcatagnnnnn

SEQ ID NO: 25824 - DNA, 544 bp, Homo sapiens
  misc_feature: GYAE6OF01BCOTL.25.36.D03.1.454.CMB.1.raw
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggaagcagtgtgttcgtcagacatacactcacctgggtccggcaggcctctggaactgggcctggagtggggtggacaagtcgaaccgccacgaccggaacaacgagacggtcgcacatcagtttcagggcagagtcctacgtttcgnggacaagtccacgggcncagtatacatgaatcgtacaatcgacctgcgtatttgcggtacacgggtccgtattactacgtgtagacgaagaaagagtccgtagcctaagaaacgtcgaacagtctaggcctaccggccccgtggggacccg

SEQ ID NO: 25825 - DNA, 295 bp, Homo sapiens; identical to SEQ ID NO: 25691
  misc_feature: GYAE6OF01B69GL.25.36.D03.1.454.CMB.1.raw
  modified_base (291)..(295): a, c, t, g, unknown or other
  misc_feature (291)..(295): n is a, c, g, or t

SEQ ID NO: 25826 - DNA, 678 bp, Homo sapiens
  misc_feature: GYAE6OF01DC1LG.25.36.D03.1.454.CMB.1.raw
  modified_base (208)..(208): a, c, t, g, unknown or other
  misc_feature (208)..(208): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctgggacccccgggnagagggtctccatctcttgttctgggagcagctcgacgtcggaaataagttgtctactggtaccagcagctcccagaaaccggccccaagctcctcatctataggaatgatcagcggcctcaggatactcgaccgtattctctggtctcgaagtctggtcctaccgttccggcccttccccgtcgggccctactcgacgggttcgggtccgttcccgggtacccggtacgggattcggacgggtcttaagggtaactttaacgtttaccgtttgggtcgtaccggttagggtttttacggggaattcggacccgttaggttccgttagggtacggtttacggggtccccggggttaacggggttggggtttacccgggggacgggggtaacgggggaacccgaaacgggtccggttacggtaacccggttacccggttagggttaccaccgggtccccgtaaacccgggg

SEQ ID NO: 25827 - DNA, 583 bp, Homo sapiens
  misc_feature: GYAE6OF01EBOWX.25.36.D03.1.454.CMB.1.raw
  modified_base (183)..(183): a, c, t, g, unknown or other
  misc_feature (183)..(183): n is a, c, g, or t
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcggtggtttcgcgtagcgtcttaagaggngtcatgtcngtgcncgtggtggagtcgtggggagcgtggtccaggccgtgggacggtccctgacggactcctcgttgtagaacgtcctgtaggtatttgtttngttcggttntggcatgctacgtcggccgacngcgccaggngaacgggcgtagtggtcggntagttanagcangtgagtacgtatgtagtattagtcacgtagtacgtaccgtcggtacggacgtacgtactaccacctagtaccgagacgtaacgtacgtaccgtaccgtaattgttagtaggttaacgtacggtagtcgtacacggtgtacggtagcgtacggacggtctacggttcgtacgtttatacgttgtcggtacgacggttcggaggtaggggtgttaggttaggtacgg

SEQ ID NO: 25828 - DNA, 307 bp, Homo sapiens
  misc_feature: GYAE6OF01DK074.25.36.D03.1.454.CMB.1.raw
  modified_base (295)..(307): a, c, t, g, unknown or other
  misc_feature (295)..(307): n is a, c, g, or t
tcagactgtacagtcacgaccggtgctcgatttagctgcgtcacgagtctctcttgggatagaagttattcagcaggcacaacaacagaggcagttccagaattcactctcaccatcagcagcctgcagcctgatgattttgcaacttattactgccaacaatataataattattcgaccacttttggccaggggaccaaggtggagatacaaacgaactgtggctgcaccatcctgtctcatcttcccgccaatctgaactgtacagtctgagcgggctggcaaggcgcatagnnnnnnnnnnnnn

SEQ ID NO: 25829 - DNA, 540 bp, Homo sapiens
  misc_feature: GYAE6OF01ETYYG.25.36.D03.1.454.CMB.1.raw
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagactctcctgtgaagcctctggtatttagtttcagttggttctggcatgcactggggtccnccgaggctccgaggcgaaggggccggagtggttggcagttanagcacatgagtggaagtttcagaatattatgcagactccggtagaacgggccattcacctatctccagacgactaacgttcccggaactagttgtagtacgttaggaatggtacagtccgtagagagtcggacggtactcggcttcgtgtattcgtgtgacgtagagtcggggaggttgtaggttacgg

SEQ ID NO: 25830 - DNA, 321 bp, Homo sapiens
  misc_feature: GYAE6OF01CCKYJ.25.36.D03.1.454.CMB.1.raw
  modified_base (164)..(164): a, c, t, g, unknown or other
  misc_feature (164)..(164): n is a, c, g, or t
  modified_base (299)..(321): a, c, t, g, unknown or other
  misc_feature (299)..(321): n is a, c, g, or t
tcagactgtacagtcacgaccggtgctcgatttagctgcgtcacgatcgtcgtcttgggatagaagttattcagcaggcacacaacagaggcagttccagaattcactctcaccatcagcagcctgcagcctgattgtattttgctaacttattactgaccaanaatataatattatcgactactttgccgagggaccaagtgagatcgaaacggactgtacggctcgcacctatctgtctctatcttcccgcatcctagaactgtacatcgtgaggcggctaggcaaggcgacagagnnnnnnnnnnnnnnnnnnnnnnn

SEQ ID NO: 25831 - DNA, 300 bp, Homo sapiens
  misc_feature: GYAE6OF01BHPX0.25.36.D03.1.454.CMB.1.raw
  modified_base (289)..(289): a, c, t, g, unknown or other
  misc_feature (289)..(289): n is a, c, g, or t
  modified_base (295)..(300): a, c, t, g, unknown or other
  misc_feature (295)..(300): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgactaacttattactgaccaacaatataataattattcgacctactttggccgagggaccaaggtggagatacaaacgaactgtggctgcaccatctgtcttcatccttcccgcatctgaactgtacagtctgagcgggctggcaggcncatagnnnnnn

SEQ ID NO: 25832 - DNA, 559 bp, Homo sapiens
  misc_feature: GYAE6OF01BFV6J.25.36.D03.1.454.CMB.1.raw
tcagactgtacagtcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctaccaaactcattaattttgagaccagtaagcggccctcgtgggtttctagtcgattcactggctccaagtctggcaacacgcctaccctaacaactctctgggctccgaggctgaagacgaggtcttgtttattctgctgttgctagtgtgctagaaactagtttggtgcgtcgggacggacggaccctaagttcgaccgttacttaaagtccgagcccaaggtcctaccggccccccttcggtacctacctccttcgttcccctaccccg

SEQ ID NO: 25833 - DNA, 511 bp, Homo sapiens
  misc_feature: GYAE6OF01CBQX4.25.36.D03.1.454.CMB.1.raw
  modified_base (220)..(220): a, c, t, g, unknown or other
  misc_feature (220)..(220): n is a, c, g, or t
  modified_base (390)..(390): a, c, t, g, unknown or other
  misc_feature (390)..(390): n is a, c, g, or t
  modified_base (505)..(505): a, c, t, g, unknown or other
  misc_feature (505)..(505): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggancagctccgacgtcggaaatagtttgtctactggtaccagcagctcccagaacgccccaagctcctcatctataggatgatcagcggccctcagggatacctgaccgattctctggctcgaagtctggctcctcggcctcccgtggccatcagtgggctccggttcgaggntgaggctgaatattactgtgctagtttggatgctagtctggagtggtccgaggtgtcggcggaggaccagcgtcgccgtctaggtccacgcccgaggcctcgcccccgtcgtccncgtccg

SEQ ID NO: 25834 - DNA, 298 bp, Homo sapiens
  misc_feature: GYAE6OF01CC47L.25.36.D03.1.454.CMB.1.raw
  modified_base (262)..(262): a, c, t, g, unknown or other
  misc_feature (262)..(262): n is a, c, g, or t
  modified_base (291)..(298): a, c, t, g, unknown or other
  misc_feature (291)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaatttattactgccaacaatataataattattcgaccacttttggccaggggaccaaggtggagatcaaacgaactgtggctgcaccatctgtcttcatcttccgccatctgaactgtacngtctgagcgggctggcaaggcgcgatagnnnnnnnn

SEQ ID NO: 25835 - DNA, 605 bp, Homo sapiens
  misc_feature: GYAE6OF01E12JY.25.36.D03.1.454.CMB.1.raw
  modified_base (359)..(359): a, c, t, g, unknown or other
  misc_feature (359)..(359): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagccgtgggacggtccctgagactctcctgtgaagcctctggtatttagtttcagttggttctggcatgcacgtggggtccgccaggcctccgaggcgaagggggccgaggtgggttggctagttanagcacatgatggaatttcagaattagttatgcagaccgtccggtagaacgggcctattccaccatccaccgaagacgaactaacgttccccggaaatagtttgtacgttaacgttaggaaacgttcgggtacacggtccttaggacggtacgtcggaacggtacgtccgggcgttcgttagttaacgtttactggtacggacggtaggtacggttacgggggagggtttgggtaaggtttaacggg

SEQ ID NO: 25836 - DNA, 368 bp, Homo sapiens
  misc_feature: GYAE6OF01CQFRY.25.36.D03.1.454.CMB.1.raw
  modified_base (207)..(207): a, c, t, g, unknown or other
  misc_feature (207)..(207): n is a, c, g, or t
  modified_base (294)..(294): a, c, t, g, unknown or other
  misc_feature (294)..(294): n is a, c, g, or t
  modified_base (346)..(346): a, c, t, g, unknown or other
  misc_feature (346)..(346): n is a, c, g, or t
  modified_base (348)..(368): a, c, t, g, unknown or other
  misc_feature (348)..(368): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctcttgtggtggcagcagctacaggtgtccactcccaggtccagctggtgcaatcgtgggcctgaggtgaagnggccgtgggtcctcgggtgaggggtcctccgtgtaaggtctccggaagcagtgtgttcgtcagacatacactcaccgtgggtccggnacggcctctaggacgtgggcctggacgcgggctggcaagggccgtgatagcngnnnnnnnnnnnnnnnnnnnnn

SEQ ID NO: 25837 - DNA, 296 bp, Homo sapiens; identical to SEQ ID NO: 25665
  misc_feature: GYAE6OF01EYS89.25.36.D03.1.454.CMB.1.raw
  modified_base (291)..(296): a, c, t, g, unknown or other
  misc_feature (291)..(296): n is a, c, g, or t

SEQ ID NO: 25838 - DNA, 297 bp, Homo sapiens
  misc_feature: GYAE6OF01DPL4M.25.36.D03.1.454.CMB.1.raw
  modified_base (292)..(297): a, c, t, g, unknown or other
  misc_feature (292)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgaccaacaatataataattattcgaccactttggccaggggaccaaggtggagatacaaacgaactgtggctgcaccatctgtctcatcttcccgcatctgaactgacagtctggacgcgggctggacaaggcgcaatgnnnnnn

SEQ ID NO: 25839 - DNA, 550 bp, Homo sapiens
  misc_feature: GYAE6OF01DSURS.25.36.D03.1.454.CMB.1.raw
  modified_base (313)..(313): a, c, t, g, unknown or other
  misc_feature (313)..(313): n is a, c, g, or t
  modified_base (354)..(354): a, c, t, g, unknown or other
  misc_feature (354)..(354): n is a, c, g, or t
  modified_base (385)..(385): a, c, t, g, unknown or other
  misc_feature (385)..(385): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagcctgggaggtccctgagactctcctgtgaagcctcgtggtatttagtttcagttggttctggcatgcacgtggggtccnccgaggctccgaggcgaaggggccgagtggtggctagttanagcacagtgatggaagttctagaattattangcagactcgtagacggcgtatcacatctacagacgacaactcccgaactattgtacgttaacgttaggaaagtggtacacgtccgtagagaggtacgagggtaccgtcggctcgttagttattacgtgtgacgtaggtagtcggggaggttgggtaggttacggg

SEQ ID NO: 25840 - DNA, 296 bp, Homo sapiens
  misc_feature: GYAE6OF01EE952.25.36.D03.1.454.CMB.1.raw
  modified_base (272)..(272): a, c, t, g, unknown or other
  misc_feature (272)..(272): n is a, c, g, or t
  modified_base (289)..(296): a, c, t, g, unknown or other
  misc_feature (289)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtctcatctccgcatctgaactgtacagtctgacgcgggntggcaaggcgcagtagnnnnnnnn

SEQ ID NO: 25841 - DNA, 613 bp, Homo sapiens
  misc_feature: GYAE6OF01EUKSB.25.36.D03.1.454.CMB.1.raw
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
tcagactgtacagtcacgaccggtgctcgatttagctgcgtcacgatctctcttgggggagctctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcaccgtggtggagtcgtggggggaggcggtggtccaggccgtggggacggtccctgacgactctcctgtgaacgcctgtggtatttagtttcaggttcggttctggcagtcgctacgtgggtccgccgaggcctccgaggcgaaggggccgaggtggtggctagtanagcanatgagtggaattcagtaatattancgacacggtactcggtaggaacgggtccgtattaccactactccgacagtaacgacctaacgttcccggaatagttgtacgtaacgttaggaaattgggtacacggtccgttaggaggtacggtacggtaggtaccgttcgggtcttacgttagttacgttacgtggttacgacggtaggtacggttagggggtacggttgggtaagttacggg

SEQ ID NO: 25842 - DNA, 299 bp, Homo sapiens
  misc_feature: GYAE6OF01CUO3R.25.36.D03.1.454.CMB.1.raw
  modified_base (293)..(299): a, c, t, g, unknown or other
  misc_feature (293)..(299): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatacaaacgaactgtggctgcaccatctgtcttcatcttcccgccatctgaactgtacagtctgagcgggctggcaaggcgcaatagnnnnnnn

SEQ ID NO: 25843 - DNA, 307 bp, Homo sapiens
  misc_feature: GYAE6OF01CVEYC.25.36.D03.1.454.CMB.1.raw
  modified_base (298)..(307): a, c, t, g, unknown or other
  misc_feature (298)..(307): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgccaacaatataataattattcgaccacttttggccaggggaccaaggtggagatacaaacgaactgtggctgcaccatctgtctcatcctccgccatctgaactgtacagtctgacgcgggacgtggacgaacggcgacatagnnnnnnnnnn

SEQ ID NO: 25844 - DNA, 512 bp, Homo sapiens
  misc_feature: GYAE6OF01BH5GM.25.36.D03.1.454.CMB.1.raw
  modified_base (202)..(202): a, c, t, g, unknown or other
  misc_feature (202)..(202): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggcgagtcagggcattagcaattattagctggtatcaacagaaaccagggagagttcctaagctctgatctatgctgcctccacgttacactcagggtcccatctcggtcagcggcagtagaatcgtggacagagttcactctcactatctagcacgcctgcagcctagaagtagtgttacgacttaacttattactagtaactaaagttaataaattacctcgtaccccttctccgtaccgtttcgggacggtacggggtaccaaagggtcggaagtagtaaaccgg

SEQ ID NO: 25845 - DNA, 722 bp, Homo sapiens
  misc_feature: GYAE6OF01D7RUN.25.36.D03.1.454.CMB.1.raw
tcagactgtacagtcacgaccggtgctcgatttagctgcgtcacgatctctcttggggagctctgggagaggagccccagccctgagattcccaggtgtttcccattcagtgatcagcactgaacacaggaggactcaccatggagttgggactgagctggtacttttcctttggcttaattttaaaaggtgtccagttgtagaagtgctaagtgggtggagtcgtagggggagtcttggtacagccgtggctacggccctgacgactctctagtgcacgtcctcgtggtacttacctaccgtttgaacttgtatttagtcgacctagttcgaccgtacggtcggggtaccgacaacggtccgtaccggaaggggggaaccggtccgtaggggaagggttccgggttacgtaggtaagggtttaagtttaagggttaagggaagttacgggtagggtaacacgtaagtacggtacgttaagtcggtaacgttacttcggttaggtaacggggaacccgggtccttaattaccccggaaacttctttccccgaacgaaacgtaaaccgtaaaccctaacggaaccctaaacgtaaccttcccgtaagttaacgtccgaggttaactaacggtcgaaccgttaggtctacgaaccgtcgtagaacccttggaacccttcgtctttaagttagttcgttagaggtaaagggtggtcggtttaggg

SEQ ID NO: 25846 - DNA, 706 bp, Homo sapiens
  misc_feature: GYAE6OF01BYO08.25.36.D03.1.454.CMB.1.raw
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (395)..(395): a, c, t, g, unknown or other
  misc_feature (395)..(395): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtcgcgagggtccggtcggccgagtcgtgtgctagactcagccacctcagtcgtcgcgggaccccgggcaggtcggtctcactcttcttgttcgngggcncagctccgacggtacgaaagttagtttcgtactacgtcggtacacgcacgcctaccgaacgaaaccggaccccaagtcctcctacacgtactaagtaaggaatcggaactcgagcccggacctaccggaggtaacctacgtacgaaccgtnttccgtcgtcggacttcggaagttcgttcggcccgttcccgccgggtccctcccggtacggccctaggtaccgtaccggggtggtccccggttaaccgggccggtagggtaccgtaggacgtagtaacttagtaacgtttccgtaggtcgtacgttagggtttacggatccgtaacgtcggtcgtaacgggttacgggttccgggtaccgggttacgggtttacggggtccggggaacggggttaaccggaccgtaagggtcccgtaacggtaccgtacccgttaggggccaccgggttcccggaaccggg

SEQ ID NO: 25847 - DNA, 789 bp, Homo sapiens
  misc_feature: GYAE6OF01DKKM0.25.36.D03.1.454.CMB.1.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagcccaccctcagtgtccgtgggacccccgggnaggagggtctccatctcttgttcgtgggancagcctccgacgtacggaaattagtttgtcctacgtggtaccagcagcctacccgaaggaaacccggcccccaagtcctcctcatctaagtaggaatgatcgacggccggcctcgagggtactacccgtagacctattcctacgtcggtacctacggaacgttccgtacgggtcccttcccggtcccgggtccccttaccccggtcggaccctacgttaccggtacgggttcgggtacccgtacccggggttacccggaagggtacgttcgggaacgggtaccgttaagaaacgtttaacgtttaccgttggtacggtacggttagggttttcggggaattccggtaccggtaagttcgtacggtacgggttccgggtacccggtacggggtttacggttcggggaccggggtaacgggaacccgtaacgggtaccgttaccgggtaacccccgggttacggttacgggccccgtaacccggggtaaccccgtaaacccggggtcccgttaacccccggccccccccggttttacgggtccccgtaaccccggttttcccccgg

SEQ ID NO: 25848 - DNA, 675 bp, Homo sapiens
  misc_feature: GYAE6OF01CUHFI.25.36.D03.1.454.CMB.1.raw
  modified_base (180)..(180): a, c, t, g, unknown or other
  misc_feature (180)..(180): n is a, c, g, or t
  modified_base (328)..(328): a, c, t, g, unknown or other
  misc_feature (328)..(328): n is a, c, g, or t
  modified_base (363)..(363): a, c, t, g, unknown or other
  misc_feature (363)..(363): n is a, c, g, or t
  modified_base (404)..(404): a, c, t, g, unknown or other
  misc_feature (404)..(404): n is a, c, g, or t
  modified_base (609)..(609): a, c, t, g, unknown or other
  misc_feature (609)..(609): n is a, c, g, or t
tcagactgtacagtcacgaccggtgctcgatttagctgcgtcacgatctctcttggggagctctgggagaggagcccagcactagaagtcggcggtgttccattcggtgatcagcactgaacacagaggactcaccatggagtttgggctgagctgggttttcctcgttgctctttaagnggtgtccactgtcaggtgcaccgtggtggagtcgtgggggagcgtggtccagccgtgggacgtccctggagacctcgtcctgtagaacgccttcgtaggtacttttagttccgaggttggttctggctagtcgctacgtcgggtcccncgaggctcgaggcgaggggcgagtggtgcagttanagcacagtagacgtggaacgtttctaggtaaattagtttancgactaacggtaccgttaccggagggaaacgggtccctaattacccaaccgtacttcctaccgaaggtaacgaaccgttaaacgttccccgggaaattgtttacggttagtaaccgtttagggaaacgttcgggtacacggtccgttaggacgacgggttacggacggtaccgttcggtacctgtttaacggttagtttaccggngggttaccggaacggtacggttacgggttccggggggtaaggttaggggtttaacgtttaacgggg

SEQ ID NO: 25849 - DNA, 309 bp, Homo sapiens
  misc_feature: GYAE6OF01ER05P.25.36.D03.1.454.CMB.1.raw
  modified_base (295)..(309): a, c, t, g, unknown or other
  misc_feature (295)..(309): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaaacaatataataattattcgaccacttttggccaggggaccaaggtgagatcaaacgaactgtggctgcaccatctgtcttcatccttcccgctatcctagaactgtacagtctgagcgggctggcaaggccgcatagnnnnnnnnnnnnnnn

SEQ ID NO: 25850 - DNA, 560 bp, Homo sapiens
  misc_feature: GYAE6OF01BT7K3.25.36.D03.1.454.CMB.1.raw
tcagactgtacagtcacgaccggtgctcgatttagctgcgtcacgatctctcttggggtctggcgccaggggtcccttccaatatcagcaccatggcctggactcctctctttctgttcctcctcacttgctgcccaggtccaaatctcagactgtggtgactcaggagccctcactgactgtgtccccaggagggacagtcactctcacctgtgcttccagcgctgggtcagtcaccagtgagaaccatccaaactggttccagcagaaacctggaccaacacccaggcactgatttatggtagacaaaactaaaaaacactcttacggaacccctgtcccggttcttccgaaggtcctcccctccgttcggggaccaaaagctacgccctggacactgtccagatgtagcagccgtgaggacgagctgaacctacactcgcctgactctcctcgtggtcggtgtcgttggtgttcggacggacggaccaaacgtcgaccgttcgtcggtcacgcccgaggcctccgccccctcggtaccacgtcctcggttacccccc

SEQ ID NO: 25851 - DNA, 713 bp, Homo sapiens
  misc_feature: GYAE6OF01CK1UW.25.36.D03.1.454.CMB.1.raw
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagcccaccctcagtgtcgtcggggacccccgggcaggagggtctccatctcttgtctgggagcagctccgacgtcggaaatagtttgtctatggtaccagcagctccaagaaccggccccaagcctcctcatctataggatgatcagcggccctcgagggactaccgtgaccgtattctcgtggctacgaagtcctggcctcccgtccggtccctcccgtaggccctatccgtacgggttcgggccgttcccgggtccggaagggtacgttacggacgggtcgttaaggtaaacgtttaacgtttaaccgttgggttacggtaccgttaagggttttgggacttcggacccgtaggttcgtcggtaacgggttcgggttacccgggtacgggtttcgggttaccggggaccgggaaccggggtaaccggtaacggtaccggttaccggtaccccgggttaccgttaacgggtacccgaacccgggtaccccgaaacgggtcccgttacccgggtacccccccggtttcggtccccgtacccgtttccccgg

SEQ ID NO: 25852 - DNA, 516 bp, Homo sapiens
  misc_feature: GYAE6OF01DZU73.25.36.D03.1.454.CMB.1.raw
  modified_base (431)..(431): a, c, t, g, unknown or other
  misc_feature (431)..(431): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggaagcagtgtgttcgtcagacatacactcacctgggtccggcaggcctctggaactgggcctgagtgggtggacatcacgcacgcgacacagagcgcacatcagtttcagggcagagtcaccttttcgtgacaagtccacgggcgcagtactacatgaatctacaatgaacctgcatttgcgacncggcctatacttactgtgaccgagaaagagtccgtagccctacaaagtcgacagctacggactcccgaccccgtgggaaccccgg

SEQ ID NO: 25853 - DNA, 717 bp, Homo sapiens
  misc_feature: GYAE6OF01A7MOO.25.36.D03.1.454.CMB.1.raw
  modified_base (426)..(426): a, c, t, g, unknown or other
  misc_feature (426)..(426): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtcgtcggggacccccgggcagagggtctccatctcttgttctgggagcagctccgacgtcggaaattagtttgtctactggtaccagcacgccctaccgaacggaacccgaccccgaagtcctcctactactactagtaaggtaatgactcgacggtcccggccctacggacgggacttaccgacgtaccgtacttccgtcgtcggcgtacggacgttcgcgtcctccgtcccgtccctccgtcgacctntcgtacgggtcggtcccgttcccgggacggtaggtctcgggacggtactaagtaacgtttacgttagtggtacgtcggtttagggttggacttcggaccgttaggtcgttacgggtcgggttaccgggtacccggggttagggtttcggggtaccggggaacgggtaaccgggaaccgtacggtcccggtaacccggttccccggtttacggtacgggtaccgacccgggtaacccgggtacggtccctcccccggtacccccggttaggtacccctacccggtttccccg

SEQ ID NO: 25854 - DNA, 677 bp, Homo sapiens
  misc_feature: GYAE6OF01CLT9C.25.36.D03.1.454.CMB.1.raw
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcaacgtggtggagtcgtgggggagcttggtacagcctggcacggcccctgagactctcctgtcggcacgcctctggtattccacctttgatgtatttatgccatcgctacgtcgggtccggacaacgtccgtcgaagggggtaacggccgtgggacggtcgggtctacggaaggttagtttaggtttaggaattagggtaggttaagcgagttaaggtccgttaagtcgggaccggtaactcgttacgggtaagggtaaaccggggtccctaacttacccgaaccctacgtcccttaccggaagtaaccgaaccgaaaccggtaccaaaccggaccttcccgtagttaactcgtacgtaacaaagttacgaacgtgttactaggaaggtacgtaccgtgggtaacgaccggtccggttacttaggttaattaccgtaagggtacttaaaacgtaaaaagttttacgttaaacgg

SEQ ID NO: 25855 - DNA, 299 bp, Homo sapiens
  misc_feature: GYAE6OF01CMBZ4.25.36.D03.1.454.CMB.1.raw
  modified_base (290)..(290): a, c, t, g, unknown or other
  misc_feature (290)..(290): n is a, c, g, or t
  modified_base (297)..(299): a, c, t, g, unknown or other
  misc_feature (297)..(299): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgaccaacaaataataaataattattcgacctacttttggccaggggaccaaggtggagatacaaacgaactgtggactgcaccatctgtctcatcttcccgccatctgaactgtacagtctgagcggctggcaaggcncgatagnnn

SEQ ID NO: 25856 - DNA, 300 bp, Homo sapiens
  misc_feature: GYAE6OF01EDT1J.25.36.D03.1.454.CMB.1.raw
  modified_base (291)..(300): a, c, t, g, unknown or other
  misc_feature (291)..(300): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttatactgccaacaatataataattattcgacctacttttggccaggggaccaaggtggagatacaaacgaactgtggctgcaccatctgtcttcatcttcccgccatctgaactgtacagtctgagcggctggcaaggcgcatagnnnnnnnnnn

SEQ ID NO: 25857 - DNA, 537 bp, Homo sapiens
  misc_feature: GYAE6OF01EIKF8.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctattggagacagaatcagcatcacgttgccgggcgagtcagggcattagctaattattagcctggtatacaacgagaaaccagggagagttcctaagctcctgatctatgctgccctccacgttacacgtcgacgggtcccatctcggtcaggcggcaggtcgtaagtcgtagggactagtacgttcgactctcctactactcagccacgcctgcacgtcgtagaagtagtgttacgactaacttagttactagtaactaaagttataaacgttaccgtcctaccccttactaccgtaccgttccgggacgggtacggacgaagggtggaagtactaaaccgg

SEQ ID NO: 25858 - DNA, 325 bp, Homo sapiens
  misc_feature: GYAE6OF01DO6H7.25.36.D03.1.454.CMB.1.raw
  modified_base (305)..(325): a, c, t, g, unknown or other
  misc_feature (305)..(325): n is a, c, g, or t
tcagactgtacagtcacgaccggtgctcgatttagctgcgtcacgatcgtctcttgggatagaagttattcagcaggcacacaacagaggcagttccagaattccactctcaccatcagcagcctgcagccctgatgattttgcaacttattactgccaaacaatataataattattcgaccacttttggccaggggaccaaggtggagatcaaacgaactgtggctgcaccatctgtctcatcttcccgccatctagaactgtacacgtctgacgcggggctcgggacaaggcgacaagtaggnnnnnnnnnnnnnnnnnnnnn

SEQ ID NO: 25859 - DNA, 295 bp, Homo sapiens
  misc_feature: GYAE6OF01BKEXA.25.36.D03.1.454.CMB.1.raw
  modified_base (288)..(295): a, c, t, g, unknown or other
  misc_feature (288)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtgagatcaaacgaactgtggctgcaccatctgtcttcatctcccgcatctgactgtacagtctggagcgggctggcaaggcgcatagnnnnnnnn

SEQ ID NO: 25860 - DNA, 519 bp, Homo sapiens
  misc_feature: GYAE6OF01DEWJ8.25.36.D03.1.454.CMB.1.raw
  modified_base (310)..(310): a, c, t, g, unknown or other
  misc_feature (310)..(310): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtcctccatcctccctgtcctgcatctgttggagacagaatcagcatcacgttgccgggcgagtcagggcattagctaattatttagcctggtatacaacagaaaccagggagagttcctaagctacctgatctatgctncctccacgttacacgtcgacgggtccatctggttcagcggnagtgaatcgnggacagtacgttcactctcactatcagcacgcctcgcacgcctagaagtagtgttgacttaactttattacgttataactaaaatattaataccgtccgtccccttacttcctaccgtttcgggacggtacgggaaccgaggtaggagtataaaccgg

SEQ ID NO: 25861 - DNA, 294 bp, Homo sapiens; identical to SEQ ID NO: 25662
  misc_feature: GYAE6OF01EZSOH.25.36.D03.1.454.CMB.1.raw
  modified_base (291)..(294): a, c, t, g, unknown or other
  misc_feature (291)..(294): n is a, c, g, or t

SEQ ID NO: 25862 - DNA, 805 bp, Homo sapiens
  misc_feature: GYAE6OF01COP3R.25.36.D03.1.454.CMB.1.raw
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggacgcccccactgactgtcgtccccaggagggacagtcactctcacctgtgcttccagcgctgggtcagtcaccagtgagaaccataccaaactggttaccagcaagaaacctggaaccaaccacccgagggcactgactttagnggtagacaaaactaaaaaacncttacttacggacccctaggcccgttctcgacggtccttcccgtaccgttgggggacctaaacgtccgtacggccccttacggaacctaccgtaggttaccaggtaacgttcggtacgtccgaacggtcccttaggggaaacgggaccggtaacgggtacgtttaccgggaacccttaaccccgaaccgttccggaccccgtttcggtccctttcccgttcccgtttacggtttcggggttcggggttaccgtttccggggttttcgggggtttcgggtttacccgggggaccggggtaaccgggtaaacccgtaaacggtccggttaaaccccgggttccgggtaccggggtaccgtacccgggaacccccggttaaacgggccccgttaccccgggtaacccccccggttaacgggttaccctaaccccgttttcccctttccccgggttaccccccttaacccccccgg

SEQ ID NO: 25863 - DNA, 602 bp, Homo sapiens
  misc_feature: GYAE6OF01D4VRD.25.36.D03.1.454.CMB.1.raw
  modified_base (203)..(203): a, c, t, g, unknown or other
  misc_feature (203)..(203): n is a, c, g, or t
  modified_base (354)..(354): a, c, t, g, unknown or other
  misc_feature (354)..(354): n is a, c, g, or t
tcagactgtacagtcacgaccggtgctcgatttagctgcgtcacgatctctcttgggggcagaagtctctctcagtcaggacacagcatggacatgagggtccctgctcagctcctgggacctcctgctgctctggctcccagataccagatgtgacgtccagatgacccagtcctccatcctccctgtctgcatctgttganacagatcagcatcacgttgccggcgagtcgagggcattacgataattattagcctggtatacaacgaacgaaccgagggatacggttcctaagtctacctgatctatcgctcgcctctacgtacacgtcgacggtcctagtcgtcggtacnggcgacagtgaacgtcgtagggactagtacgttaccacttactacactagtaccgacgtcacgccgtacgactaccgtaccgtagtaagttacgtttacgtacgttaaccttaaacgtttaactttacgttaacgtaaaccgttaaaattaccgttaaacttaccgttcccgtacccctttactaccgttacggttcccgggacgggtaccggtaaacggtagggttaccgaaagtactaaaaccggg

SEQ ID NO: 25864 - DNA, 645 bp, Homo sapiens
  misc_feature: GYAE6OF01BQH20.25.36.D03.1.454.CMB.1.raw
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctccgtgtaaggtctccggaagcagtgtgttcgtcagacatacactcaccgtgggtccgcacggcctcgtcggaacgtgggcctggacggtgggtacggaactaagtccgaacccgccaaccggacccggaaacaacgaggacggtcgacacatcgtagtttcgagggcaaggacgtcctaccgttttccggaggacgtaacgtccgacggggcgaccaagtactactagtagaacttctacaacgtcgaaccgtgacgttattcggaccggtacgtaccgggtaccgttattacttacgtgtacgacggtaagaaacgtacgttacccgtcgtaccctaacggaaaacgttccgaaaccgtacggtaccgtaccgggaccctccccgggtaaccccggttcgggggaaaccccgg

SEQ ID NO: 25865 - DNA, 364 bp, Homo sapiens
  misc_feature: GYAE6OF01BRSMM.25.36.D03.1.454.CMB.1.raw
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
  modified_base (298)..(299): a, c, t, g, unknown or other
  misc_feature (298)..(299): n is a, c, g, or t
  modified_base (302)..(302): a, c, t, g, unknown or other
  misc_feature (302)..(302): n is a, c, g, or t
  modified_base (304)..(364): a, c, t, g, unknown or other
  misc_feature (304)..(364): n is a, c, g, or t
tcagactgtacagtcacgaccggtgctcgatttagctgcgtcacgatctctcgttgggatagaagttattcagcaggcacacaacagaggcagttccagaattcactctcaccatcagcagcctgcagcctgatgatttttgctaacttattacttgccaacaatataataattattcgaccacttttggccagggggaccaaggtggagatcaaacgactgtggctgcaccatctgtcttcatcttccgcatctgactgtacagtctggngcgggctggcaaggcgcgagtagnagnncgntnnnnnnnnnnnnnnnnnnnnnnnnnnnnnnnnnnnnnnnnnnnnnnnnnnnnnnnnnnnnn

SEQ ID NO: 25866 - DNA, 623 bp, Homo sapiens
  misc_feature: GYAE6OF01AQR6S.25.36.D03.1.454.CMB.1.raw
tcagactgtacagtcacgaccggtgctcgatttagctgcgtcacgatctctcttggggagctctgggagaggagcccccagccctgagattccccaggtgttcccattcagtgatcagcactgaacacagaggactcaccatggagttgggactgagctggtattttccttttggctattttaaaaggtgtccagtgtgaagtgcaactggtggagtcgtggggggagcttggtacagcctggcacggcccctgagacctctcctgtgcacgcctctggtattcacctttgatgatttatcgccatgcgtacgtcgggtccggcaagctccgaggggacggcctggaggtcggtctcgaggttatttaggtggaattaggtggtagctagtaggcttaagtggaccggtacttcgtgggtacgggaacgggtccctattccaacccattccgtccgaagacgaacccaaaccgacccaaacgtaacccttccctaggtacttccgtagaacctaaagttcgaaactggttcaggaaggacgtcgtacgggaacgggtaccctacggggttccctttagtactttaccggtgtaacggtaaactttaaaaagtttgttaaccgg

SEQ ID NO: 25867 - DNA, 305 bp, Homo sapiens
  misc_feature: GYAE6OF01CXKHD.25.36.D03.1.454.CMB.1.raw
  modified_base (293)..(305): a, c, t, g, unknown or other
  misc_feature (293)..(305): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgaccaacaatataataattattcgacctacttttggccgagggaccaaggtgagatacaacgactgtgctgcaccatctgtcttcatccttccgcatctagactgacagtctgagcggtctggcaaggcgacagtagcgnnnnnnnnnnnnn

SEQ ID NO: 25868 - DNA, 543 bp, Homo sapiens
  misc_feature: GYAE6OF01DMYC5.25.36.D03.1.454.CMB.1.raw
  modified_base (360)..(360): a, c, t, g, unknown or other
  misc_feature (360)..(360): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
tcagactgtacagtcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcggtcaccatcgtcctgcactggaaccagccgtagactagttggtgtcttaataactagtgtcctcctcgtacccaacaacaccaggacaacggacccccaaatcaatcatttatgactgtacagtcatccggtcctacgtggtacgtttctgggtcnctttctctcggcctacgtaacgtcttacggacaaccgtcggccctcctagaccagtcgtcgggctcgagctagacgacgagtctagttatntgntacttcatacagacgactaccatagtctggtcgttcggaggacggactaggtcgaccgtctacggtcaacggccaagccgcgtaccccg

SEQ ID NO: 25869 - DNA, 302 bp, Homo sapiens
  misc_feature: GYAE6OF01D6IEG.25.36.D03.1.454.CMB.1.raw
  modified_base (295)..(302): a, c, t, g, unknown or other
  misc_feature (295)..(302): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataaataattattcgaccacttttggccaggggaccaaggtgagatcaaaacgaactgtaggctgcaccatctgtcttcatcttcccgccaatctagaactgtacagtctgagcgggctggcaaggcgcatagnnnnnnnn

SEQ ID NO: 25870 - DNA, 586 bp, Homo sapiens
  misc_feature: GYAE6OF01CTER6.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtcctccatcctccctgtctgcatctgttggagacagaatcagcatcacgttgccggcgagtcgagggcattagcaattattagcctggtatcaacagaacgaggagacgtcctaagctcctgatctatcgctcgcctacctacgttacacgtcgacgggtcccagttcgtcgttcgacgcggctagtagatcgtggacagtacgtcactctcactatcagcacgcctcgcgtacgcctaggaacgtacgtcggttataaccttaactttaatttacgtaagttaacgttaaaagttaacttaactaacccgttacccgtaccccctttacgttacccgttaacccgggtttaccgggacgggtaaaccggggtaacccggtaaagggtacgggaaacggtaccgtaaaacccggg

SEQ ID NO: 25871 - DNA, 588 bp, Homo sapiens
  misc_feature: GYAE6OF01CEQYO.25.36.D03.1.454.CMB.1.raw
  modified_base (250)..(250): a, c, t, g, unknown or other
  misc_feature (250)..(250): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccgggancagtgtgttcgcagacatacactccaccgtgggtccggcgaggcctcgtggacgtcgggcctggaggtgggtggaacaatccgaaccgccacgaccggaacaacgagacggtcgcgacagtcgacgtttcgagggcaggactctaccgtttcgnggacacgtccgacgggcncgagtactacatacgaactctacgtaatcgacgtgacgtagttcgaccggtacgaccgggtccgttaagttacttacgtcgtcgacggtagtaaacgacgtccgtcgtaccctaagaaacgtccgaacgcgtcgtcggacgtcccggaccccgtggggaaccccgg

SEQ ID NO: 25872 - DNA, 746 bp, Homo sapiens
  misc_feature: GYAE6OF01CVUG3.25.36.D03.1.454.CMB.1.raw
tcagactgtacagtcacgaccggtgctcgatttagctgcgtcacgatctctcttggggtctggcgccaggggtcccttccaatatcagcaccatggcctggactcctctctttctgttcctcctcacttgctgcccgagggtaccaaatctcagactgtggtgactcgaggacgccctcactgactgtcgtcccgagggaggacagtcacctctcacctgtcgtcttccgagcgcgtgggtcagtcaccgagtgaacgaccataccaaactggttccagacaacgaaaccgtggaccaacccacccgagggccacgtgtaatttagtaggtcgaactaaaacctaaaaaacctacttccgtaccggacccccgtcggtccccgttcctacgtaccggtcccttccccgttccggttacgggggaacctaaacggccgtaccgcccgtacgaacctcgtcggtacgacgtattcggtcgaccgtacggtcccgtaggacgggaacgacgggtcctacggaaccctacccgacgtccgcccttacgtcccttccgttcccgttacggttgggttcggttcggttcggtttggggttcgggtcgggaccgggtaaccgggaaccctaaacggttccggtacccggttacccggtcggggtacccaaccggcccggaacccggtcccgccccggttaccccccggttcccgggtacctacccgttcccgtttccccggttaccccccccg

SEQ ID NO: 25873 - DNA, 315 bp, Homo sapiens
  misc_feature: GYAE6OF01C17QK.25.36.D03.1.454.CMB.1.raw
  modified_base (156)..(156): a, c, t, g, unknown or other
  misc_feature (156)..(156): n is a, c, g, or t
  modified_base (163)..(163): a, c, t, g, unknown or other
  misc_feature (163)..(163): n is a, c, g, or t
  modified_base (221)..(221): a, c, t, g, unknown or other
  misc_feature (221)..(221): n is a, c, g, or t
  modified_base (290)..(290): a, c, t, g, unknown or other
  misc_feature (290)..(290): n is a, c, g, or t
  modified_base (293)..(315): a, c, t, g, unknown or other
  misc_feature (293)..(315): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtaattttgctaacttattactnaccaaanaaataataataattatcgactactttggacagggacaaggtgagatacaaagaactgngctgcaccatctgtctcatcctccgcaatctagaatcgtacagtctggagcggactggacgaagcaganagnnnnnnnnnnnnnnnnnnnnnnn

SEQ ID NO: 25874 - DNA, 297 bp, Homo sapiens
  misc_feature: GYAE6OF01EVZYW.25.36.D03.1.454.CMB.1.raw
  modified_base (287)..(297): a, c, t, g, unknown or other
  misc_feature (287)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatctcccgcatctgactgtacagtctgagcgggctggcaaggcgcatagnnnnnnnnnnn

SEQ ID NO: 25875 - DNA, 638 bp, Homo sapiens
  misc_feature: GYAE6OF01BZ121.25.36.D03.1.454.CMB.1.raw
  modified_base (221)..(221): a, c, t, g, unknown or other
  misc_feature (221)..(221): n is a, c, g, or t
  modified_base (298)..(298): a, c, t, g, unknown or other
  misc_feature (298)..(298): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggancagctccgacgtcggaaattaagtttgtctactggtaccagcagctcccagaaaccggccccaagctcctcatctanaggatgatcagcggccctcgagggactacctgaccgtattctcgtggctacgaagtctcggcctccgtcggccctcctggccatcgagtcgggcctccgggtccgaggtactggacggctagtaattatttacgtggtcgtcgtaggttttgggatcgccgtagtccgtggtacggttcgggtacccgtacggggttcggttcgggacggggtacgggaaccgtaaacggtccgttacggtacccggttacccggtaacgggtcccgaccgggacccccgtaaaggggtccccgttacccgggtcccccccgtttacgggtccccgtaccgtttcccccg

SEQ ID NO: 25876 - DNA, 587 bp, Homo sapiens
  misc_feature: GYAE6OF01C0VAM.25.36.D03.1.454.CMB.1.raw
  modified_base (447)..(447): a, c, t, g, unknown or other
  misc_feature (447)..(447): n is a, c, g, or t
tcagactgtacagtcacgaccggtgctcgatttagctgcgtcacgatctctcttggggacataacaaccagattcttcctctaaaagaagcccctgggagcacagctcatcaccatggactggacctggaggttcctctttgtggtggcagcagctacaggtgtccactcccaggtccagctggtgcaatcgtgggcctgaggtgaagaggccgtgggtcctgggtgagggtctccgtgtaacggtctcggaagcagtgtgttcgtcagacatacactcaccgtgggtccggcaggcctcgtggaacgtgggccctggaggtggggtcggaacactacgaccgccgaacggacggaacacgagacgtcgacacatcagttcgaggcaggatccgtacttttcgaggactacgtccgacgggcgacgtagtatacgatgaatcactancgtactggctagtttcgacgacgacggtccgtagtacttacgtgcgtagaaggaaacgtagtccgtcgtaccgtaaacgaaacggttccaagacggtacgtacggtccgtacccggtaccccggtcgggggtaaccccgg

SEQ ID NO: 25877 - DNA, 559 bp, Homo sapiens
  misc_feature: GYAE6OF01A3RA3.25.36.D03.1.454.CMB.1.raw
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtggggggagcgtggtccagcctgggagtccctgagactctcctgtgaagcctcgtggattttaggttcagttggttctggctagtgcacgtgggtcccgccaggctccaggcaaggggccgagtggtgcagtangcanatgatggaattcagaatatatgacagactcgtgaacggcgatcaccatcctaccagacgacaacttccccggaatacttcgtagttacgttaggaaacgttgggtacaaggtcctaggacgacgtcgggaggtaccgtcgggaccttcgtaggttacttacgtggtcgacggtaggtaggtaggggacggtgggttaggttaacgg

SEQ ID NO: 25878 - DNA, 297 bp, Homo sapiens
  misc_feature: GYAE6OF01EOO7Y.25.36.D03.1.454.CMB.1.raw
  modified_base (290)..(297): a, c, t, g, unknown or other
  misc_feature (290)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcgccatctgaactgtacagtctgagcgggctgggcaaggcgcatagnnnnnnnn

SEQ ID NO: 25879 - DNA, 588 bp, Homo sapiens
  misc_feature: GYAE6OF01DAULV.25.36.D03.1.454.CMB.1.raw
  modified_base (305)..(305): a, c, t, g, unknown or other
  misc_feature (305)..(305): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtgtccccaggagggacagtcactctcacctgtgcttcagcgctgggtcagtcaccgagtgagaaccatccaaaactggttccagcagaaacctggaccaaccacccagggacactgatttanggtgacaactaaaaacactactcggaccctcgcccgttctcagctccctcgttggggacaagctcgccctgactactgacagatgtcgcacgcgtaggaggacgaggctgacctaccgactcgcctacgcctctccgtcgtgggtcgtgtcggttgggtcgttcgggcggtacggaaccgtaacgtcggtacccgttccggtcgggtaccacggccccgtaaacggcccgtacccggtccccccgttacgggtcctaccgtcccgttccggttacccccccgg

SEQ ID NO: 25880 - DNA, 308 bp, Homo sapiens
  misc_feature: GYAE6OF01DCP83.25.36.D03.1.454.CMB.1.raw
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
  modified_base (298)..(308): a, c, t, g, unknown or other
  misc_feature (298)..(308): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgaccaacaatataataattatcgaccacttttggccaggggaccaaggtggagatacaaacgaactgtggactgacaccatctgtcttcatcttccngccatcagaactgtacagtctggaggcggctggccaaggcgacanagcnnnnnnnnnnn

SEQ ID NO: 25881 - DNA, 298 bp, Homo sapiens
  misc_feature: GYAE6OF01BGLGU.25.36.D03.1.454.CMB.1.raw
  modified_base (290)..(298): a, c, t, g, unknown or other
  misc_feature (290)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctggcaaggcgcatagnnnnnnnnn

SEQ ID NO: 25882 - DNA, 537 bp, Homo sapiens
  misc_feature: GYAE6OF01AZG7A.25.36.D03.1.454.CMB.1.raw
  modified_base (477)..(477): a, c, t, g, unknown or other
  misc_feature (477)..(477): n is a, c, g, or t
  modified_base (516)..(516): a, c, t, g, unknown or other
  misc_feature (516)..(516): n is a, c, g, or t
tcagactgtacagtcacgaccggtgctcgatttagctgcgtcacgatctctcttggggagctctgggagaggagcccccagccctgagattcccaggtgtttccattcagtgatcagcactgaacacagaggactcaccatggagttgggactgagctggattttccttttggctattttaaaaggtgtccagtgtgaagtgcaactggtggagtcgtggggggaggcttggtacagcctggcaggcccctgagactctcctgtgcagcctctggattcacctttgatgatttatgccatgcacgtgggtcccgcaagctccgaggggaaggcctgggagtggggtctcgaggtattagttggaataggtggtagcagtaggctagtgcggactcgtgtggaacgggccgtagttcaccatcctaccagacgacaacgaccaagacctccctagtactctagacaaatgaacagtcngagagcgtggaggacacggtccttagttattacgtgtanaactaaaaagtttgttaaacg

SEQ ID NO: 25883 - DNA, 611 bp, Homo sapiens
  misc_feature: GYAE6OF01AY6T4.25.36.D03.1.454.CMB.1.raw
  modified_base (208)..(208): a, c, t, g, unknown or other
  misc_feature (208)..(208): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcggggacccccggnaggagggtctccatctcttgttctgggagcagctccgacgtacggaaattaagtttgtctactggtaccagcagctcccagaaccggccccaagcctcctcatctataggatgatcgagcggccctgacggactaccgngaccgtattcncgtggctacgtagtctcggtcctccgtccggccctccgtcggccactcgaggtcgggtccctcccgggtacgagggcgtggacgtcgtagtaacttacttacgtggtagtcgtaggtttgggtactcgccgttaggtcgtggtacggtcggtacccgggtagggtcgggttccgggacggggtaacgggaccgtaacggtcccgtacgggtacccggttaccggtaaggtcccgtacggaccccggtaacggg

SEQ ID NO: 25884 - DNA, 305 bp, Homo sapiens
  misc_feature: GYAE6OF01BMZHA.25.36.D03.1.454.CMB.1.raw
  modified_base (294)..(305): a, c, t, g, unknown or other
  misc_feature (294)..(305): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatccttcccgcatctgaactgtacagtctggagcgggctgggcaagggcgcatagnnnnnnnnnnnn

SEQ ID NO: 25885 - DNA, 288 bp, Homo sapiens
  misc_feature: GYAE6OF01BFM9E.25.36.D03.1.454.CMB.1.raw
  modified_base (275)..(275): a, c, t, g, unknown or other
  misc_feature (275)..(275): n is a, c, g, or t
  modified_base (281)..(288): a, c, t, g, unknown or other
  misc_feature (281)..(288): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacactttgccagggaccaaggtgagatcaaacgactgtgctgcaccatctgtcttcatcttccgcatctgaactgtacagtctgagcggctggcaaggcncatagnnnnnnnn

SEQ ID NO: 25886 - DNA, 295 bp, Homo sapiens
  misc_feature: GYAE6OF01CN88Y.25.36.D03.1.454.CMB.1.raw
  modified_base (284)..(284): a, c, t, g, unknown or other
  misc_feature (284)..(284): n is a, c, g, or t
  modified_base (289)..(295): a, c, t, g, unknown or other
  misc_feature (289)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtggagatacaaacgaactgtggctgcaccatctgtctcatcttccgccatctgaactgtacagtctgagcggctggcaggcgnatagnnnnnnn

SEQ ID NO: 25887 - DNA, 295 bp, Homo sapiens
  misc_feature: GYAE6OF01BDTUL.25.36.D03.1.454.CMB.1.raw
  modified_base (280)..(280): a, c, t, g, unknown or other
  misc_feature (280)..(280): n is a, c, g, or t
  modified_base (286)..(295): a, c, t, g, unknown or other
  misc_feature (286)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttgccagggaccaaggtgagatcaaagaactgtggctgcaccatctgtcttcatcttcccgcatctagactgtacagtctgagcggtctggacaggcncatagnnnnnnnnnn

SEQ ID NO: 25888 - DNA, 563 bp, Homo sapiens
  misc_feature: GYAE6OF01A29UX.25.36.D03.1.454.CMB.1.raw
  modified_base (314)..(314): a, c, t, g, unknown or other
  misc_feature (314)..(314): n is a, c, g, or t
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggtattttccttttggcttattttaaaggtgtccagtgtgaagtgcaactggtggagtcgtgggggagtcttggtacagcctggcaggccctgagactctcctgtgcagcctctggacttcacctttgatgtattatgccatgctacgtgggtccgnaagcgtcgagggacggcctggagtggtctcgaggtattaggtggtaatggtggtagctagtaggctagtggacggtactcgtggtaggaacgggtccgtattccaacctagtcctacgagacgaaccaacgaccaaacgaccttcccgtagtactcgtacgactaaagtcgaactacgtactagacgagcgtaggacgacgtcggtacttagtaacgttctagtagtaacttaaaagtttacgttaacg

SEQ ID NO: 25889 - DNA, 950 bp, Homo sapiens
  misc_feature: GYAE6OF01DFAKN.25.36.D03.1.454.CMB.1.raw
  modified_base (931)..(931): a, c, t, g, unknown or other
  misc_feature (931)..(931): n is a, c, g, or t
  modified_base (935)..(935): a, c, t, g, unknown or other
  misc_feature (935)..(935): n is a, c, g, or t
  modified_base (937)..(937): a, c, t, g, unknown or other
  misc_feature (937)..(937): n is a, c, g, or t
  modified_base (944)..(946): a, c, t, g, unknown or other
  misc_feature (944)..(946): n is a, c, g, or t
  modified_base (948)..(950): a, c, t, g, unknown or other
  misc_feature (948)..(950): n is a, c, g, or t
tcagactgtacagtcacgaccggtgctcgatttagctgcgtcacgatctctcttgggcagtccaggggaggcctgaagtgggtcggcctcatgagaccggagggcctcgtgggagggacaggtggagcatgacgcgtctctgagtgggctaggttcacgcctcgtacgaaagggaccaactactaaacgcccaatcccgtacctatcgtacgaactaaaatcgaaccacgtcctagaactacggtacgaaacgactacacgtaccctaattacgtttaatttacgttggtacggaccgtaacgtacccgttcggtccgtttcgttccgttacgttacgggttaacgggttttaccgggggttaacttttaacgggttaacgggtaaaccgttaaaacccgttttaaccgttttaacccttaaccgttttaaccctttacccccgaaacgttaacgggtttacgggggttaaccgggtttttaccggggggaaaccggtaaaaccggggggtaaccccgttaacccggggttacctaacggttccccgtttaccccttacccccgtttaacccccaacccccgttaacccccggaaacccggtaaaccccggggtacccccgttacccggtttacccgggtttaccccccgtttccccccggttacccggtacccccgtaccccccgtttaacccgaaacccgtaaaccgggaacccgtaccccgtaacccggttcccggggtaccggggaaccctaacccggacccgggtccccgggtcccggttcgggtcccgttaccggtacccggttaacgggtaacccgtaaaccgggttacccttaaccgttacccgaacgttacgtaccggtaacgttccggtacgggtcgggaccgggtacggtcggaaccggacggtaccgacgtagtacggntagngnagagcgnnncnnn

SEQ ID NO: 25890 - DNA, 294 bp, Homo sapiens
  misc_feature: GYAE6OF01C0CSK.25.36.D03.1.454.CMB.1.raw
  modified_base (155)..(155): a, c, t, g, unknown or other
  misc_feature (155)..(155): n is a, c, g, or t
  modified_base (162)..(162): a, c, t, g, unknown or other
  misc_feature (162)..(162): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (274)..(275): a, c, t, g, unknown or other
  misc_feature (274)..(275): n is a, c, g, or t
  modified_base (288)..(288): a, c, t, g, unknown or other
  misc_feature (288)..(288): n is a, c, g, or t
  modified_base (290)..(294): a, c, t, g, unknown or other
  misc_feature (290)..(294): n is a, c, g, or t
tcagactgtacagtcacgaccggtgctcgatttagctgcgtcacgatctctcgttgggatagaagttattcagcaggcacacaacagaggcagttccagaattcactctcaccatcagcagcctgcagcctgatgtattttgacaacttatactnaccaaanaatataaataattactcacctactttggccagggacaagnganatacaacgaatgtgctgcaccagtctgtctnactcctaccgcatctanactgtacagtctgacggcggnngacgagcacagantnnnnn

SEQ ID NO: 25891 - DNA, 679 bp, Homo sapiens
  misc_feature: GYAE6OF01EEE5C.25.36.D03.1.454.CMB.1.raw
  modified_base (210)..(210): a, c, t, g, unknown or other
  misc_feature (210)..(210): n is a, c, g, or t
  modified_base (615)..(615): a, c, t, g, unknown or other
  misc_feature (615)..(615): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctggcccagtctgtgctgactcagcccaccctgagtcgtcgtcggggacccccggnaggacgggtcctccattcctctttcggttcgtgggagtcaggcctccggaacgttacggaaaattaacggttttcgtactacgtggtaaccaggcaacgccctacccgaaggaaacccgccccgaacgtcctcctcactactaagtacggaatagtatcgacggccgcctacgacggtactaccgtacgaccgtactctacgtcgacgtacggtacgtctcggtccttcccgtaccggtccctccctgggacctacgtcggtacggtcgggtccgtaccgggtaccgtaggagttcggaggtctagtaattacttcgtcgtggtaccgttaggtttacgggacttccggacgttacgtcggtacgtacggttcggggtaccgtacggggttcgggttacccgggnggggaacggtacctaacgcggttaccggaccgttcccgggagtaccgtccgccggtaacccggg

SEQ ID NO: 25892 - DNA, 604 bp, Homo sapiens
  misc_feature: GYAE6OF01CW0I8.25.36.D03.1.454.CMB.1.raw
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (411)..(411): a, c, t, g, unknown or other
  misc_feature (411)..(411): n is a, c, g, or t
tcagactgtacagtcacgaccggtgctcgatttagctgcgtcacgatctctcttggggagctctgggagaggagcccagcactagaagtcggcggtgttccattcggtgatcagcactgaacacagaggactcaccatggagtttgggctgagctgggttttcctcgttgcttctttaaggaggtgtcccatgtcagggtgcaccgtgggtggagtcgtggggggaggcgtggtccagccgtggggacgtccctgagaccttctcctggtagaacgcctgtggtatttaggtttccagttggttctaggcctagtcgctacgtcgggtcccgccgagggtccaccgagggcgaacgggggtccggaggtgggttaggctagtanagcanatgactggaagttcagaaattnttagtcgacagtactccgtagacgggccagttccacatctaccagaacgacaacttcccggaactagttgtagttaacgttaggaaagtggtacaaggtcctaggacgacggtacgacggtaccgtcggtcctgttaggtattactggttgaccggtagacggttacggggaggttgggtaacggttaacggg

SEQ ID NO: 25893 - DNA, 566 bp, Homo sapiens
  misc_feature: GYAE6OF01ART7V.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttgcgggcagtcgagggcattagactaatttatttacgcctaggtatacaacgaagaaaccagggactacgttacctaagcctcctagattctatgctcgacctccaacgttacacgtcgacgggtcccagttcgtcggttcaggtcggctagtacgaatcgtagggacagtacgttcacttctacactatcagcagcctgcacgaccgtagaagtctcgttacgactaactttataccgtgttaaccaaagttactaactaccgtaccgtccccttacgttccgttaaccggtttccgggaacgggtaaccgggtaacgtaaagggtacggtaaagtacgtaaaccgg

SEQ ID NO: 25894 - DNA, 821 bp, Homo sapiens
  misc_feature: GYAE6OF01DEMB3.25.36.D03.1.454.CMB.1.raw
  modified_base (194)..(194): a, c, t, g, unknown or other
  misc_feature (194)..(194): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagcccacctcagtgtccgtcgggacccccggnaggacgggtcctccattctcgtttcgttccgtgggacgcacgcctccggaacgtacgggaaattaagtttcgtctacgtggtaccagcacgcctacccgaagaacccggccccaagtcctcctactattactaagtaacggaattgactccgacggccggtaccctagaacgggtaactacccgtacggaccgtattccgtcgtacggcctacgtaacgttcgtccggtccttcccgtcccgggcctttcccggacggcctaagtccgggtaacgggttccggggtaccccgttccgggggttaccggagggttaacgtcgggtaaccggacgtttaaacgaaccgttttacgtttaaccggtcggtttaacggacggttttaaggggttttcggggtaaacttcgggtacccgttaaagtttccggttaggggttaaccggttccgggggtttacccgggttacggggtttcgggttaccccgggggaaggggtaaacccggtaacggaaccgggtccgttaaccgggtcccggttaaccggtacgggttcccgaaaccggtacccgaacgggttaccccggtcccgtaccccccggtttcggtaacccgttcccgtttaccccgg

SEQ ID NO: 25895 - DNA, 711 bp, Homo sapiens
  misc_feature: GYAE6OF01AFYN8.25.36.D03.1.454.CMB.1.raw
  modified_base (161)..(161): a, c, t, g, unknown or other
  misc_feature (161)..(161): n is a, c, g, or t
  modified_base (256)..(256): a, c, t, g, unknown or other
  misc_feature (256)..(256): n is a, c, g, or t
tcagactgtacagtcacgaccggtgctcgatttagctgcgtcacgagtctctctgggacataacaaccagattcttcctctaaagaagcccctgggagccacagctcatcaccatggactggacctggaggttcctcttgtggtggcagcagctacaggtntccactcccaggtccagcctggtgcaatcgtgggcctgaggtgaagcggcctgggtcctcgggtgagggtcctccgtggtaacggtctccggaancgtagtgtgttcgtacagacataccactcgaaccgtggggtccggcagggcccttgacggaactcgggcctggacgggtgggtacggaacaacgtccgaaccggtccgaacggccggaaacgaaccgtaggacggtcacgtaacgagtccgaagtttcgaacgggtcaaggtaccgttcctaccggttttccggacggtaacctaacggttcccgacgggctaccgtaaggtacgtacgtacgtacgtaacttccgtaacgtaacgttacgaccgttggtacgtacgtttaggacccggtacgtaccgggtaccgttaagttacgtttaacgtcggttacgaccggtaaggtaaacggtacgttacccggacgtacccgttaacgtaaacggtaccggtaacgacggtaccgtaccgacccgttacccgggaccccggttggggtaaacccccgg

SEQ ID NO: 25896 - DNA, 559 bp, Homo sapiens
  misc_feature: GYAE6OF01A5LT0.25.36.D03.1.454.CMB.1.raw
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (498)..(498): a, c, t, g, unknown or other
  misc_feature (498)..(498): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtgtccccaggagggacagtcactctcacctgtgcttccagcgctgggtcagtcaccagtgagaaccatccaaaactggttccagcagaacctggacaaccacccagggcactgatttatggtnacaaactaaaaaacnctctacggacccctgcccggttctcagtcctccctccgttggggaacaaagctcgccctgacactgtccagatgtgcagcctgacggacgaggtcctgacctaccactgccctgcctctctcgtggtggtgtcgttgggtcgttcgggcggtaggacctaacgtcgacccgttccgngggtccacggccgaaggccctccggtccccctcggtcccaccttccgttccgttacccccc

SEQ ID NO: 25897 - DNA, 638 bp, Homo sapiens
  misc_feature: GYAE6OF01D7BBS.25.36.D03.1.454.CMB.1.raw
  modified_base (190)..(190): a, c, t, g, unknown or other
  misc_feature (190)..(190): n is a, c, g, or t
  modified_base (325)..(325): a, c, t, g, unknown or other
  misc_feature (325)..(325): n is a, c, g, or t
  modified_base (441)..(441): a, c, t, g, unknown or other
  misc_feature (441)..(441): n is a, c, g, or t
  modified_base (577)..(577): a, c, t, g, unknown or other
  misc_feature (577)..(577): n is a, c, g, or t
tcagactgtacagtcacgaccggtgctcgatttagctgcgtcacgatctctcttggggagctctgggagaggagcccagcactagaagtcggcgtgtttccattcggtgatcagcactgaacacgagaggactcacatgggagtttgggctgagcttgggttttcctggttgtcttacgtttttaaaggnggttcgtcctactggtccagggttcgcctaccggtgggtggagtcggtaggggggacgcggttggtacccaggtccggtgggacgtcccgtagacgctctacgttggagacgtccctgtaggttactttagttcngttggttcaggctgtgccgtagcgggtcccgaagcggtcctacgagggacgaagggggtcctaggtggtggactagttagcgcagtgtgacgtggtacgttatgtaaattcgttanccgagtacgtccgttcgacggtacgggccttactaccactaacgtccgaacgagtaacgacttacgttacccgaattgttagtcgtaagtaggtaatgggttacacggtgtcggaacgtggtacgagtaccggtcncggtttatgtagttcgtaggtgaccgaagggtgttacggggagttaggttcgttaaacggg

SEQ ID NO: 25898 - DNA, 678 bp, Homo sapiens
  misc_feature: GYAE6OF01BDDAX.25.36.D03.1.454.CMB.1.raw
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtcgtcgtcgggacccccgggnaggacgggtctccagtctctttgttcgtgggancagctccgacgtacgaaattagtttgtctacgtggtaccagcagcctaccgacgaaaccggccccaagcctacctcatctagtaggatgaatcgacgccgccctacgaacggactaccgtagaccgtatttcctcgtcggtcgtacgtaacgtccgtacggccgttcccgtccggccccttcccgtcggcccctaagttccgtacggttccgggtcccgttaccggggtaccgaacgggtagtacggaggtcgtaagtaacgtttagttaacgtgtagtacgttaggtttgggaacgttcgtacccgttagttcgtaacgggttgttaccggggtacccggtacggggttcgggttacggggaccgggtacggggtaaccgtacggtccgtacggtacccggtacgtacggtacccggacgtaccccgtaccggg

SEQ ID NO: 25899 - DNA, 659 bp, Homo sapiens
  misc_feature: GYAE6OF01D8AL6.25.36.D03.1.454.CMB.1.raw
  modified_base (206)..(206): a, c, t, g, unknown or other
  misc_feature (206)..(206): n is a, c, g, or t
  modified_base (314)..(314): a, c, t, g, unknown or other
  misc_feature (314)..(314): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggcctcccagataccagatgtgacgtccagatgacccagtcctccactccctccctgtctgcatctgttgganacagaatcagcatcacgttggccgggcgagtcgagggcagttagctaattattagcctggtatacaacacgaaaccgagggagtacgttacctaagcctcgtgatctntcgctcgcctctacgttacacgtcgacgggtccatcgtcggtacagccggcagtagacgtcgtaggaacagtagttacactctacactactcgtacgaccgacgcccgtgaccgtacgaccgtaaggaacgttagttacgttacgtaaccttaaaaccgttttacgtttaacgttaacgttaaaacttaaaaacggtttaaactttaaaccgttaccgttacccccggttaaccccctttaccggttacccgtttaacccgggtttacccggggaaccggggtaaaccggggttaaacccgtaaagggggttaacgggtaaacggtaaaccggttaaaacccggg

SEQ ID NO: 25900 - DNA, 677 bp, Homo sapiens
  misc_feature: GYAE6OF01EKRRD.25.36.D03.1.454.CMB.1.raw
  modified_base (357)..(357): a, c, t, g, unknown or other
  misc_feature (357)..(357): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgcttcttttaagaggtgtccactgtcaggtgcacctggtggagtcgtgggggaggcgtggtccagccgtgggagtccctgagctctcctgtgaagcctctggtatttagttcagttggttctggcatgcacgtcgggtcccgccgaggcctcgagggcgaaggggccggtaggtggttggcagttanagcacatgatggaagtttcagtaatattatgacagtaccttccggtaggaacggggtaccgtaactttccgaaccctattccctacccgtaaggaacgtaaacccgtaaacgtttacccccgggaaatacgttttcggttacgttaaccggttttagggaaaacgtttcgggtaaccaacgtcccgttaggaacggtacggttcgggaaacgggtacccgttaccgggcctttacgttagggtttaacttaccggttaggtcggtaccggtaaggtacgggttacggggggaagggtttggggttaagggtttaaacggg

SEQ ID NO: 25901 - DNA, 582 bp, Homo sapiens
  misc_feature: GYAE6OF01DF670.25.36.D03.1.454.CMB.1.raw
  modified_base (225)..(225): a, c, t, g, unknown or other
  misc_feature (225)..(225): n is a, c, g, or t
  modified_base (407)..(407): a, c, t, g, unknown or other
  misc_feature (407)..(407): n is a, c, g, or t
tcagactgtacagtcacgaccggtgctcgatttagctgcgtcacgatctctcttggggacataacaaccagattcttcctctaaagaagcccctgggagcacagctcatcaccatggactggactggaggttcctctttgtggtggcagcagctacaggtgtccactcccaggtccagctggtgcaatcgtgggcctggaggtgaagaggcctgggtcctcgggngagggtcctccgtggtaaggtctaccggaagcagtgtgttcgtcagacatacactcacctgggtccggcaggcctctggacgtgggcctggagtgggtgggaacaatacgaaccgccgacgccggaacaacgagacggtcgcacaactcagtttcgagggcagagtctaacccgttttcggnggtaacaagttccgacgggcgacgagtaataacatggtaatctacaatcgtactgtcgtattttcggacgacacggtccgtattacttacgtgtgacgtaagaaaggtcgtaccgtgtaccctaacgtaaaagtccgaacgagctacggcctaccggacccgtggggtaacccgg

SEQ ID NO: 25902 - DNA, 813 bp, Homo sapiens
  misc_feature: GYAE6OF01D1XJQ.25.36.D03.1.454.CMB.1.raw
tcagactgtacagtcacgaccggtgctcgatttagctgcgtcacgatctctcgttgggggcagaagtctctctcagtcaggacacagcatggacatggagggtccctgctcagctcctgggacctcctgctgctcgtcggcctacccagactaccagatcgtagaccgtaccagactcgacccagtcctccacttcccgtcctgtctgctagttcgttggtaggacgacgaagtaactcagtactactaccgtaccggttcgggaccgggtacgtacggtacggagggtactaacgttacggtaacttaagtttacgttacggtccgttaaggtactaaccgaaacgaacggtaaaccggtaggggtaacttacggttaacctaacgtccgttactaggtacttacgtacgtaccggtccttacctacccgttacccgttaacggttaccaaccgggttccggtaacccgggttacccttcgtttaccgggttacccgggttacgaacgggtacggtacctagggttactaaccggttacggtacgggaactttacggtacctttacccgtaccgttacgtaccgtaacgtttaccgacgactcccgggaaccttaccgacggtaccgtaccgtaacgtaaggttaacgttacgtttacggttacttaaaccgttttaactttaacgtaaccttacgttaaaagtaaccgtttaaaactaccgttacccggtaccctaccgttaccgtaccggttaccgggtacgggaccgggttaaacgacggttaagggaacgtaacgtaaccgtaaaccg

SEQ ID NO: 25903 - DNA, 296 bp, Homo sapiens
  misc_feature: GYAE6OF01C69NH.25.36.D03.1.454.CMB.1.raw
  modified_base (262)..(262): a, c, t, g, unknown or other
  misc_feature (262)..(262): n is a, c, g, or t
  modified_base (291)..(296): a, c, t, g, unknown or other
  misc_feature (291)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttccgccatctgaactgtacngtctgagcgggctggcaaggcgcagtagnnnnnn

SEQ ID NO: 25904 - DNA, 296 bp, Homo sapiens
  misc_feature: GYAE6OF01CKAHD.25.36.D03.1.454.CMB.1.raw
  modified_base (292)..(296): a, c, t, g, unknown or other
  misc_feature (292)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatacaaacgaactgtggctgcaccatctgtcttcatcttcccgccatctgaactgtacagtctgagcgggctggcaaggcgcatagnnnnn

SEQ ID NO: 25905 - DNA, 299 bp, Homo sapiens
  misc_feature: GYAE6OF01AHZ5G.25.36.D03.1.454.CMB.1.raw
  modified_base (283)..(283): a, c, t, g, unknown or other
  misc_feature (283)..(283): n is a, c, g, or t
  modified_base (290)..(299): a, c, t, g, unknown or other
  misc_feature (290)..(299): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtgagatcaaacgaactgtggctgcaccatctgtctcatcttcccgccatctgaactgtacagtctgagcgggctggcaaggcncatagcnnnnnnnnnn

SEQ ID NO: 25906 - DNA, 640 bp, Homo sapiens
  misc_feature: GYAE6OF01B4XJL.25.36.D03.1.454.CMB.1.raw
  modified_base (321)..(321): a, c, t, g, unknown or other
  misc_feature (321)..(321): n is a, c, g, or t
  modified_base (341)..(341): a, c, t, g, unknown or other
  misc_feature (341)..(341): n is a, c, g, or t
  modified_base (454)..(454): a, c, t, g, unknown or other
  misc_feature (454)..(454): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccaggtccaaatctcagactgtggtgactcaggacgccctcactgactgtcgtcccgaggagggacagtcactctcacctgtgcttcagcgcgtgggtcagtcacagtgaacgaaccactaccaaacgttcggtaccagacaacgaaacctcggaaccaaccgacccgagggccaacgtgtattagnggtacaacaaaactaaaacnctacgtcgaccctcgtccgttcacgacgcctccgtcggtagggacaacgctacgcccgtagactacgtcgtacagtcttggacacgacgaccgtaggaacgggacgacgggtnaccgtaacgtacctacgtccgtcctacgtcctcccgttcccgtggttcgggttaggtcgttcggttaggggtcgtaccgggacggaacggtacctaacgtcggtcccgtcggtcggtacaacggcccgacggtccctaccccggtccccgtacgtacccgtaccgttcccgtcccgtttacccccg

SEQ ID NO: 25907 - DNA, 605 bp, Homo sapiens
  misc_feature: GYAE6OF01D4E9W.25.36.D03.1.454.CMB.1.raw
  modified_base (321)..(321): a, c, t, g, unknown or other
  misc_feature (321)..(321): n is a, c, g, or t
  modified_base (447)..(447): a, c, t, g, unknown or other
  misc_feature (447)..(447): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcaccgtgggtggagtcgtggggggagcgtggtcccagccgtggggacgtccctgagactctcctgtgaagcctctggtatttagttcagtggttctggctatgctacgtcggggtcccnccgaggcctccgagggccgaaggggggccggtaggtgggttggactaggttatacgcacatgagtaggtaagttctagaatattatgacagtactaccggtaggaacgggccgtaattccaacctntcctaccagaacaacaacgttacccggaatagttgtagttaacgttaggaaatgggtaccagtaccgttaggagaggtaccggaggtaccgtcggtcttcgtagttattacgtgtggacgtaggtacgtagggggtaggttagggttaggttaacggg

SEQ ID NO: 25908 - DNA, 353 bp, Homo sapiens
  misc_feature: GYAE6OF01CWC55.25.36.D03.1.454.CMB.1.raw
  modified_base (163)..(163): a, c, t, g, unknown or other
  misc_feature (163)..(163): n is a, c, g, or t
  modified_base (275)..(275): a, c, t, g, unknown or other
  misc_feature (275)..(275): n is a, c, g, or t
  modified_base (316)..(316): a, c, t, g, unknown or other
  misc_feature (316)..(316): n is a, c, g, or t
  modified_base (320)..(353): a, c, t, g, unknown or other
  misc_feature (320)..(353): n is a, c, g, or t
tcagactgtacagtcacgaccggtgctcgatttagctgcgtcacgagtctctcttgggatagaagtttattcagcaggcacacaacagaggcagttccagaattcactctcaccatcagcagcctggcagcctgatgtattttgcaacttattactgaccaanatataataattattcgacctactttggccaggggtaccaaggtggagtatcaaacgaacgtgtgggactgcaccatctgtctcagttcctcccgcatctagaacctgtaccngttactgacggtcgggcgtcggcaacgggccaccagtacgntcannnnnnnnnnnnnnnnnnnnnnnnnnnnnnnnnn

SEQ ID NO: 25909 - DNA, 317 bp, Homo sapiens
  misc_feature: GYAE6OF01EGQJE.25.36.D03.1.454.CMB.1.raw
  modified_base (301)..(317): a, c, t, g, unknown or other
  misc_feature (301)..(317): n is a, c, g, or t
tcagactgtacagtcacgaccggtgctcgatttagctgcgtcacgagtctctcttgggatagaagttattcagcaggcacacaacagaggcagttccagaattcactctcaccatcagcagcctgcagcctgatgatttttgctaacttattactgaccaaacaatataaataattattcgacctactttggccaggggaccaaggtggagatacaaacgactgtggctgcacatcgtcgtcttcatccttcccgcatctgaactgtacagtctggacgcgggctggcaaggcgcagtagnnnnnnnnnnnnnnnnn

SEQ ID NO: 25910 - DNA, 670 bp, Homo sapiens
  misc_feature: GYAE6OF01DKEWS.25.36.D03.1.454.CMB.1.raw
  modified_base (251)..(251): a, c, t, g, unknown or other
  misc_feature (251)..(251): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctggaggtgaagaggcctgggtcctcggtgagggtctcctgtaaggtctccggaancgagtgtgttcgtcagacatacactcacctggggtccggcaggcctcgtagggaaccgtggggcctggacgggtggggtacggaacgacgtaccgaacccgccgacggaccggaacaacgaggacggtcgacaacgatcgtacgtttcgagggcaggtacgttccgtaaccgttttccggaggtaaccaacggtcccgacggggtcgacgagttaactacagttacgtaatctactaattacggaccttggaccgtagtttcgacggtaaccgcgggtaccgtaatttcttaaccgttgtacggacggtaaaggaaacggtacgtacccgttagacccgttaacgaaaaggttcccgaacgtaacggtccgttaacgggccccttacccgggacccccgggttgggggaaacccccggg

SEQ ID NO: 25911 - DNA, 710 bp, Homo sapiens
  misc_feature: GYAE6OF01C1WSX.25.36.D03.1.454.CMB.1.raw
  modified_base (247)..(247): a, c, t, g, unknown or other
  misc_feature (247)..(247): n is a, c, g, or t
  modified_base (331)..(331): a, c, t, g, unknown or other
  misc_feature (331)..(331): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactggtggtgactcgaggacgccctcactgactgtcgtccccgaggaggacagtcactctcacctgtgcttccagcgcgtgggtcagtcaccagngaagaaccactaccaaaacgttcggttaccagacaacgaaacctaggaaccaaccccgaacccgagggaccactagtatttagnggtacgaacctaaaactaaaaaacctctacgttaccggacccctcggtacccggttctacgtaccggtcccttccccgtccggttacggggactaaacgcgtaccgccctagacctactcgtcgagtcgttacgcgtactacggtccgtagggaacgggaccggtacggaccgtacgtaacctaccgaccgtcggtcccgtacgttcccttccttccgttacggttgggttcggttccgttgggttcgggttcgggttaccgggacgggtaacggaacccgtaacgtccggtacccgggtccggtacgggtaccacggacccgacggtccgtaccccgtccccggtacgtccctacccgttccgtccccggttcccccg

SEQ ID NO: 25912 - DNA, 318 bp, Homo sapiens
  misc_feature: GYAE6OF01D772X.25.36.D03.1.454.CMB.1.raw
  modified_base (292)..(292): a, c, t, g, unknown or other
  misc_feature (292)..(292): n is a, c, g, or t
  modified_base (313)..(318): a, c, t, g, unknown or other
  misc_feature (313)..(318): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgctaacttattactgaccaaactaataataataatttattccgacctacttttggaccgaggggaccgaaggtggagatacaaacgaactgtgctgaccacatctgtcttcatccttcccgcctatctgaactcgtacagtctggagcgggntgggacaagggcacgaatagnnnnnn

SEQ ID NO: 25913 - DNA, 622 bp, Homo sapiens
  misc_feature: GYAE6OF01EC1WC.25.36.D03.1.454.CMB.1.raw
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctggaggtgaagaggcctgggtcctggtgagggtctcctgtaaggtctccggaagctagtgtgttcgtcagacatacactcaccgtgggtccggcaggcctcgtggaactgggcctgaggtgggtgggaacaactcgaacccgccacggaccggaacaacgaggacggtcgcacatcgtagtttcgagggcagacgtctaccgttttccgacggaactaacggtccgacggggccgacgagtaataaccagtacgtaacgtctacgtaagtacgacctacggcgtagtttcggacgggtaaccgaccgggtacccgttaattacgtttacgtgtacggacgtaaggaaaggtacgttaccgtcgtacctaacgaaacgttccgaacgacgtcgtacggtcctaccgtaccccggtgggaaccccggg

SEQ ID NO: 25914 - DNA, 757 bp, Homo sapiens
  misc_feature: GYAE6OF01EVRB8.25.36.D03.1.454.CMB.1.raw
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggtatttttcctttggcttattttaaaggtgtccagtgtgaagtgcaactggtggagtcgtgggggaggcttggtacagccgtggcacggcccctgagactctccgtgtgcacgcctctggtattcctacctttgattgtatttactgaccctagtcgtaccgaccggttcggggtacccggactaacggtcccgtacccggaagggggaaaccgggtcccgtagggggtacggttcggggtacttcggtaagggttaattttaagggttacggtaaagttagggttagggtaaggtaccgtaagttacgggtcttaaggtcggccgggttaacgttcggtagggtacgggtaacgggtacccgtaagtttaccaaccctattcccgtaccaaacggaaccggtaaccaaccggacccctaaacggaaccccttaccccgttagttacctacgtaccgtaacgaaacgtaaccggaaacgttacggtaccgtaggacgtaaccggtacgtacggaacggtacccggtaccggttccgtttaagttaaccgtttaaccgttaggtaacgttaaaacctttaaaaagtttaacgttaaacgg

SEQ ID NO: 25915 - DNA, 845 bp, Homo sapiens
  misc_feature: GYAE6OF01EYL6S.25.36.D03.1.454.CMB.1.raw
  modified_base (264)..(264): a, c, t, g, unknown or other
  misc_feature (264)..(264): n is a, c, g, or t
  modified_base (356)..(356): a, c, t, g, unknown or other
  misc_feature (356)..(356): n is a, c, g, or t
tcagactgtacagtcacgaccggtgctcgatttagctgcgtcacgatctctcttggggagctctgggagaggagcccagcactagaagtcggcggtgttccattcggtgatcagcactgaacacagaggactcaccatgggagtttgggctgagcgttggggtttttcctcgttgcttacttttaaggaggttcgtccactggtcaggtcgcaccgtgggtggagtcgtggggggagtcggtggtccagccgtgggacggtccnggacgaccttctccgtggtgaacgccctgtggttattttaggttcgtaggttcggttctgggactagttcggcctacgggttcggggtcccnccggacgggccgtacccggaaggggaccgggtaaacggggggtcccggtagggttcggggttacggaccgttaaggtttacgacggtaccgtaactaggttacgggaagttacggggtaaacgttttcgaaggttaaactttaaggtttaaagtacgggtaaaacggtacccggttacccgggtaacggggtaaccggggtacccgttaaacgttacccgaacccgtacttacccgtaccgtaacggtaaacggtaaccgttaaaccgtttaccccgggtaaacttacgggttttacggtacggtttaaacggttaagggtaaacgttccgggtaacgtacggtccgtaaggacggtacggtacggacggtacggttccggacgttacgttacggttaattacggtggtacggtaccgggaaggggttaaccgggttacggggggttaagggttacggggtttaaggttaccgggttttaaaccggggg

SEQ ID NO: 25916 - DNA, 303 bp, Homo sapiens
  misc_feature: GYAE6OF01DTSB6.25.36.D03.1.454.CMB.1.raw
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
  modified_base (298)..(303): a, c, t, g, unknown or other
  misc_feature (298)..(303): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgaccaaacaataataataattattcgacctactttggccaggggaccaaggtggagatacaaacgaactgtggctgcaccagtctgtcttcatccttccgcatctagaactntacatctagagcgggctggacaagggcncatagnnnnnn

SEQ ID NO: 25917 - DNA, 301 bp, Homo sapiens
  misc_feature: GYAE6OF01EVXSG.25.36.D03.1.454.CMB.1.raw
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (287)..(301): a, c, t, g, unknown or other
  misc_feature (287)..(301): n is a, c, g, or t
tcagactgtacagtcacgaccggtgctcgatttagctgcgtcacgatctctcttgggatagaagttattcagcaggcacacacagaggcagttccagaattcactctcaccatcagcagcctgcagcctgatgattttgcaacttattactgccaacaatataataattattcgacacttttggccaggggaccaaggtggagatcaaaacgaactgtggctgcaccatctgtcttcatcttcccgcatctgactgtacngtcngagcgggctggcaaggcanacgnnnnnnnnnnnnnnn

SEQ ID NO: 25918 - DNA, 764 bp, Homo sapiens
  misc_feature: GYAE6OF01DIP0E.25.36.D03.1.454.CMB.1.raw
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggcctcccagataccagatgtgacgtccagatcgacccagtcctccactccctccctgtctgcatctggtgagacaagancagacatctacgttcggccggngacgtcgaggctattacgactaatttattacgtccgtaggtactacaaacgaacggaaaccgaaggtacgtacgtacccgtaagtcctaccttagaacttcgtaacgtcgtccgttaccgtaccccgttaaccgtaacccgtttaaccacccggtttccggaacccggggttaccctacggttaccgttccgggtttaacgaccggggtaccgtccgtaagttacggtaacgttaccgggtaggaaccgtaagttacgttaccgtaacctccgtactacgtaatccggacaccgtacgtccgtacggaccacgacccgttaaggtaaccggttagttgggttaaacccgtaacgtttaaacctttaaccgttacgttaaagttaaacccggtaaaaatttaccgtaaaaccgtttacccggttaccccgtacccccgtttacgttaacccgttacccgggtttaacgggaaccccgggtaacgggtaaacccggaagggttaaccgaaacgaacggttaaaaaccccgg

SEQ ID NO: 25919 - DNA, 315 bp, Homo sapiens
  misc_feature: GYAE6OF01AK38Q.25.36.D03.1.454.CMB.1.raw
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (303)..(315): a, c, t, g, unknown or other
  misc_feature (303)..(315): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtggagatacaaacgaactgtggctgcaccatctgtcttcacttccttcccgcatctgaactgtacagtctgacgcgggctcggacgaggcncgatagntncnnnnnnnnnnnnn

SEQ ID NO: 25920 - DNA, 292 bp, Homo sapiens
  misc_feature: GYAE6OF01CH5UE.25.36.D03.1.454.CMB.1.raw
  modified_base (258)..(258): a, c, t, g, unknown or other
  misc_feature (258)..(258): n is a, c, g, or t
  modified_base (289)..(292): a, c, t, g, unknown or other
  misc_feature (289)..(292): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctactttggccaggggaccaaggtggagatacaaacgactgtggctgcaccatctgtcttcatccttccgcatctgaactntacagtctgagcgggctggcaggcgcatagnnnn

SEQ ID NO: 25921 - DNA, 345 bp, Homo sapiens
  misc_feature: GYAE6OF01B1I0M.25.36.D03.1.454.CMB.1.raw
  modified_base (310)..(345): a, c, t, g, unknown or other
  misc_feature (310)..(345): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattatcgacactttggccagggaccaaggtggagatacaaacgaactgtgctgcaccatctgtctcatccttcccgcctatctagaacttgtacacgtctggacggcgggaccgttgggactaaacggggcacgaagtagcannnnnnnnnnnnnnnnnnnnnnnnnnnnnnnnnnnn

SEQ ID NO: 25922 - DNA, 681 bp, Homo sapiens
  misc_feature: GYAE6OF01BGG9K.25.36.D03.1.454.CMB.1.raw
  modified_base (469)..(469): a, c, t, g, unknown or other
  misc_feature (469)..(469): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggctgggtcctcggtgagggtctccgtgtaaggtcgtcggagcagtgtgttcgtcagacatacactccaccgtggggtccgcgacggcctacgtcgggaacgtcggggcctggaggtcggggtacgggaacaacgtaccgaacccgccgaacggaccggaaccaacgaggacggtcgacacacgtacgtacgttcgagggtactaggacggttccctaccgttttccgaggaacctaacggtccgacgggcgacgaagttanacgatggaactctacaacgtcaacccgtgacgttagttacgggaccgacggtaaccgggtccgttaagttactttacgtggttacggaacggtaaagaaacggtaaaccgtttccggtaccgtaacccgtaaaccgtaaaagggttcccgaaagaacgggtcgtacgggtaccccggaccccgtccccggggttaacccggggaaccccggg

SEQ ID NO: 25923 - DNA, 864 bp, Homo sapiens
  misc_feature: GYAE6OF01DI2HD.25.36.D03.1.454.CMB.1.raw
tcagactgtacagtcacgaccggtgctcgatttagctgcgtcacgatctctcttggggtctggcgccaggggtcccttccaatatcagcaccatggcctggactcctctctttctgttcctcctcacttgctgcccaggtccaaatctcagactgtggtgactcaggagccctcactgactgtcgtcccgaggaggacagtcactctcacctgtgcttcagcgcgtggtcagtaccaccagtgaagaaccataccaaacgttcggttaccagacaacgtaaaccgtacggaaccaaacccgacccgagggacctacgtagtatttaacgtcggtacaaacaaaactaaaaaactcctacgttaccggaacccctcgtacccggttacctacgacggtccttcccgtcggttacggggacctaaacgtccgtacgtacccgttagaaccgtacgttacgtaccgagtagttacgtcgaccgtaacggaccggttacgggaacgggaaccggtaacggtaccgttaaccgtaaacccgttaaccccgtaaccgttcccgggttcccttacggttccccttaacccgtttcccggtttcggttacgggggtttcggtacgggttttcccggggttttaagggggttccggggtttaacccgggggaccggggtaaaccggggttaaaaccccgttaaaaccggttccccggggttaaccccggttaccggggtttacccggggtaaaccctaaccccgggggtccccggtaaaaccgggttcccccgttacccccggggtaccccccgtttacccggggtaaccctacccccggttttccccggttaacccccggtttccccccccg

SEQ ID NO: 25924 - DNA, 303 bp, Homo sapiens
  misc_feature: GYAE6OF01CL5CY.25.36.D03.1.454.CMB.1.raw
  modified_base (240)..(240): a, c, t, g, unknown or other
  misc_feature (240)..(240): n is a, c, g, or t
  modified_base (288)..(288): a, c, t, g, unknown or other
  misc_feature (288)..(288): n is a, c, g, or t
  modified_base (295)..(303): a, c, t, g, unknown or other
  misc_feature (295)..(303): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaataataataattattcgaccacttttggccaggggaccaaggtggagatacaaacgaactgtggctgcaccatctgtcttnatccttcccgccatctgaactgtactagtctgagcgggctggcaggcncagtagnnnnnnnnn

SEQ ID NO: 25925 - DNA, 306 bp, Homo sapiens
  misc_feature: GYAE6OF01C6D9D.25.36.D03.1.454.CMB.1.raw
  modified_base (235)..(235): a, c, t, g, unknown or other
  misc_feature (235)..(235): n is a, c, g, or t
  modified_base (294)..(306): a, c, t, g, unknown or other
  misc_feature (294)..(306): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattatgccaacatataataattatcgaccacttttggccaggggaccaaggtggagatcaaagaactgtggctgcaccatcgtgtcttnattccttcccgccattctgaactgtaccagtctggagcgggctggacaggcgctaatgnnnnnnnnnnnnn

SEQ ID NO: 25926 - DNA, 909 bp, Homo sapiens
  misc_feature: GYAE6OF01BG9AR.25.36.D03.1.454.CMB.1.raw
tcagactgtacagtcacgaccggtgctcgatttagctgcgtcacgatctctcgttggggagctcgtgggagaggacgcccagcactagaagtcggcggttgttccagttcggtgatcagcactgaacacaggaggactcaccagtggtagtttgggctgagtcgtttcgggttttcctcgttgtctttacgttttaaggaggttcgtcctacgttgtcgaggtcgcctaccgtgggtggaggttcggtggggggacggtcggttcggtcccaggtcccgtggggtacggttcccgtaggacgtaccttccgttccgtggtacgtaacgtcccttagttaggttaatttttaggtttcgtaggttcggttacgtcggactagtcggccgtacggttccggggtcccgacgtacgggtcctaccggaagggtaccgggaacggggggtcccggtaggttcggggttcggacgttaaggttagtacggctaacgtagttaggtaacgttagggtaactttcgtaaaggttaaatttacgttagtacggacgtaacggtacccgttaccgggtaagggtaaccggggtacctaacgttacccgtaaccgttaacgttacccgtaaccgtaacgggtaaaccgtaaccgtttaaaccggttacccggaaacgtttagtttacgggttaaacgtttaaccggttaacgggtaaacggtttccgggtaccgtaaccgggttacccggttaagggaaccgggttaacggtacccgggtaacgggtacccggtttaccggtaccgtttacggtttaacggtttaacggtttaaccggtgggttacccgggaagggttaacgggttaccggggttaacgggggttaagggtttacgggtttaagggtttaaacccgggg

SEQ ID NO: 25927 - DNA, 327 bp, Homo sapiens
  misc_feature: GYAE6OF01C5GQA.25.36.D03.1.454.CMB.1.raw
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (307)..(327): a, c, t, g, unknown or other
  misc_feature (307)..(327): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgactaacttattactgaccaacaataataataattattcgacctacttttggccaggggaccaaggtggagatacaaacgactgtggctgcaccatctgtcttcatctccncggggggatctgactgtacngtcgtgagcggacgtggacgaacggcgacagtacgnnnnnnnnnnnnnnnnnnnnn

SEQ ID NO: 25928 - DNA, 712 bp, Homo sapiens
  misc_feature: GYAE6OF01C0BG2.25.36.D03.1.454.CMB.1.raw
  modified_base (172)..(172): a, c, t, g, unknown or other
  misc_feature (172)..(172): n is a, c, g, or t
  modified_base (186)..(186): a, c, t, g, unknown or other
  misc_feature (186)..(186): n is a, c, g, or t
  modified_base (203)..(203): a, c, t, g, unknown or other
  misc_feature (203)..(203): n is a, c, g, or t
tcagactgtacagtcacgaccggtgctcgatttagctgcgtcacgatctctcttgggggcagcagtctctctcagtcaggacacagcatggacatgaggtccctgctcagctccgtgggactcctgctgctctggcctcccaggtaccagctgtgacatccagatcgacccngtcctcctcttccngtctgcatctgtggganacagagtccacatcacgtcggccggacgacgtacgacggactaacttaacctaaatttatttacgaccgttaggtactaccaaaccaaccgaaaaccgaagggaaacctacccgtaaacgtcctaccgtagtacttacttacttactcgacctactccctaccttgaccgtagtcgacgggtccctatcctcgtactcgacgcggctaggtcgatcgtaggactagtattcgagttcctaccaacctactcccggaccgtcctacgaccgtacgtcccgtagtaccgtaccgtttacgtacgtaccttaaacgtttacctttaacgttaacgttaaaccctaaaccgtttacgtaaccgttacccgtaaccggttacccgttacccccggttaaacgtttaccggggttttacccgggaacccgggtaaacccggggtaacccctaacgggtaaccggttaacccggaacccgttaaaacgggtaaaccgggttaccgttaacccgggg

SEQ ID NO: 25929 - DNA, 369 bp, Homo sapiens
  misc_feature: GYAE6OF01C9CKV.25.36.D03.1.454.CMB.1.raw
  modified_base (85)..(85): a, c, t, g, unknown or other
  misc_feature (85)..(85): n is a, c, g, or t
  modified_base (120)..(120): a, c, t, g, unknown or other
  misc_feature (120)..(120): n is a, c, g, or t
  modified_base (238)..(238): a, c, t, g, unknown or other
  misc_feature (238)..(238): n is a, c, g, or t
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (312)..(369): a, c, t, g, unknown or other
  misc_feature (312)..(369): n is a, c, g, or t
tcagactgtacagtcacgaccggtgctcgatttagctgcgtcacgatctctcttgggatagaagttattcagcaggcacacaacngaggcagttccagaattcactctcaccatcagcancctgcagcctgatgtattttgcaacttattactgccaacaatataataattattcgacctattttggccaggggaccaaggtggagatccaaagaacctgtgctgcaccatctgtctnatcgttccccgcatctgaacttnacatctgacgcggcgtcggacaagggccnaagtgcgntgnagccaagtnannnnnnnnnnnnnnnnnnnnnnnnnnnnnnnnnnnnnnnnnnnnnnnnnnnnnnnnnn

SEQ ID NO: 25930 - DNA, 530 bp, Homo sapiens
  misc_feature: GYAE6OF01CFY3I.25.36.D03.1.454.CMB.1.raw
  modified_base (331)..(331): a, c, t, g, unknown or other
  misc_feature (331)..(331): n is a, c, g, or t
  modified_base (398)..(398): a, c, t, g, unknown or other
  misc_feature (398)..(398): n is a, c, g, or t
  modified_base (433)..(433): a, c, t, g, unknown or other
  misc_feature (433)..(433): n is a, c, g, or t
  modified_base (473)..(473): a, c, t, g, unknown or other
  misc_feature (473)..(473): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtcgtccccaggagggacagtcactctcacctgtgccttccagcgatgggtcagtcaccgagtgagaaccataccaaactggttccagcaagaaacctggaacaacccacccgagggcactgtatttagtggtgacaaaactaaaaacnctctacggaccctcgccgttctcagcctccctccgtggggacaagctcgccctgactacgtgtcagntgtcgcacgcgtggacggacgaggctcgactaccnctcgcctcgctctctgtggtgtgtcgttgggtcgtcgggnggacggacacgtcgaccgtcgtggcacgccagcctcgccctcgctctctccgtcccc

SEQ ID NO: 25931 - DNA, 296 bp, Homo sapiens
  misc_feature: GYAE6OF01ADB3O.25.36.D03.1.454.CMB.1.raw
  modified_base (288)..(296): a, c, t, g, unknown or other
  misc_feature (288)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttatactgccaacaatataataattattcgaccacttttggccaggggaccaaggtggagatcaaacgactgtggctgcaccatctgtcttcatctcccgcatctgaactgtacagtctgagcgggctggcaaggcgcagtagnnnnnnnnn

SEQ ID NO: 25932 - DNA, 380 bp, Homo sapiens
  misc_feature: GYAE6OF01DBIBE.25.36.D03.1.454.CMB.1.raw
  modified_base (331)..(331): a, c, t, g, unknown or other
  misc_feature (331)..(331): n is a, c, g, or t
  modified_base (333)..(380): a, c, t, g, unknown or other
  misc_feature (333)..(380): n is a, c, g, or t
tcagactgtacagtcacgaccggtgctcgatttagctgcgtcacgatctctcttgggatagaagttattcagcaggcacacaacagagcagttccagaattcactctcaccatcagcagcctgcagcctgatgtattttgactaacttattactgaccaacaataataataattatcgacctactttggcgtaggggaccaagggtggagataacgaaacgaactggtcggctgaccacatctgtcctatactcctcccgctatctacgtaactcgtaacgtgtaccgtggacggtccgggacgtcggaccgaacgggtccgagaagtggnannnnnnnnnnnnnnnnnnnnnnnnnnnnnnnnnnnnnnnnnnnnnnnn

SEQ ID NO: 25933 - DNA, 671 bp, Homo sapiens
  misc_feature: GYAE6OF01DZA0S.25.36.D03.1.454.CMB.1.raw
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcgaggacgccctcactgactgtcgtcccgaggacggacagtcactctcacctgtcgcttaccgagcgcgtcggtcacgtacaccgagtacgaacaacctactacctaaacgttcggtaccaagtacgaacgaacgtacggaaccaacctacccgagggacaacgtacgtagtttagtcggtacgaactaaaactaaaaactctacgtacggacccctacgtcccgttactacgacgtacctcccgtcggtacgggaacaacgtcgtacgcctagactacgtacgtacagttacgtcggactaccgagtaccgtaggaaccggtacgacggtactacggaacttaaccggctaccggccttacgtccttctccgtagttcggtcggtacgtttcggtggggttcgtaacgggccggtaacggaccctaacggtcgacccggtttacgcggtacgacgtacccggagttcccgacccgtccccgtagccctacttccgtcccgtacccc

SEQ ID NO: 25934 - DNA, 602 bp, Homo sapiens
  misc_feature: GYAE6OF01AV0J0.25.36.D03.1.454.CMB.1.raw
  modified_base (207)..(207): a, c, t, g, unknown or other
  misc_feature (207)..(207): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacgaggtgtccactcccaggtccagctggtgcatcgtggctggaggtgaagnggccgtgggtcctggtgagggtctccgtgtaaggtcgtaccggaagcagtgtgttcgtcagacatacactcaccgtgggtccgcaggcctcgtggaactgggcctggaggtggggtgggaacaagtaccgaaccgccaccggaccggaacaacgaggacgtcggcacgatcgagttcagggcagagtctacccgtttcgcgacgaacgtccgacgggcgcagtacacagtgaatctactaagtgtactgacgtagtttcggacggtaccgtaccggcgttaattacgttacgtgtcgacggaagaaacggtacgtccgtcgtacctaacgtaaacggtaccgaacgtacgacgtacgggtaccgtacccggaccccggtcggggtaacccccggg

SEQ ID NO: 25935 - DNA, 334 bp, Homo sapiens
  misc_feature: GYAE6OF01DON1R.25.36.D03.1.454.CMB.1.raw
  modified_base (153)..(153): a, c, t, g, unknown or other
  misc_feature (153)..(153): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (302)..(334): a, c, t, g, unknown or other
  misc_feature (302)..(334): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattacngaccaaataataataaatattatcgaacctatttggaccaggggaccaaggtgagatacgaaacgaactgtggcngctaccagtcngtctcgatccgtccnctanctagaacctgtacagtcngagcggctggacacggtcnaatgncnnnnnnnnnnnnnnnnnnnnnnnnnnnnnnnnn

SEQ ID NO: 25936 - DNA, 332 bp, Homo sapiens
  misc_feature: GYAE6OF01EE2XY.25.36.D03.1.454.CMB.1.raw
  modified_base (298)..(298): a, c, t, g, unknown or other
  misc_feature (298)..(298): n is a, c, g, or t
  modified_base (300)..(301): a, c, t, g, unknown or other
  misc_feature (300)..(301): n is a, c, g, or t
  modified_base (303)..(332): a, c, t, g, unknown or other
  misc_feature (303)..(332): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattacctgccaacaatataaataattattcgacctacttttggccagggaccaaggtgaagatcaaacgaactgtggctgccaccatctgtcttcatcttcccgctatctgaactgtacagtctagagcgggctggcaagggcgacagtagnannannnnnnnnnnnnnnnnnnnnnnnnnnnnnn

SEQ ID NO: 25937 - DNA, 412 bp, Homo sapiens
  misc_feature: GYAE6OF01C3LN9.25.36.D03.1.454.CMB.1.raw
  modified_base (233)..(233): a, c, t, g, unknown or other
  misc_feature (233)..(233): n is a, c, g, or t
  modified_base (385)..(412): a, c, t, g, unknown or other
  misc_feature (385)..(412): n is a, c, g, or t
tcagactgtacagtcacgaccggtgctcgatttagctgcgtcacgatctctcttgggatagaagttattcagcaggcacacaacagaggcagtccagaattcactctcaccatcagcagcctgcagcctgattgtattttcgactaacttattactcaaccaaataataattaataattacttaccgaccttacgtttcgggaccgaaggggaaccgaagggtaggaagtaanaaccgaaacgtaacgtggtacggctcgacctaactgttctcgttccttactaccttcccttcccgactacttccgtaagtaccgttacgtaacgtcgtcggtaggcggggtccggtacggtacggaaccgaacgggtccaatagagcttgannnnnnnnnnnnnnnnnnnnnnnnnnnn

SEQ ID NO: 25938 - DNA, 777 bp, Homo sapiens
  misc_feature: GYAE6OF01EBUJ9.25.36.D03.1.454.CMB.1.raw
  modified_base (134)..(134): a, c, t, g, unknown or other
  misc_feature (134)..(134): n is a, c, g, or t
  modified_base (160)..(160): a, c, t, g, unknown or other
  misc_feature (160)..(160): n is a, c, g, or t
  modified_base (593)..(593): a, c, t, g, unknown or other
  misc_feature (593)..(593): n is a, c, g, or t
  modified_base (645)..(645): a, c, t, g, unknown or other
  misc_feature (645)..(645): n is a, c, g, or t
tcagactgtacagtcacgaccggtgctcgatttagctgcgtcacgagtctctcgttgggggcagcagtctctctcagtcaggacacagcagtggacagtggacgggtccctgctcaggctccgtcgggtctccngtctgctcgtcggcctcccgagtccngtctcgtacgactactaccgtagtacgttaccgacccttcggtttccctttcccgtttacccttccgtgttccgttaagccgtagttcgggtcggtaagggacactaggtactcctaactcgttacgtcggtccgggcggtacgaccgtacgtaacggtaacctaacgtttaaaccgttaagtttaccgttaacggtacgttacgtaacctaaaccgaaaacccgtaaaaccggtaaaaccggtaacgggttaaaaccgtacccgtaaacttccttaaccgtgtaacttcgttaaccgtttcacgttcctaacccgttccgtaaccggttcgacgttacggttacccggaaccgttcctcgttacctcggttcgacgcggtcgctgggtacgtcggttacggacgtacgtagttacgttcgtcgtaaccgttnacccgggttatcccggtaccgcgttacgcctcgtaccgattcgacgttactntaacgtttaccgttactacggttaacctaacgtacgtaaccgacgttccgttaaaccggccgtttaacccggtggtacccgtacgggtccaaccggtctaccgaccgtactaccgacgtaacggcgttacgg

SEQ ID NO: 25939 - DNA, 739 bp, Homo sapiens
  misc_feature: GYAE6OF01AV7XV.25.36.D03.1.454.CMB.1.raw
  modified_base (90)..(90): a, c, t, g, unknown or other
  misc_feature (90)..(90): n is a, c, g, or t
  modified_base (227)..(227): a, c, t, g, unknown or other
  misc_feature (227)..(227): n is a, c, g, or t
tcagactgtacagtcacgaccggtgctcgatttagctgcgtcacgagttcgtctcttggggagcttcgagcctgtggtaggagaacgacnggtattcaggacaatctccagcatggccggcctccctctcctcctcaccccgtccttcgactcactgtgctagggtcctgggccctagttactgtgctgactcgagccaccctcgagtgtccgtcgggacccccggntaggacgggtcctccgagtcctcgttcgttcgtgggagcagctccgacgtacgaacttacgtttgtctacgtcgtaccagcacgctacccgacgaaccggcccccaagccgtcctacacgtacgtagtacggaactgaatacgaacgccggtccctacgacggggtactaccgtacggaaccgtacgtttcctacgttcggccgttacgtaaacggttcctaggtcccttcccgtacccgggtccccttacccgtcggaccgtacgttccgacggttaccgggtccgttcccgggtaccggaggtacgttacgggacggtacgtaagtaaacttactttaccgttaggtcgtaccgtaagggtttacgggacgttacgtacctaggttccttaggtaacgttcggttacccggtacgggttcggtttccggggacggtaacgggacccgtaacggtccgttaaccggtacccggtttccgtaacgggtcctaacggtccccgggtaaccggg

SEQ ID NO: 25940 - DNA, 753 bp, Homo sapiens
  misc_feature: GYAE6OF01BJUTE.25.36.D03.1.454.CMB.1.raw
  modified_base (224)..(224): a, c, t, g, unknown or other
  misc_feature (224)..(224): n is a, c, g, or t
  modified_base (461)..(461): a, c, t, g, unknown or other
  misc_feature (461)..(461): n is a, c, g, or t
  modified_base (525)..(525): a, c, t, g, unknown or other
  misc_feature (525)..(525): n is a, c, g, or t
tcagactgtacagtcacgaccggtgctcgatttagctgcgtcacgatctctcttggggagcttcagctgtggtagagaagacaggattcaggacaatctccagcatcggccggcctccctctcctcctcaccctcctcactcactgtgcgacgggtccgtcgggcccagtctgtcgctgacctcacgcccacctcgtagtcggtccggtccggggacccccggngacgggtacgggtcctccgtacttccttcgtttggttcggtgggacgccgacgtccgtaccggtacggttaacggtaaactttacggtttcgtaccgttacgtacggtaaccgacgcgaaccgtccgtaaccccgaaccggaaaccccggtcccaacgtcctacctacacttacgtaagtacgaagttacgacgtaccgacggtcccgtccgtacggaacggtctaccgtagacctnttccgtcgtgtacctacgtacgttcggttccgcccgttcccggtcccggtaccctttcccgggngtaccctaggttcgggaccgggttccgggtacccggtccggtacgggaggtcgtacgggacgtacgttacgtaacgtttagttacgtcggtgttacgggttaagggttcgtaccggtcgtacgttacggtggtcgggtaacggttccgggtaccggtcgggttacgggcgggacggtacggagtccgtacgaccggttaccgagttaccggcgtaccgccggtaccgg

SEQ ID NO: 25941 - DNA, 299 bp, Homo sapiens
  misc_feature: GYAE6OF01AJ3UJ.25.36.D03.1.454.CMB.1.raw
  modified_base (281)..(281): a, c, t, g, unknown or other
  misc_feature (281)..(281): n is a, c, g, or t
  modified_base (286)..(299): a, c, t, g, unknown or other
  misc_feature (286)..(299): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgtacaaaaatttgacagtgacccgtggatgttcggccaggaccaaggtggacatcaaacgactgtggctgcaccatctgtcttcatcctcccgcatctgaactgtacagtctgagcggctggacaggcncatgnnnnnnnnnnnnnn

SEQ ID NO: 25942 - DNA, 813 bp, Homo sapiens
  misc_feature: GYAE6OF01BJ90E.25.36.D03.1.454.CMB.1.raw
  modified_base (238)..(238): a, c, t, g, unknown or other
  misc_feature (238)..(238): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctcagtgtcgtcggggacccccgggcaggacgggtcctccatctcttgttcgngggagcagcctccgacgtacggaaattaagtttgtctactggtaccagcacgctacccgaacgaaccggcccccaagcctcctcatctataggaatgatcgagccggccctcgacggactaccgtcgaccgtacttctcgtcggcgtcggaagtccgtacggcccttcccgtcccgggtccccttaccccggtcggaccctacggttccgaacgggttccggggtcccgttcccgggggtcccggaaggggtacgttacggggtaacgggtccgtttaaggtaaactttaacgttttaccgttacgggttcgggtaccgtttaaggggtttttacgggggtaacgttccgggtaaccccgttaagggtttcccgttaacggggtaacgggtttccggggggttaccccgggttaaccggggggtttacggggttaccccgggggttaccggggggaaacccggggggtaaacccgtaaacggggtccccggtttaacgggtacccccccgggttttaacggggtaacccggggttacccggtaaaccccggggacccccgggttaaacccggggg

SEQ ID NO: 25943 - DNA, 365 bp, Homo sapiens
  misc_feature: GYAE6OF01CP921.25.36.D03.1.454.CMB.1.raw
  modified_base (342)..(342): a, c, t, g, unknown or other
  misc_feature (342)..(342): n is a, c, g, or t
  modified_base (349)..(365): a, c, t, g, unknown or other
  misc_feature (349)..(365): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtatttgactaacttattactgaccaataataattaaataatttacttccgacctacgtttggaccgtaaggggaaccaagggtggaagtaataaccgaaaacggtaaccgtggtcggctcgacctacctatcgtgttacctctacttccctcccgcattactacgtaactgtacaggtcgtggacggcggtcgtggacgacggccganagtacgnnnnnnnnnnnnnnnnn

SEQ ID NO: 25944 - DNA, 743 bp, Homo sapiens
  misc_feature: GYAE6OF01C03K9.25.36.D03.1.454.CMB.1.raw
  modified_base (227)..(227): a, c, t, g, unknown or other
  misc_feature (227)..(227): n is a, c, g, or t
tcagactgtacagtcacgaccggtgctcgatttagctgcgtcacgatctctcttggggagagaagacaggattcaggacaatctccagcatggccggcctccctctcctcctccaccctcctcactcactgtgcagggtcctgggcccagtctgtgctgactcagcccaccctcagtgtcgtcggggacccccgggcaggacgggtctccatctcttgttctgggancagctccgacggtcggaaatagtttgtctatcggtaccagcagcctacccaacgaaaccggccccaagcctcctcatctataggaatgatcgagccgcctacgagggactaccacgaccgtattcctcgtggctacgaacgttcgtcggtcctcccgtccggcccgttccctcggacctatcggacgggttcggggtcccgttcccggggtaccggtaggacggttacgggacgggtaccttaaggtaatttacgtttacgttcggttacggtacgtttaaggggtttttaggggactttccgggaccgtaacgttccggttagggtacgggttccgggtccgggtacggggtttcggggttacggggacggggtaacgggtaaccgtaaacggtccgttaccgggaaccccggtttccggaacgggttacccggaaccggccccggaaaccggggttccccggttacccggtccccccccggtttaacgggtccccgttaacccgtttcccccgg

SEQ ID NO: 25945 - DNA, 301 bp, Homo sapiens
  misc_feature: GYAE6OF01CCINI.25.36.D03.1.454.CMB.1.raw
  modified_base (296)..(301): a, c, t, g, unknown or other
  misc_feature (296)..(301): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgcctaacaatataataattattcgaccactttggccagggaccaaggtgagatcaaacgaactgtggctcgcaccatactgtcttcatccttcccgcctatctgaacttgtacagtctgagcgggctggacaaggccgcatagnnnnnn

SEQ ID NO: 25946 - DNA, 862 bp, Homo sapiens
  misc_feature: GYAE6OF01BRWNQ.25.36.D03.1.454.CMB.1.raw
tcagactgtacagtcacgaccggtgctcgatttagctgcgtcacgatctctcttggggagctctgggagaggacgccccagcccctgagattcccaggtgtttccattcagtgatcagcactgaacacagaggactcaccatggagttgggactgagctggtattttcctttggcttaattttaaaaggtgtccagtgtagaagtgcaacgtggtggtaggtcggtggggggaggtcgttcgggtacagtcccgtggaccgacgggcccctaggacgaccttccgtccgttggttacggcctacggtcccttcgttacgggtaaccttttacctaccgtttttggaacttaggtaactttatccggtacctagttcgccgtacccggttcggggtccccggacgtaacggtcccgttaccggaaaggggggtaaccgggtccgttacggggtacgggttcggggttaccttacgggttaaacgggttaggtttacgggttagggtaaacgttacggggttagggttacgacgtaacgggttaaggtccgttaaggttcccggacgggttaccctttacgggtcggttaacgggggaaaccccggttcccgtaacgtttaaccccgacccttaacggtcctaccgaaaggtaccggaacccgaaccgtaacccgaaacgttaaccccgttccgttaggaacctttacccgtaagtaacccgttaaagtcggtaaaaccttcggtaacggtaccgggtagtaaccgggtacgtaacgggtacccgggaacgtttccccggacggttttagtaaaacttcgggttacgggtaaattaaaacgttaaaagttttggttaaaccggg

SEQ ID NO: 25947 - DNA, 720 bp, Homo sapiens
  misc_feature: GYAE6OF01BNTY1.25.36.D03.1.454.CMB.1.raw
  modified_base (235)..(235): a, c, t, g, unknown or other
  misc_feature (235)..(235): n is a, c, g, or t
  modified_base (553)..(553): a, c, t, g, unknown or other
  misc_feature (553)..(553): n is a, c, g, or t
tcagactgtacagtcacgaccggtgctcgatttagctgcgtcacgatctctcgttggggggggtcacaagaggcagcgctctcgggacgtctccaccatggcctgggctctgctgctcctcactctcctcactcgaggacacgacgggtcctcgggcccagtcgtcggctgactccaaccgtcgccctcgtgtcgtcgggtcctcgtgggaccggtcaacgtccacctatttccngtcacgtcggaaccagccactgtattcggtcggtccttacgtttcgcctttgtccttcgttacggaaccctaaacaacccgaccggaacgaaacggcctaccgtaactacgtaagtttacgttttacggacgtaccgtaacggtaacggtcccggtaccccgttggttcggggtttaccttacggtccgttacttccgacggttcggccctacgtaacggtcgtaccggacctacgaccgtccctaaccgtacacttccgtcgtcggtctaccgaggtcgtaggacgtaacggtcggttacttcggtttacttcggtntcggttcgttcggtacttgttcggaacgtagttaaacgtactttaagggtcgttccgtaggtcggggtaccgaacgggacccttaagtccgggtaccttacggttaagccggactccggacggtccctacccggtcccctacgtccagttcccgtccgttccctccg

SEQ ID NO: 25948 - DNA, 634 bp, Homo sapiens
  misc_feature: GYAE6OF01DAXXM.25.36.D03.1.454.CMB.1.raw
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctggaaggtgaagaggcctgggtcctcggtgagggtctcctgtaaggtctaccggaagcagtgtgttcgtcagacatacactcaccgtggtccgcaggcctcgtggaactgggcctggaggtgggtggaacaacgtacaaccgaccacgccggaaacaacagagtcgcacaatctagttacgagggcagacgtctaacccgttttcggagaacacgtaccgtacgggcgactagtaataaacagtagtaagtcctacaacgtcggaactggtaccgtatttaggaccggtaaccgtaaccgggtccgttaacgttaagtttaccgttagtacgggaccgaaagggaaaacggtaggtcccttacggaaccttacgaaaaacgttacggaacgtacgtccgttagggtaccctaccggaccccggtcgggggaaccccgg

SEQ ID NO: 25949 - DNA, 334 bp, Homo sapiens
  misc_feature: GYAE6OF01D6HC3.25.36.D03.1.454.CMB.1.raw
  modified_base (313)..(334): a, c, t, g, unknown or other
  misc_feature (313)..(334): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgactaactttattactgtaactaaaatttgacagtgacccgtggatcgtcggcccgagggaccaaggtgacatacaaacgactgtggctgcaccatctagtcttcactccttcccgcatctagaactgtacagttcaggacggccgggtgtcggacggaacggccgatagagnnnnnnnnnnnnnnnnnnnnnn

SEQ ID NO: 25950 - DNA, 729 bp, Homo sapiens
  misc_feature: GYAE6OF01EPRHK.25.36.D03.1.454.CMB.1.raw
  modified_base (217)..(217): a, c, t, g, unknown or other
  misc_feature (217)..(217): n is a, c, g, or t
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctggcctgactcaacctgcctcgtgtctggtctccgtggacggtcaatcacctatttccngcactggaaccagcactgatgttggctacttgtaccttgtctcttcggtacctaacaaaccaccccggtaacaaacggcctaccgaaactctaattaatttttagagaccagtaacgtccggcccttacgtgggtttctagtcgtatctacgtcggctactaagtctggccgaactccggccctaccctaaacactctcgtcgggtctcacggctgaacgacgtaggcttagtttactttcgtgtcgttagttcgtcgtaagttcgggtacgtacgttaacgtaaaaacgttacgttttacggggttacgttaccggttacgggggacccggggttaaccggggtaacccccttaaaggtttacccgggtaacccgtttaaccggttttaaacgggtcccgtaaccgggtaaccccccggtaaagggtcccccgttaccccggtacccccccgttccccggtttacccgtaccccgtttaccgtttcccccggttaccccggttcccccccg

SEQ ID NO: 25951 - DNA, 688 bp, Homo sapiens
  misc_feature: GYAE6OF01AMW55.25.36.D03.1.454.CMB.1.raw
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagccgtggggacggtccctggagactctcctgtgaagccctctggtatttagtttcagttggttctggcatcgcacgtgggtccgccgaggcctccgagggcgaacgggggccggaggttgggttggctaaggtttacaggccacgtagtggagttgggtaaagtttctaggtaaatttattagtcgactaggtacctccggtagggaacgggtccctaatttaccgaacctacttacccgtacccgaaggtaaccgtaaaccgtaacgttacccccgggtaaatacgtttacgggttacggttaaccgtttaaggggtaaactttcggggtacctaacggtcccgttaggagtacggtccggacggtaccgtccgggtacgttcgttaggttaacttcgtggtacggacggtaaggttacggtagggggttagggttgggttaaggtttaacggg

SEQ ID NO: 25952 - DNA, 656 bp, Homo sapiens
  misc_feature: GYAE6OF01EDXMV.25.36.D03.1.454.CMB.1.raw
  modified_base (500)..(500): a, c, t, g, unknown or other
  misc_feature (500)..(500): n is a, c, g, or t
  modified_base (519)..(519): a, c, t, g, unknown or other
  misc_feature (519)..(519): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
  modified_base (550)..(550): a, c, t, g, unknown or other
  misc_feature (550)..(550): n is a, c, g, or t
  modified_base (583)..(583): a, c, t, g, unknown or other
  misc_feature (583)..(583): n is a, c, g, or t
  modified_base (643)..(643): a, c, t, g, unknown or other
  misc_feature (643)..(643): n is a, c, g, or t
tcagactgtacagtcacgaccggtgctcgatttagctgcgtcacgatctctcttgggggcagaagtctctctcagtcaggacacagcatggacatggacgggtccctgctcagctcctgggacctcctgctgcctcgtggcctcccagactaccagatggtgaccgtccagactgaccctagtcctccacttccctccctgtcctgacctagttcgttggttaggacgaaccaggtaactcacgctaactcctacggttcggacccgggtgaaggttccgaacggggactaagtttacgacttaaagttttacgtttaacgccgttaggttaataaccaaacggaaacgaaaccggagggtaacgtacggttacctaacgtccttacgtagtacttactagtcgtacctccgtacccttaccgtacgttacccgacgtaccggtacgggtcccctagttccgtcggttcgacggtccggatacgtagtacgcgtggaccngtacgttccatctacactnactcgacncgtccngtacgacctgagtagtnttcgtataactttacgtctacgataataaactntaaccgtccgtaccttacccttctacggtacggtcggaacgggtacggaacgtagggaancgtaactaaccgg

SEQ ID NO: 25953 - DNA, 815 bp, Homo sapiens
  misc_feature: GYAE6OF01BFCXK.25.36.D03.1.454.CMB.1.raw
  modified_base (229)..(229): a, c, t, g, unknown or other
  misc_feature (229)..(229): n is a, c, g, or t
  modified_base (708)..(708): a, c, t, g, unknown or other
  misc_feature (708)..(708): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtcgcgagggtccgtcggcccgacgtacgtgtcgacttgactcgacgccctaccctctcggttgtccgtaccggggccccccggngaacggacgggttcctccgacttccttctttcggttaccggtggggcgacgacggtccgtccggtaacggttacggtaaaagtttaacggttttcgtaccttaaccggttacggtaaccacggaccgaccggtacccctaccccgaaaaccggaaaaccccgggcccccgtaaagtcccttacctacgtacttaccgtaaaggttaaggtaaacgtcgtaacgtaaccgaccgggcccggtacccgtacggtaaccgggtaacctacccgttaaccgtaaccgttaccgtttccgttacggtacggtccgttaacggtaacggttccgtccggttcccgtaccccggttccgtccccgttcccggttcggaccgtacggttcgtacggggtccggtcccgttacccggggtacggaggtaccgttaggcccggttattaacgtaactttacgttcgtaggttcgtacgttaggttccgngtacccgtcgtgtacgtggtacgggttcgaccggtcggtcggtcgggacggtacggaccacggtccgttacgggtacctaccgggagtccaccggtcccgtaaccgg

SEQ ID NO: 25954 - DNA, 293 bp, Homo sapiens
  misc_feature: GYAE6OF01AWAGM.25.36.D03.1.454.CMB.1.raw
  modified_base (288)..(293): a, c, t, g, unknown or other
  misc_feature (288)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgaccaaacaatataataattattcgaccactttggccaggggaccaaggtggagatacaaacgaactgtggctgcacatctgtctcatctccgcatctgaactgtacagtctgagcggctggcaaggcgcagtagnnnnnn

SEQ ID NO: 25955 - DNA, 657 bp, Homo sapiens
  misc_feature: GYAE6OF01AHQN7.25.36.D03.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
tcagactgtacagtcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacgtcaatcaccatttccngcactggaaccngcactgatgttgctaggtttattactttgtctctgtaccaacaacaccaggcaacgccccaaattatcatttangagccactacgccgccctnaggtactttactaatccgtctttcgtctcggtcctaccgtaagttctggacacgccgaccggtccctacccgtgaactaacgttcctacgtcgggcctccgacggtcgtacggacggtacggacggtcgtagtaactttacgttaccgtgtccttaactctaacttacggttacggaacctacgtaacttaccaaaccgttaacccgttccccggttccgttaccgggacccggttacgggaaccccgtacgggtacccttaccccggttccggtaccgggttaccgaacccggtacccccgaacggaccccccaaacccctcgttacgtacccccg

SEQ ID NO: 25956 - DNA, 685 bp, Homo sapiens
  misc_feature: GYAE6OF01C5NSD.25.36.D03.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (425)..(425): a, c, t, g, unknown or other
  misc_feature (425)..(425): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctcagtgtccgtcggggaccccggnaggacggtctccattctctttgttcgtggggacncgacgtccgtaccggaacggttacggtaaaatttaaggttttcgtaccttaacgttcgggtaacccaagcctaacgcctacccgaaacggaaaccccggcccccaagtccctacctacacttccgtaatacggaatacgatcgacggccgacctacgacggtactaccgtgaccgtattcncgtggactacgacgtcgtacgtcctccgtccgtcctccgtcggacctatcggtaggtccgggtcccgtaccggtcggaagtagtcggacgtacgttaagttaaactttacgttacgttaggtaacggtttagggttacggtatccgacgttgttcgacggttcgggttaccgggtacggtacgggtcggttaccggggacggtacgggaacgacggtcgtaccgccgttaccggtacgtccgaacgcccgtcggtccccg

SEQ ID NO: 25957 - DNA, 903 bp, Homo sapiens
  misc_feature: GYAE6OF01BER95.25.36.D03.1.454.CMB.1.raw
  modified_base (215)..(215): a, c, t, g, unknown or other
  misc_feature (215)..(215): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcgtagtgtcgtccggggacccccgggngaggacgggtctccgattccttccttgttccgtgggagtcgagcctccggaccgtacggtaaaattaacggtttgtacgttacgttggtaacccgagccgtaacgccctaccccgaacggaaaccccggacccccaacgtcctaccctccgacttacctaagtaacggtaatagactaccgacggcccggtaccctacggaacggacttaccgtaacggaacccggtactttacccgtcgtacgggtacccgttacgggtaaacgttccgttacgggtccctttccccccggttccggtcccccttaccccggttcgaccccgttaacgtttacccgggaagggttccgggggttccccgttaccccggggtttacccggaagggtaaccggttacgggtaacgggttaccttaacggtaaattttaccgttacctttagggtaccggtttacgttaacgggggttttcgggaacttcccggtaaacccgttacgggtttaccgtacgggtttacgggttccccggggttacggggttaaccgggtttcgggggttacccgggggtaacccggggtaaccggggtaacccggtaaacgggttcccgggttaacccgggttaaccccccgggttacgggttaaccgggtttaacccggaacccccggtccccgggttaaaaccccgggg

SEQ ID NO: 25958 - DNA, 318 bp, Homo sapiens
  misc_feature: GYAE6OF01DLFPD.25.36.D03.1.454.CMB.1.raw
  modified_base (302)..(318): a, c, t, g, unknown or other
  misc_feature (302)..(318): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgactaacttattactgaccaacaatataaataattatcgacctagtttggccaggggaccaaggtggagaatacaaacgactgtgctgcacctatctgttcttcactcctcccgcatctagactgtacagtctggaggcgggctggacgaggcgacagtagnnnnnnnnnnnnnnnnn

SEQ ID NO: 25959 - DNA, 773 bp, Homo sapiens
  misc_feature: GYAE6OF01DFNHU.25.36.D03.1.454.CMB.1.raw
  modified_base (164)..(164): a, c, t, g, unknown or other
  misc_feature (164)..(164): n is a, c, g, or t
tcagactgtacagtcacgaccggtgctcgatttagctgcgtcacgatctctcttggggtctggcgctaggggtcccttccaatatcagcaccatggcctggactcctctctttctgttcctcctcacttgctgcccaggtccaaatctcagactgtggtgactnaggagccctcactgactggtcgtcccgaggagggacagtccactctccaccgtgtgtccttccaggcgcgtgggtccagtccacgtagtagaacgaaacctactacccgtaaaacgttcggttaccagacctaacgaaaccgtacggaaccaaaccccgacccgagggacctagttagtacttttaggtagggtaccaaactaaaaaccgttaaaaaaacctccgttaccgttaccggacccccgtcggtaccccgtttcctaccgaccggtcccttaccccgtccggttacggggacaaacggtcctccgccctagacctacgtcggtacaggtactcgtcgacctacggcgtagggaacggaacggtacggccgttaaccgaacctttaccgaaccgtcgtaccccgttgcccctttccgttccggtcggttgggttccggttggttccgggtttacggggtcgttaccggggacgggtaaccggaaccgttaaccggccgggtaaccgtccgggtcggtacctacccgggacccgttaaccgggccccgttaccccgtacccccggttacgtaccccgtacctttcccgggtccccttaccccccg

SEQ ID NO: 25960 - DNA, 654 bp, Homo sapiens
  misc_feature: GYAE6OF01DP4A4.25.36.D03.1.454.CMB.1.raw
  modified_base (294)..(294): a, c, t, g, unknown or other
  misc_feature (294)..(294): n is a, c, g, or t
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggattttcctttggcttattttaaaggtgtccagtgtgaagtgcaacgtggtggagtcgtggggggagcttggtacagcctggcaggcccctgacgactctcctgtgcagcctctggtattccactttgatgattangccatgctacgtgggtccgcaagcctcgagggacggcctggagtcggtctcgaggttattagtaggattaggtggtagctaagtaggcttagcggtacggacttcgtggtacggaacgggtccgaacgttaccgaccctacgtaccgtacccgacggaacgaacctaaccggaccctaaacgtaaccctacccgttcgtaacttccgtacgaacgtaaactacggaacctacggttacgtacggaacggacgtcggtaacgggaacggtaaccggtacccgggttaacctttcggtttaaacgtttacccgttaggttaaccgttaaaacgttaaaaaagttttacggtttaaaaccggg

SEQ ID NO: 25961 - DNA, 710 bp, Homo sapiens
  misc_feature: GYAE6OF01A066A.25.36.D03.1.454.CMB.1.raw
tcagactgtacagtcacgaccggtgctcgatttagctgcgtcacgatctctcttggggagctctgggagaggagcccagcactagaagtcggcgtgttccattcggtgatcagcactgaacacagaggactcaccatggtagtttgggctgagtcgttcgggttttcctcgttgcttcgttttaaggaggtgtccctactgtcaggtcgccaccgtgggtggagtcggtgggggggacgtcggtggtccacggtccgtggggacggtccctggacgctctcctgtagacgcctcgtggtatttagttcgagttggttctggtctagtcgctacggtcgggtccgccacggcctaccggagggcggaacgggggccggtaggtgggttcggacgtagttagtacggctaacgagtacggtagtagggtaagttcgtaagtaaattagttacgtgtaccaacgtaccggttaccggtaggggtaaccgggtaccctagttacccgaacctacgtttcccaaccgaaagggtaacctaacccgttaaccggttaaccccgggaatttacgtttacgggttaacgttacgtaacgggtaagttccggtaacgtaccgtaccggtaggacggtaacgtacgggtcgacggttcgtcgttagtacgtttagtcgtgtacgcgggagtcggtaggggtacgtggttacggttaacgg

SEQ ID NO: 25962 - DNA, 324 bp, Homo sapiens
  misc_feature: GYAE6OF01DW8MH.25.36.D03.1.454.CMB.1.raw
  modified_base (208)..(208): a, c, t, g, unknown or other
  misc_feature (208)..(208): n is a, c, g, or t
  modified_base (314)..(324): a, c, t, g, unknown or other
  misc_feature (314)..(324): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgctaacttattactgccaaacaatataataattattcgacctactttggccaggggaccaaggtgganatacaaacgaactgtgctcaccactctcgtcttctatcttcccgtccactctcgaacttagtacgtagcttgacggcgggcgtcggtacgacggacgccgatacgnnnnnnnnnnn

SEQ ID NO: 25963 - DNA, 789 bp, Homo sapiens
  misc_feature: GYAE6OF01BS7ME.25.36.D03.1.454.CMB.1.raw
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggattttcctttggcttattttaaaggtgtccagtgtgaagtgcaactggtggagtcgtgggggagcttggtacagcctggcaggtcccttgagtacctctccgtgtcgctaggcccttcgtggtacttcctaccgttttggacttgtaatttatcggcctaagtcgacctacgtcgggggtaccgacaaacggtcctacccggaaggggtaacgggtcccgtagggggtacggttcggggttacctacggtaagggtttaagtttaagggtttagggaaagttaacggggttagggtaacgtaccgtaaggttacgggactttaacggtcgggtaccgggtaccgttaccggttggggttaaccgggaacgggggtacccgttaacgtttacccgaaaccccgttacgtacccgtttaaccggaacggtaaaccggtaaacccgtaaacccggtaccccgtaaaacgtaaccccgttcccccgtttaaggtaaccttccggtaacggtaacctaaaggtaccgtaacgtacgttaccgtaggaacggaacgtcggtacggaacgggtacggtaccgggttaccttaggttaacgttaccgtaggtaactaagttaaaaacttagttaacgg

SEQ ID NO: 25964 - DNA, 586 bp, Homo sapiens
  misc_feature: GYAE6OF01A60SG.25.36.D03.1.454.CMB.1.raw
  modified_base (252)..(252): a, c, t, g, unknown or other
  misc_feature (252)..(252): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcgggtgagggtctcctgtaaggtctccgggaancagtgtgttcgtcagacatacactcacctgggtccggcaggcctctggaactgggcctgagtgggtaggacatacgaccgccacgccggaacaacgagacggtcgcacatcgagtttcgagggcagacgtcctaccgttttcgaggtacaagtccgacgggcgccaggtactacgatgaactcactaagtcgacgtgcgtatttcggacggacgtaccgggtcgtacttacgttactggttagaccggtaagaaacgcgttacccgtgtccctaagaaaacgttccggaacacgtccgttacgggcctccggacccccgttgggggaaccccgg

SEQ ID NO: 25965 - DNA, 752 bp, Homo sapiens
  misc_feature: GYAE6OF01EGIFZ.25.36.D03.1.454.CMB.1.raw
tcagactgtacagtcacgaccggtgctcgatttagctgcgtcacgatctctcttggggagctctggggagaggagccccagccctgagattcccaggtgttccattcagtgatcagcactgaacacagaggactcacagtggaggttgggactgagctggtactttttccgttttggtacttaagtttttaaaagggtgttaccgtaggttggtagtaaggtggacgtaacggtgggtagggtacggttcgggtaggggggtacggtcgttaggtacgacggtccgtggaccggaccgggcccccgagtacctccgtacctggtcgcacgtcctcgtggtacttcctaccgttgtataggtattacgcgaccgatcggctacgggtcggaccgacgacgctacgggagggacggcgtagggcggttcggactacggtaggttagttagggtaggtaacggttggtaggtacgacgtaggtaggtctaggtcggtacggtactcggtagggacgggtaacgggtcctagttaccgacctacgtaccgaccgaagaccgaaccgtaaccgccgtaaacgtcccttacgtacgtactaccgagtaacgtaaagtcgtaacgtacggtagttaggaacggtaccggtaacgtaacggggacggttaacctaccggggttaccgtttaaggttacgtttaaaccggtggttaaaacgttaaaccgttttaaaattacccgggtttaactaaacgggg

SEQ ID NO: 25966 - DNA, 468 bp, Homo sapiens
  misc_feature: GYAE6OF01BLWVY.25.36.D03.1.454.CMB.1.raw
  modified_base (436)..(468): a, c, t, g, unknown or other
  misc_feature (436)..(468): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcacgcctgattgtattttcgactaactttattactacgaccaaactaataaattaaattaatttacttaccgtaaccttacgtttttcgggacccgaagggggaacccgtaaagggtggaacgtaataaccgaaaaacgtaacgttggtacgggtacctacggaccaaccgttacttaccgttcgttacctttacctacgttaccccttccccggaacccttacttcctaacggttaaacgttcgtaacttaggtccgttagggacggccgggtccggtacgggaccgaacggggcctaagtagtacgatgnnnnnnnnnnnnnnnnnnnnnnnnnnnnnnnnn

SEQ ID NO: 25967 - DNA, 947 bp, Homo sapiens
  misc_feature: GYAE6OF01CDTGQ.25.36.D03.1.454.CMB.1.raw
tcagactgtacagtcacgaccggtgctcgatttagctgcgtcacgatctctcgttgggggagctcgtgggagaggagcccagcactagaagtcggcggtgttccattcggtgatcagcactgaacacagaggactcaccagtggagtttgggctgagtcgttgggttttcctcgttgtcttacttttaaggaggttcgtccacttggtcaggtcgcaccgtgggtcggtagtcggtggggggaggtcggtcggtccaggtcccggtggggaccggttcccagacgtacctccgttccgtggtacgaacgtccctgtaggttaactttttaggtttccaggttcggtttacgtgggtacctagtcgaccggtacggttcggggtacccgccgtacgggtccttacccgggaagggacgggaacgggggtcccgggtagggtttacgggttacggaccggttaagtttaagaccgcgtaaaccgttagtacggtaggtacggttaaaggttttccgtaaaggtaaaagtttaagtttacggtacgtaaccgggtaaccggttaacccggttacccggggttaagggggaaacccgggttacccgtaaacggttttaacccctaacccggttactttaacccccgttaacccggaaaacggttaaaccgggaaaccccgtttaaacccgttacccccggggtaaaatttaccggttttaacgggtttaacgttaaccgggttttaaaggaacggtttccgggttaaccgaaccggttaacccgtgggtaacgggtaccggtaacgggtaaccgggtaccgttacccgggttacgttcggtttaaagggttaactttaacgggtgggttaaccgggacgggtaacggggttaacggggtttaaccggggggttaaggtttacgggggttaagtttttaaaaccccgggggg

SEQ ID NO: 25968 - DNA, 351 bp, Homo sapiens
  misc_feature: GYAE6OF01A1CXG.25.36.D03.1.454.CMB.1.raw
  modified_base (236)..(236): a, c, t, g, unknown or other
  misc_feature (236)..(236): n is a, c, g, or t
  modified_base (310)..(311): a, c, t, g, unknown or other
  misc_feature (310)..(311): n is a, c, g, or t
  modified_base (315)..(315): a, c, t, g, unknown or other
  misc_feature (315)..(315): n is a, c, g, or t
  modified_base (318)..(351): a, c, t, g, unknown or other
  misc_feature (318)..(351): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgctaacttattactgaccaacaatataaataattatcgacctactttggccaggggaccaaggtgagatacaaacgactgtaggctgcacatcgtntcttcacttcctcccgcatctagaactgtactagtctaggacggcgggtacgtggacgaaggccgcgaagtagnngtgnagnnnnnnnnnnnnnnnnnnnnnnnnnnnnnnnnnn

SEQ ID NO: 25969 - DNA, 687 bp, Homo sapiens
  misc_feature: GYAE6OF01CEL7W.25.36.D03.1.454.CMB.1.raw
  modified_base (429)..(429): a, c, t, g, unknown or other
  misc_feature (429)..(429): n is a, c, g, or t
  modified_base (540)..(540): a, c, t, g, unknown or other
  misc_feature (540)..(540): n is a, c, g, or t
  modified_base (620)..(620): a, c, t, g, unknown or other
  misc_feature (620)..(620): n is a, c, g, or t
  modified_base (638)..(638): a, c, t, g, unknown or other
  misc_feature (638)..(638): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcacatggagtttgggctgagtcgttggggttttcctcgttgcttcttttaagaggtgtccatgtcaggtgcaccgtggtggagtcgtgggggagcgtggtccagccgtggggacgtcctagacgtactctccgtgtgaagcctcgtggtactttagttcagttggtttgctattcgacgtgggtcccgccgaggtcctccgaaggccgaaaaggggtcgtgggacggttggggtggcggttacagttaggtggggtagggagttagggtaaacgtaaagtgtacgttattttacgngtacgaaggtaccgttcgggtaggaaacggggcccctaacgtaccaacctacgtcctaaccgagggacggacagtacccgtaaccaaaacgttaaccttaacccgttttanaccgttacgaacctaaagtttaacggaaaccgttggaacctacgtacgaccgacggtacggcttacgtactaaccggttntacggcgggccgggttanaacggaaaggtaccggtacgggggtacccggccgtacggacggtaaccg

SEQ ID NO: 25970 - DNA, 714 bp, Homo sapiens
  misc_feature: GYAE6OF01DL1WZ.25.36.D03.1.454.CMB.1.raw
  modified_base (250)..(250): a, c, t, g, unknown or other
  misc_feature (250)..(250): n is a, c, g, or t
  modified_base (596)..(596): a, c, t, g, unknown or other
  misc_feature (596)..(596): n is a, c, g, or t
tcagactgtacagtcacgaccggtgctcgatttagctgcgtcacgatctctcgttgggggcagaagtctctctcagtcaggacacagcatggacagtggacgggtccctgctcagctccgtgggactcctgctgctcgtgcctccagactacagtatgtacgaccactacgagtacgaccgtacgtactcctacctcctccctcgtcgtcgctacttcgtggttggacgaataacggaataccagtaacnctacgtaccgttcggccggggacggtacggtacggtacggacggttaaacttacggtacttaaagtttaagtttacggtacgtacggttaaacggtaactaaaccggaaaacggaaaaccggtaacgggtaaggttaaccgtttaaccgttaaccggtacgttacccgtacgttaagttacttacgtcgttacgtaccgttaccgttaaccccgttaggtttaaacccgaacgttcccgggtaaccgggtaccgttccgttacgttaccggtacggacggtagccggtagttacggacgtcgtacggactaggtactcgtactcgtactacatacagctcgaccgntaccgaagtctacgtaagcggtactaggttacctaagttactagaacttagtaagtaatactacgtcctacctacgtcgtacgtacggtggaacggtacaagggtctaagacgtaacg

SEQ ID NO: 25971 - DNA, 302 bp, Homo sapiens
  misc_feature: GYAE6OF01BMDS6.25.36.D03.1.454.CMB.1.raw
  modified_base (294)..(302): a, c, t, g, unknown or other
  misc_feature (294)..(302): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtggagatacaaacgaactgtggctgcaccatctgtcttcatccttcccgctatctgaactgtacagtctgagcgggctggcaaggcgcatagnnnnnnnnn

SEQ ID NO: 25972 - DNA, 572 bp, Homo sapiens
  misc_feature: GYAE6OF01EX7LF.25.36.D03.1.454.CMB.1.raw
  modified_base (185)..(185): a, c, t, g, unknown or other
  misc_feature (185)..(185): n is a, c, g, or t
  modified_base (273)..(273): a, c, t, g, unknown or other
  misc_feature (273)..(273): n is a, c, g, or t
  modified_base (319)..(319): a, c, t, g, unknown or other
  misc_feature (319)..(319): n is a, c, g, or t
tcagactgtacagtcacgaccggtgctcgatttagctgcgtcacgatctctcttggggagctctgggagaggagccccagccctgagattcccaggtgttccattcagtgatcagcactgaacacagaggactcaccatggagttgggactgagctggatttttcctttggctattttaaaaggngtccagtgtgaagtgcaacgtggtggagtcgtgggggaggtcgttggtacagtcctggcaggcccctgagactctcctgtgcagcctntggattcacctttgattgattatgacctatcgcacgttcgggccgnaaacggctacgaaggggaggcctgggagtggtctgaggtattggtaggaatgtggtagctagtaggctagtggcggtactgtggtaggacgggacctattccgacctatcctaccgagaacgtaaccaaccggtaccaacgaacctcccgtagtaactccgtagaccaaagttcgaatcgcgtagagtacgcgtagacggaacgtcgtaccttagtaccttacgagttaagaaccttaaaaagttacgtaacg

SEQ ID NO: 25973 - DNA, 743 bp, Homo sapiens
  misc_feature: GYAE6OF01EY097.25.36.D03.1.454.CMB.1.raw
tcagactgtacagtcacgaccggtgctcgatttagctgcgtcacgatctctcttggggacataacaaccagattcttcctctaaagaacgcccctgggagcacagctcatcaccatggactggacctggagttcctctttgtggtggcagcagctacaggtcgtccactcccgaggtccagctggtgcaatcgtgggcctggaggtagaacggacggccgtgggtcctcgggtggtagggtccttccgtaggtaacggtcgtacgggaagcgtagttgtgttcgtcagacactacactcaccgtcgggtccgacgacggtcctcgtacggtaacgtcgggtccgtggaggttcgggggtacggaacgtaacgtaccgaacccgaccgaaccggacccgaaacgaacgaggaacggtcgacacgtacgttacgtagttacgacgggtacacggtacgttaccgttacccgtttaccggtacggaaccgttaaccggtaccggaccgggtaccgtactaacggttactaacgaacgttacgtaaacttacgtaccgtaacgtaccgtaaccgttcggaccgttaagtttccgggaaccggtaccgtacgggttaccgttaattacgtttacgtacggtagaccggtaagtaacggtacggttcccgtacgtacccgtaacgtaaaaggtcccaacggacgtaccggtacggacccgttacccggacccggtcggggtaaccccgg

SEQ ID NO: 25974 - DNA, 861 bp, Homo sapiens
  misc_feature: GYAE6OF01DFJRU.25.36.D03.1.454.CMB.1.raw
  modified_base (236)..(236): a, c, t, g, unknown or other
  misc_feature (236)..(236): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctcgcccagggtccaaatctcagactggtggtgactcaggacgccctcactgacttcggtcgtccccgagggagggacacgtcactcctcacctgtcgtcttccgngcgcgtgggtcagtccacgaggtcgaacaaccactaccaaacgttcggtaccacgacgtaacgaaaccgtaccggaacccaaaccccgaccggacgggacctacgttagttaagtttacgtacgggtaactaaaccgtaaaaaaaccttaaaaaccgtaccgttaccggtttaccccggtacccccgttaccgggttccccggtttaccgtaccgtaccgggttccccttccccgggttacccggggtttaacggggggaacctaaacccgggttccgtacccggtacccgtacgtaaccgtaaccgttcggacgtacggttacgtcggtacgtaccgtacgggtacccggtgggaaccggggaacgtacggggtaccgttacggtaacccacccgttaccgtccggtcccgtttcgtaccttcccggttaccggtttgggtttcggggtacgggttttccgggttcggggtttacgggttcccggggttaccggggaacccggaacgggttaacccgtaaaccggtcccggtaccggtcggtacccggtcgacccggtcggtaccccggcccgttccccggtacccccgttggacccctccctttcccgaaccgttcccccccg

SEQ ID NO: 25975 - DNA, 906 bp, Homo sapiens
  misc_feature: GYAE6OF01AZPIG.25.36.D03.1.454.CMB.1.raw
tcagactgtacagtcacgaccggtgctcgatttagctgcgtcacgatctctcttggggagctctgggagaggagcccagcactagaagtcggcggtgttccattcggtgatcagcactgaacacagaggactcaccagtggagtttgggctgagtcgttcgggttttcctcgtttgcttacgtttttaaaggacggttcgtacccacgtgtcgagggttcgcctaccggtgggtggaggttcggtggggggacgtcggtcggtacccgaggtcccggtgggggtacgtcccgtggacgtaccttcctccgtggtacgacgtcccttagttagggttatttttacggttcgtagggtttcggtttacgtcgggtactaacggtttcggacccgttaccggttccgggggtcccccgaaccggtacggggtccccgtacccgggaagggggtacccgggaaacggggggggtcccgggttaaggggttttcgggggttacggaaccgttaaaggttttaacgaaccgggtacctaaacgttaggttacggtaaaggtttaaggggttaacgtttacgtaaagggttaaatttacgtttagaccggtaacgtaaccggtaccggttaccgggtaaggggtaaccccgggtacccttaaccgttaaccctaacccgtacgttacccgtaaccgaaggtaaacccgtaacccgttaaaccggttaccccggtaagtttacgtttagttaacggttaacggttaaggtaaacttcggggtcaacgtacggtagacgggtacggtacggaccggtaccgttcgggtacgttacgttagttaacgtccggttagggaccgtagggtaacggtacggggttagggtacgggtttaggttagggtttaaacccggg

SEQ ID NO: 25976 - DNA, 675 bp, Homo sapiens
  misc_feature: GYAE6OF01EBVI2.25.36.D03.1.454.CMB.1.raw
  modified_base (204)..(204): a, c, t, g, unknown or other
  misc_feature (204)..(204): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggagttcctctttgtggtggcagcagctacaggtgtccactcccaggtccagctggtgcatctggcctgaggtgaagngctgggtcctcggtgacggtctcctgtaacggtctccggaagcagtgtgttcgtcagacagtacactcgaccgtcgggtccgcgacggcctcgtcggaacgtcgggcctggaggtgggaggaacaacgtcgaccgcgacgaccgaacgaacgagacgtcgacgactagtacgtagttcgaacggtcaggtacgttccttaccgttttccggacggtaactaacgggttccgtacggggccgtacgtaagttactaacgtacgttaggaaactttccgtaacgtaacgtaccgtaaccgttcggtacgtaacgttttcgggaccgggtaaccggtacccgggtacgttaacgtttacgtaccgttaggtcgtaacgaaggtaaacgtaccgttccgtacgtacccgtaaacggaaacgttcggaactacggtccgtacggacctacccgggacccggtccgggaaacccggg

SEQ ID NO: 25977 - DNA, 685 bp, Homo sapiens
  misc_feature: GYAE6OF01BO3M5.25.36.D03.1.454.CMB.1.raw
  modified_base (208)..(208): a, c, t, g, unknown or other
  misc_feature (208)..(208): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagactaccagatgtgacgtccagatcgacccagtcctccactccctccctgtctgctatcgtgtgganacagtaactcagctatcacgttcggccggacgtacgtcgaggtctagttagactaatttattacgccgttaggtactacaaacgtaacgaaaccggagggtacgtacgttaccgtaagtcctcgtagtatcgtatcgtctccgtccctaccgtacgtaccgactcggtaccgggtacctagttccgtacggttacgcggtacggtactaaggttacgagttcggtacgggaactaggttacgttaccctacgttccgtaacacgttataccgagtccgaccgtccacggtacctacggtaccgttagaacgtaggtttcgttaacgtaacctttaactttacgtaccgttaaagttaaactaaagtttacttaaccgttacccgtcccgttaccccgttacttaccggttacccgggttacggggaacgggtaccgggaaccggtaagggtacgaacggtaaaccgtaaaacccggg

SEQ ID NO: 25978 - DNA, 296 bp, Homo sapiens
  misc_feature: GYAE6OF01AM2LC.25.36.D03.1.454.CMB.1.raw
  modified_base (265)..(265): a, c, t, g, unknown or other
  misc_feature (265)..(265): n is a, c, g, or t
  modified_base (288)..(288): a, c, t, g, unknown or other
  misc_feature (288)..(288): n is a, c, g, or t
  modified_base (293)..(296): a, c, t, g, unknown or other
  misc_feature (293)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtggagatcaaacgactgtggctgcaccatctgtcttcactccttcccgcatctagaactgtacngtctgagcgggctggcgaaggcncatgnnnn

SEQ ID NO: 25979 - DNA, 660 bp, Homo sapiens
  misc_feature: GYAE6OF01A0AM9.25.36.D03.1.454.CMB.1.raw
  modified_base (191)..(191): a, c, t, g, unknown or other
  misc_feature (191)..(191): n is a, c, g, or t
  modified_base (283)..(283): a, c, t, g, unknown or other
  misc_feature (283)..(283): n is a, c, g, or t
  modified_base (320)..(320): a, c, t, g, unknown or other
  misc_feature (320)..(320): n is a, c, g, or t
  modified_base (351)..(351): a, c, t, g, unknown or other
  misc_feature (351)..(351): n is a, c, g, or t
tcagactgtacagtcacgaccggtgctcgatttagctgcgtcacgatctctcttggggagctctgggagaggagccccagcccctgagattcccaggttgtttcccattcagtgatcagcactgaacacagaggactcaccatggagttggactgagctggtatttttcctttggcttagttttaaaggtntcctagtgtagaagtgctaacgtgggtgagtcggtgggggagtcgttggtacagccgtggcacggccctggactactcctcgtagtcgccgngtccctagtggtacttcctacctttgatgtatttacncgcctattcggactacggtcgggtacccganaacggtcgtaccggaaggggtacgccgtgggacgttgggtctacggtaaggttacgttaggtaggtaacgtggtaggtagtactaggtacggtacttaggtcggtacgtacgttcggtaggtaacgggtaacggtcccgttaacgtacccgtaaccgtactccgttaaccggagtaaccgaaccgtaaccgaaccgtaactacccgtcgtacgttacacgtacgaacaacgtaggacctagtccgaggacgacgtgagggtacgacggtcctacgtagttactcgtagactaaagtaatttacgtaacg

SEQ ID NO: 25980 - DNA, 690 bp, Homo sapiens
  misc_feature: GYAE6OF01ESRNE.25.36.D03.1.454.CMB.1.raw
  modified_base (336)..(336): a, c, t, g, unknown or other
  misc_feature (336)..(336): n is a, c, g, or t
  modified_base (465)..(465): a, c, t, g, unknown or other
  misc_feature (465)..(465): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtcgtccccaggaggacagtcactctcactgtcgcttccagcgcgtggtcagtcaccagtgagaacatccaaactgtccagcacgaaacctggaaccaaacccacccgagggaccacgtacgtatttagtcggtagaacaaaactaaaaaaacnccttaccgttacggtaacccccgtcgtaccccggtttctaccgtacggtccctaccccgttaccggttacggggggacctaaacggtccgtcgtccccgtagtacctacgttcgacgagtatcggtacncgtacgtccgtaggaacggtacggaggacctacgtacctacctacgtcgtccctcgtcccgttcctccgttcggttacgggtcggttcgttcgggtttcgggttacgggttccggggacgggtaacggaaccgtaacgtccggtaaccggttcggtcgggttacacccggccgaacggtcccgtaccgtccccggtacgtaccctcgtccccgttccgtaccccc

SEQ ID NO: 25981 - DNA, 665 bp, Homo sapiens
  misc_feature: GYAE6OF01DPD9S.25.36.D03.1.454.CMB.1.raw
  modified_base (146)..(146): a, c, t, g, unknown or other
  misc_feature (146)..(146): n is a, c, g, or t
  modified_base (196)..(196): a, c, t, g, unknown or other
  misc_feature (196)..(196): n is a, c, g, or t
  modified_base (217)..(217): a, c, t, g, unknown or other
  misc_feature (217)..(217): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
  modified_base (524)..(524): a, c, t, g, unknown or other
  misc_feature (524)..(524): n is a, c, g, or t
  modified_base (565)..(565): a, c, t, g, unknown or other
  misc_feature (565)..(565): n is a, c, g, or t
  modified_base (599)..(599): a, c, t, g, unknown or other
  misc_feature (599)..(599): n is a, c, g, or t
  modified_base (610)..(610): a, c, t, g, unknown or other
  misc_feature (610)..(610): n is a, c, g, or t
  modified_base (629)..(629): a, c, t, g, unknown or other
  misc_feature (629)..(629): n is a, c, g, or t
  modified_base (638)..(638): a, c, t, g, unknown or other
  misc_feature (638)..(638): n is a, c, g, or t
  modified_base (645)..(645): a, c, t, g, unknown or other
  misc_feature (645)..(645): n is a, c, g, or t
tcagactgtacagtcacgaccggtgctcgatttagctgcgtcacgatctctcgttgggacataacaaccagtactttcttcctactaaagacgccccgtgggagcacagctcatcaccatcggactggacctggtacgtttccttnttgtggtgcagcagcctacgaggtcgtccacgtccgagtccagtctggtnacagttcgtggggacctaggnggtagaacggcggtccgttcgggttcctgggttagacgggttctaccgtaggttaacgggtccgaccggtaagccgtaggttcgttaggttaccnggaaanacgtataaccggtactacccgtacgttcggggtaccccaggaccgaccgtttcgacgggtaacgttcgggggacccttggaacggtcgggaacgcgtaacgaaccggaccgtcgtaaaccgnggaacacgngtaggtaccagnaacgctaaggtnacggtnacgaagttccgtaactttcgaggtacaaccggtcgacgtaacggnttaagactaagtgagacctagtacaaggtccattcgggatntagacgaccgagtccgtaattagtagtagacganaccggtaaatntcggactaccaagtaaagnggtaaaccncggtacncgaccgtacgcgtaggaccg

SEQ ID NO: 25982 - DNA, 344 bp, Homo sapiens
  misc_feature: GYAE6OF01BTMCU.25.36.D03.1.454.CMB.1.raw
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
  modified_base (328)..(344): a, c, t, g, unknown or other
  misc_feature (328)..(344): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgctaacttattactgaccaaacaataataataatttacgttccgaccttacttttcgggccgaaggggaccaaggtggagtatacgaaacgactggtcgctcgacacgtatctgtcttcattcctcccgctatctacgtactcgtaccacgttcgngacggccggtctggacgaacggcgnacgtagnnnnnnnnnnnnnnnnn

SEQ ID NO: 25983 - DNA, 709 bp, Homo sapiens
  misc_feature: GYAE6OF01BUMRC.25.36.D03.1.454.CMB.1.raw
  modified_base (203)..(203): a, c, t, g, unknown or other
  misc_feature (203)..(203): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtcctccatcctccctgtctgcatctgttgganacagaatcagcatcacgttgccgggcgaagtcgagggcctagttagctaatttatttacgccttaggtactaccgtaaacgacgaaaacccgaggggaagtaggtttaccctaaggccttaccttggaactttcgtaagttcgtaccgtgtcccctacctaacggttaacctaccgtacgtaaccggggttaccctagttacccgttacgggtttaccaacggtcgggtaacctagggttacgtaacgttacggtcggggtaaacctaagggttacgtttaacccgtaaccgttaccttacctaaaccgttatcccgaagtcctaacgccgttacggcctaccggtctaacggaagttaccgtcggttacgttacttaaacgtttacgtaacttacggtaaactaaaaacggttactaaaacgttaccgtccgtaacccccgttcttaccgtaacgtttccgggaacggtacggtacccggtaaaggttcgaagttacgtaaaccg

SEQ ID NO: 25984 - DNA, 304 bp, Homo sapiens
  misc_feature: GYAE6OF01A1QUM.25.36.D03.1.454.CMB.1.raw
  modified_base (292)..(304): a, c, t, g, unknown or other
  misc_feature (292)..(304): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatccttcccgccatctgaactgtacagtctgagcgggctggcaaggcgcatagnnnnnnnnnnnnn

SEQ ID NO: 25985 - DNA, 822 bp, Homo sapiens
  misc_feature: GYAE6OF01DE633.25.36.D03.1.454.CMB.1.raw
tcagactgtacagtcacgaccggtgctcgatttagctgcgtcacgatctctcgttgggggcagaagtctctctcagtcaggacacagcatggacatgagggtccctgctcagctcctgggactcctgctgctctggcctacccagataccagatgtgacgtccagatcgacccagtcctaccatccctcctagtctgactattcgttaggtaggaagaacaagaactcgaagacaactacgtaaccggttgggcccgggaacggtacgtacggaagggtactaagtttaacgacttaaaagttttacttttacggaccgttaaggttaacacgaaaacgaacggtaaaaccggagggtaagtaaccgttacctaacggtaccttaccgttagacttacgtagtacgaccgtaccgtaccctaccgtaaccggttaaccaccggttacggaacccgggttaccctagtaccggttaccgtacgaacggtacggactaaggtacgtaacgtggtacgggaactaggtacgttacctaacgttacctaacttaacgtaccgtaacgacgtaaccgtacgttcccgacgtacggaccgtaaccggttaagtaaagtacgtttaccggtttacgaaaacctttaacgtttttaaccgtaacggttaaacttaaaaaccggttaaaagttaaacctttaaacgtaccccgttaacccggttaccccttaaccgtttaaccgggtttaaccggttaccggggaaacccgggttaaaccggggttaaaccgtaaaaggggtccgaaaaggttaaccgtaaaaaccccggg

SEQ ID NO: 25986 - DNA, 832 bp, Homo sapiens
  misc_feature: GYAE6OF01BRTOQ.25.36.D03.1.454.CMB.1.raw
tcagactgtacagtcacgaccggtgctcgatttagctgcgtcacgatctctcttgggggagctctgggagaggagcccagcactagaagtcggcggtgtttccattcggtgatcagcactgaacacagaggactcaccagtggagtttgggctgagtcgttgggtttttcctcgtttgtcttacgttttaaaggacggttcgtccctacgttgtcgtagggttcgccgaccgttgggtgggtaggttcggtagggggggacggtcggttcgggtcccgaacggtcccggtcgggggacggttcccgtaggacgtaccttccgttcccgtggtacggtaaccgtcccttacggttaggtttaatttttacggttttacgaggtttcgggtttcgtggtactagtcgaccgtaccggtcggggtccccgccggtaacggtccgtaccggaacgggcgggaaacgggggtcccgggtaggttcggggttacggacgtaggttaacgtacgacgtaacgtaggtaggtagtacggtaagtttacgtaagttaattacgtttagtacgtacgtaacgttaccgtaccgggtaacggtaacggggtaccctaacggttaaccctaccgtacgttaccgaaccgtaacgggaacctaaaccgtaaccgtttacccggaacttacgtttacggttaagtttacggtaaggtaacgtcggggtacctaccggtacgttaggacgtacgggtacggaggtaccgtacggttcgttacttaggttacttcggtagcggtaacggtacgtacggggttagggtaggttagtttagggttacggg

SEQ ID NO: 25987 - DNA, 757 bp, Homo sapiens
  misc_feature: GYAE6OF01C0UEJ.25.36.D03.1.454.CMB.1.raw
  modified_base (281)..(281): a, c, t, g, unknown or other
  misc_feature (281)..(281): n is a, c, g, or t
tcagactgtacagtcacgaccggtgctcgatttagctgcgtcacgatctctcgttgggggggtcacaagaggcagcgctctcgggacgtctccaccatggcctgggctctgctgctcctcactctcctcacctcaggacacagggtcctgggcccagtctggcctgactcaactgcctcgtgtctgggtctcctggacgtcaatcacctatttcctgccacgttcggaaccagcactgatgttgctactttgacttgtctctggtaccaacaacgaccganaacgctacaatctatattttgagacagtacgcgaccttcgtgggttctacgtcgacttcactggtctaccgtaagtcgtacgggtacaaccgtaccggtcccttacccgtaaactacttaccgttacgtcggggtcctaccgacggtacgtacgggaaacggtacgggtaacggttacgtttacgtttttagtttaccgttggttaccgttggtttacgtacggtttacgtttacgggttagggaccgtttaaggtaaaaaccgttagggtttttacgggttacggtccgggttaccggggtaaccgggaccggggttaaaccctaacggttttacggaaccccggtttacggtttaaacggttaccgaacccggtaccccgtaaaaccgggggtcccttacccgggtacccccccgttcgggtttacccgtaaccccggtttccgttaccccgggtttttccccccgggtccccc

SEQ ID NO: 25988 - DNA, 314 bp, Homo sapiens
  misc_feature: GYAE6OF01BSUS2.25.36.D03.1.454.CMB.1.raw
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (306)..(314): a, c, t, g, unknown or other
  misc_feature (306)..(314): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgactaacttattactgaccaaacaataataaataattattcgacctacttttggccgaggggaccaaggtggagactacaaacgaactgtaggctgccaccatctgtcttcatccttcccgcattcngtaactgtacngtctgagcggntggcgaacggncatagnnnnnnnnn

SEQ ID NO: 25989 - DNA, 819 bp, Homo sapiens
  misc_feature: GYAE6OF01EUPCR.25.36.D03.1.454.CMB.1.raw
  modified_base (231)..(231): a, c, t, g, unknown or other
  misc_feature (231)..(231): n is a, c, g, or t
  modified_base (310)..(310): a, c, t, g, unknown or other
  misc_feature (310)..(310): n is a, c, g, or t
tcagactgtacagtcacgaccggtgctcgatttagctgcgtcacgatctctcttggggagagaagacaggattcaggacaatctccagcatggcccggcctccctctcctcctcacccctcctcactcactgtgcgagggtcctgggcccagtctgtgctgactcagccctaccctcagtcgtcgtcggggacccccggcaggacgggtctccatcttcttgttctgggancagtcctccgacgtacggaaattagtttgtctacgtcggtaccagcacgcctcccaacgaaaccggccccaagcctccnctactctagtaggaatgactcgagcccggcccttacgagggtactaccgtagaacccgttacttcctacgtcggtacctacggtaacgttccgtcggtcccttcccggtcccgtccccgttccccgtacggccctacgttaccggtacgggtccggggtcccgttccccgggtaccggtacgggtaacgttcggaacgggtacttagggtaaactttaagttacccgttggttcggtacgttaaggggttttcgggtacgttcgggtacccgtacggttacggtaccgggttacggggttcccggggttacccgggttaccggggtttcggggttacccgggggtacggggtaaccggggtaaccggtaacggtacccggtaccggggtttaccccggtttaccgggttacgggtccccgaaaccgggtaccccggttaaacccgggtccccggttccccggttacccccccggttaccgggttacccgtaccccggttttcccccggg

SEQ ID NO: 25990 - DNA, 295 bp, Homo sapiens
  misc_feature: GYAE6OF01D7FUX.25.36.D03.1.454.CMB.1.raw
  modified_base (283)..(283): a, c, t, g, unknown or other
  misc_feature (283)..(283): n is a, c, g, or t
  modified_base (289)..(295): a, c, t, g, unknown or other
  misc_feature (289)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgccaacaatataataattattcgacctactttggccaggggaccaaggtggagatcaaacgaactgtggctgcaccatctgtctcatctcccgcatctgaactgtacagtctgagcgggctggcaaggcncatagnnnnnnn

SEQ ID NO: 25991 - DNA, 681 bp, Homo sapiens
  misc_feature: GYAE6OF01BRQU0.25.36.D03.1.454.CMB.1.raw
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtcgtccccaggagggacagtcactctcacctgtgccttccagcgcgtgggtcagtccaccagtgaacgaaccataccaaactcggttaccagacaacgaaccgtcggaccaacccaccgagggccagtagtatttagtggtanaacctaaaactaaaaacncttacgtaccggaccctcggtcccgttctacgacgtcctcccgtcggtaggggaccaacgcgtcgccctagactacgtcgtacagtgtcgtcgacgacgtaccgtggaacgggacgacggacctacgaaccctacccacgtccgcccgtcgtcctccgtcctggttcgggtcggttcggttcggttcggggttcgggttccggggacgggaacggtaacccgtaacggtccggtaccccgttacgggtccggtaccgtaaccgggtcccgtaacggtccccgttacccgccccggtttccggtacccgtaccgtttcccgttccccgttaccccccg

SEQ ID NO: 25992 - DNA, 760 bp, Homo sapiens
  misc_feature: GYAE6OF01B1JX6.25.36.D03.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (694)..(694): a, c, t, g, unknown or other
  misc_feature (694)..(694): n is a, c, g, or t
tcagactgtacagtcacgaccggtgctcgatttagctgcgtcacgatctctcttggggagagaagacaggattcaggacaatctccagcatggcccggcctccctctcctcctccaccctcctcactcactgtgcagggtcctgggcccagtctgtgctgactcagcccaccctcagtgtcgtcgggacccccgggcaaggngggtcctccattcttcttgttccgtggggancacgtccgtacccggacggtacggtaaaattaaggttttcgtactacgtacggtaccagtccgacgccctacccgaacggaaacccggacccccaaagcctcccctacacttacgtaagtaacgggaattacgaactccgacggcccgggtaccctacgggtaacggggtacttaaccccgtagaaccccggttattccgtcgtcggtcctaacggtaacggttccgtcgggtcccttcccggtcccggtcccccgtcccgtcggtaccctacgtccggtacgggttccgggtcccgtacccgggtaccggagggtactggtaaacgggtctagtaaacttcttaccggtggtacgtcggttagggtttggactgccgtagttcgtggtacgggttccggttaccggtgggttccggtacggggcggtaaccgggctaggccgtcggtacccggttaccgngggtacccaccggtacccggacggttcccgtaccccggaccccgttcggttaccctccgttccccg

SEQ ID NO: 25993 - DNA, 623 bp, Homo sapiens
  misc_feature: GYAE6OF01A2O0M.25.36.D03.1.454.CMB.1.raw
  modified_base (210)..(210): a, c, t, g, unknown or other
  misc_feature (210)..(210): n is a, c, g, or t
  modified_base (491)..(491): a, c, t, g, unknown or other
  misc_feature (491)..(491): n is a, c, g, or t
tcagactgtacagtcacgaccggtgctcgatttagctgcgtcacgatctctcttggggagcttcagatgtggtagagaagacaggattcaggacaatctccagcatggccggcctccctctcctcctcaccctcctcactcactgtgcagggtcctgggcccagtctgtgctgactcagccaccctcagtcgtcgtcgggacccccgggnaggacgggtcctccagttcctcgttgttcgtggggagcacgcctccggacggtacggtaaaattaagtttgtctacgtggtaccagcagcctacccgaacgaaaccggccccaagcctcctacactctaagtagaatgatacgacggccggccctagacggtactaccgtgaccgtattctcgtgctacgtagtcgtcgctcccgtcggtccctccgtcgccatcgacgggtcggccgtccggtacggagtcggtaggacggtctagtaacttcgttacgnggttacgacgttaggttacgggatccggtaccgagttcgacggcgggtacgggtcggtacgggtacggtaccgggacgggacgtaacccgtaggtcgtacggttaccggtacttagggactcggtacggccg

SEQ ID NO: 25994 - DNA, 308 bp, Homo sapiens
  misc_feature: GYAE6OF01C0G85.25.36.D03.1.454.CMB.1.raw
  modified_base (293)..(293): a, c, t, g, unknown or other
  misc_feature (293)..(293): n is a, c, g, or t
  modified_base (299)..(308): a, c, t, g, unknown or other
  misc_feature (299)..(308): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgaccaacaatataataattattcgaccacttttggccaggggaccaaggtggagatacaaacgaactgtggctgcaccatctgtcttcatccttcccgccatcctgaactgtacagtactgaggcgggctggcgtaaggcncatagnnnnnnnnnn

SEQ ID NO: 25995 - DNA, 873 bp, Homo sapiens
  misc_feature: GYAE6OF01D368X.25.36.D03.1.454.CMB.1.raw
  modified_base (215)..(215): a, c, t, g, unknown or other
  misc_feature (215)..(215): n is a, c, g, or t
  modified_base (461)..(461): a, c, t, g, unknown or other
  misc_feature (461)..(461): n is a, c, g, or t
  modified_base (534)..(534): a, c, t, g, unknown or other
  misc_feature (534)..(534): n is a, c, g, or t
tcagactgtacagtcacgaccggtgctcgatttagctgcgtcacgatctctcgttggggagctcgtgggagaggacgcccagcactagaagtcggcggttgttccagttcggagatcgagcacgtagaaaccacgaggaacggctaccgaacctaggtgggttaggttttcgggcgttaggacgtcgggttttccgggttttccttcgggtttcnccgtttttaagtttaaagggtggttccgtaccctaggttcggtacgtagggttcgcccgtacgggttggggtagggtaccgttcgggggtggggggacgtcgggtcccgtccggacggtccggtagggtccgtccgtagacgtcctcctcgtggaacgtacctccgttaggttagtttaagttttcgtcgtagggtttccggtcgtcgtagtcgaccggccgggttccgggtaccccggggtaccncgggaccgtcccgggtaccgggaacgggtacgggggtaccggggtcgttagggtcgggtacgtagtaacggtnaaccggactagtagtcggtaaggtcggttaacttaagaagtttaactagaccgtacggaaccgttaccggtaacggtaccgggtaacggtacccgttaccgtaacccgttacctaaccgtaccgtaaccgaacggtaaacccgtaacgtaacccgttccccgtaagttaggttttacggtaaaccgtttagggttaaccggaaggttcggtaaccggtaccgtacggtggtacggtacggtacggtccggtacgtcggttacgtagttcgtaacgttacggtgaccggtagtacggggtacggttacgggtaagttcgggttaaggtcgggttaaccgg

SEQ ID NO: 25996 - DNA, 625 bp, Homo sapiens
  misc_feature: GYAE6OF01CG2PP.25.36.D03.1.454.CMB.1.raw
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
  modified_base (256)..(256): a, c, t, g, unknown or other
  misc_feature (256)..(256): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (585)..(585): a, c, t, g, unknown or other
  misc_feature (585)..(585): n is a, c, g, or t
tcagactgtacagtcacgaccggtgctcgatttagctgcgtcacgatctctcttggggacataacaaccagattcttcctctaaaagaagcccctgggagcacagctcatcaccatggactggacctggagttcctcgtttgtggtggcagcagctacgaggtgtccactcccaggtccagctggtgcaatcgtgggcctggaggtgaaggnggccgtgggtcctggngaggtctccgtgtaacggtcctacggancgtagtgtgttcgcgagactatacactccgaccgtcgggtcccggcgacgtccgtcgtaggacgtcgggcctggnggtgggnggaacgacgtaccgaacccgccgaaccgaccgaacacgagtaggtcgacacagtcagttacgacggagagtacgtcttaccgtttcggaggtacgtacgtcccggacgggcgacgtagtactaagtactagtaactccttacgagtccgtacgtcgtacgttagttcggaaccggtcgaccggttacgtaattagttacctgtacgacgtaacgaagtcgtacgtcgacgttaacgaaggccgaacncggtccgacggtccgaccccggtcggccgggtaacccggg

SEQ ID NO: 25997 - DNA, 182 bp, Homo sapiens
  misc_feature: GYAE6OF01CC183.25.36.D03.1.454.CMB.1.raw
  modified_base (145)..(145): a, c, t, g, unknown or other
  misc_feature (145)..(145): n is a, c, g, or t
  modified_base (175)..(182): a, c, t, g, unknown or other
  misc_feature (175)..(182): n is a, c, g, or t
tcagactgtacagtcacgaccggtgctcgatttagctgcgtcacgatctctcttgggtattcggcggagggaccaagctgaccgtcctaagtcagcccaaggctcgccccctggtcactctcgttcccaccctcctcactgtacngtctggagccgggctggcaaggcgcatagnnnnnnnn

SEQ ID NO: 25998 - DNA, 797 bp, Homo sapiens
  misc_feature: GYAE6OF01EVQ7Y.25.36.D03.1.454.CMB.1.raw
  modified_base (210)..(210): a, c, t, g, unknown or other
  misc_feature (210)..(210): n is a, c, g, or t
  modified_base (414)..(414): a, c, t, g, unknown or other
  misc_feature (414)..(414): n is a, c, g, or t
tcagactgtacagtcacgaccggtgctcgatttagctgcgtcacgatctctcttggggagcttcagctgtggtagagaagacaggattcaggacaatctccagcatggccggcctcctctcctcctcaccctcctcactcactgtgcagggtcctgggcccagtctgtgctgactcacgccaccctcagtgtcgtccggggacccccggnaggacgggtcctccattcctctttcgttcgtgggacgcgacgccgtaccggacgttaacggtaaaattaacgttttcgtacgtacgtacggtaccaggcacgtcctacccgaacggaaacccgccccaagtcctacctactactactaagtaaggaatagactcgacggccgccctacggaggtactaccgtacggaaccgttnttccgtaccgtacggaccgttacggtaaacgttcggtcggtccccgttcccggtaccggtcccccttacccggtaccgggtacccctaacgtaccgtaacgggtccgggttacccgtccccgggtaaccgggtaacggtggttaccgggaaggtacccggttaacgttaaagtttaacgtttacgtaggtacgttacggttagggtttaggtaccgttcgaccgtacggttacgtacgggtacgggttccgggtacccgggttacgggttcggggtttaacccgggacggggaacccggtaaccggaccgttaccgggttacccgggtaaccccgtttacggtaaccgggtaacccggtaaccgaccccgggttaaacccggg

SEQ ID NO: 25999 - DNA, 402 bp, Homo sapiens
  misc_feature: GYAE6OF01CSZXH.25.36.D03.1.454.CMB.1.raw
  modified_base (166)..(166): a, c, t, g, unknown or other
  misc_feature (166)..(166): n is a, c, g, or t
  modified_base (385)..(402): a, c, t, g, unknown or other
  misc_feature (385)..(402): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgccagcctgatgtattttcgactaacttattactgaacctaanaattaattaaattaatttacttaccgaaccttacgttttcggaccgaaggggaccgtaagggtggaatactaacgaaacgacgttggtcgcctacgcactacttcgttgttccttactaccttcccgttcccgacctactttaccgacgttaacctacgtaaccgaacgttcgtacgggacggtcgggtacggtacggacgaaggggcctacaaggtgnnnnnnnnnnnnnnnnnn

SEQ ID NO: 26000 - DNA, 683 bp, Homo sapiens
  misc_feature: GYAE6OF01EUIRB.25.36.D03.1.454.CMB.1.raw
  modified_base (204)..(204): a, c, t, g, unknown or other
  misc_feature (204)..(204): n is a, c, g, or t
  modified_base (431)..(431): a, c, t, g, unknown or other
  misc_feature (431)..(431): n is a, c, g, or t
  modified_base (524)..(524): a, c, t, g, unknown or other
  misc_feature (524)..(524): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctgctcccagataccagatgtgacgtccagatcgacccagtctccatccctccctgtctgcattctgttgganacagtaatcagcatccgacgttcggccgggacgtacgtcgagggctagttagactaatttagttacgccgttaggtaatacgaaacgaacggaaaaccggtaggggaagttaccgttaccgtaacgccttcctagtacttacgtagtcgtcctcgtaccctaccgtaacgtttaaccaccgtacggtacgggttacccctagttcccgtcgggtacgaggccggtanacggttagaacgtcggtacgggaactacggtacgttccaacgtcttacaacctactacacgccgtcgccgtgaccagtaccgtaggaacgttntaggttccgtacttaaacgtttaactacggttataaaacgtaaaagttacttaaacgttcccgtacccgttaccccttagttcccgttaaccgggttaccgggaaccggggtaaccgggaaacggttaaagggacggtaacgtaaacgtaaaacccggg

SEQ ID NO: 26001 - DNA, 756 bp, Homo sapiens
  misc_feature: GYAE6OF01E1REF.25.36.D03.1.454.CMB.1.raw
  modified_base (405)..(405): a, c, t, g, unknown or other
  misc_feature (405)..(405): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggagttcctctttgtggtggcagcagctacaggtgtccactcccgaggtccagctggtgcaatcgtgggcctggaggtgaagacggtccgtgggtcctggtgtagggtcctcgtgtaacggtcctaccggaagcgtaggtgtcgttacgtcacgacacgtaccaccgtcaccgtcggggtaccgcgtacggcctcgtacgggtaaccgtcggggccctagggagggtcggggtacggtaacgaacgtccgaacccggccgtaacggaccgaacgaacgnggacgcgacacacgtccgtagttcagggtcgtaagtacgtccgttaccggttttacccggagtaacccgaacgtaccggaccgggtaccgtacgtaaacgtacgtaacgtataacggtaacttccgtaacacgttacgtaacctacggacgttacggtaccggtacggtaccggtaccgggccgtttaaacgtacgtttacggtcggttacggacggtaaacgggtaaacgtaccggttacccgtaaaccggttaccgttaaaccggtaaacggaacccgtaacggtaaccggttcgttaacccggttccccggaccgggttaaccccccgggtaccgggtaaacccgggg

SEQ ID NO: 26002 - DNA, 815 bp, Homo sapiens
  misc_feature: GYAE6OF01A4CYM.25.36.D03.1.454.CMB.1.raw
tcagactgtacagtcacgaccggtgctcgatttagctgcgtcacgatctctcttggggagctctgggagaggagcccagcactagaagtcggcggtgttccattcggtgatcagcactgaacacagaggactcacatggagtttggctgagtcgttgggttttcctgttgcttcgttttaagaggtcgtcctactgtccgaaggtcgaccgtaccgtgggtggtagttccggtggggggacggtcggtcggtccgacggtccgtacggggaccgtccccgagtacctccgttccgtgtacgaacgtccgttcggttggtacttttaggttccgtaggttcggttcgtaggctacgtcgacgtacggtcgggtccctacggacggtccttaccggaaggtccgggaaacggggccggtaacgggttggttacggtacgttaacggttaacgtcgaacctaagtagtagtacgtaaggtacgtttagacgtaaagtttcggtatcgacgtacggtaaccgtcgggtaacgggtaaccggaccttaacggttccccaaaccgttcgtacgaaccgtaacgtaacgtaccctttaaccgtaccggaaaccttggtttacgtacggtaacgttggtaaacgttcgtcgaacggttcccgtaaggaccggttagtaaaccgggtcggttacccgttcgtaccgtttagggtaaacctttacgttaacgggttccggaaacgggttacccgtaaaggggtttacggttaacccggggggttaggtttaaccgggttaacggtttaaccggttaacccggggg

SEQ ID NO: 26003 - DNA, 851 bp, Homo sapiens
  misc_feature: GYAE6OF01EU4RW.25.36.D03.1.454.CMB.1.raw
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtgtccccgaggagggacagtcactctcacctgtgcttccagcgcgtgggtcagtcaccagtgagaaccactaccaaaacgtcggttaccacgacaaacgaaaacccgtacggaaacccaaaaccccgaaccccgaacggggacctaaccgttaggttaagttttaagttacgggtacgaacctaaaaaccttaaaaaaaacctaccgttaccgtttaacccgggtaaccccccgttaccgggtcccccggtttaccgtaccgtaaccgggtcccctttcccccggttacccggtttcggggggaaccctaaaacggccttaccgggtaccccctacggtaaccctaaccggttcgttaccgaaggttaacgtcggttacgcgtaccggtacccgttagggaacgggtaacggacggtaccgttacgaacccgttaacccgaccgtacgtcccgtcggtccttcccgttcccggttcggttcggggttcgggttcggttccgggtttcggggttcggggttccggggacggggtaaccgggtaaccgtaaaccggttcccggtaacccggttccgggttcgggtaccgtaccggacccgtaaccgggtcccgtaccccggtccccgttaccggttacccgtacccgttcccggttcccgttaccccccg

SEQ ID NO: 26004 - DNA, 677 bp, Homo sapiens
  misc_feature: GYAE6OF01BEF33.25.36.D03.1.454.CMB.1.raw
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtcgtcggggaccccgggcaggacgggtcctccattcttcgttgttcgtgggagcagcgtccgacggtacggtaaattaagtttcgtctacgtcggtacagcagctcccgaacgaaccgccccaagcctcctcatctaagtagatgatcgacggccggcctacgacgggactaccgtcgaacctattctcgtggtctacggacgtcgtcggtcccttccgtcccggtcccgtcccgtcggacctacgtccggagggttccgggtcccggttacccgggtaccgggtaaggtacgttacgggaacgggtcttaaaggtaacttacgtttacgtgggtacgtacgttgggttacggtacgtcgcttaggttcgtcggtacgggtacggtccgggttaggttccgggtacggggaacgggtcggaaccgcgtaccggtacggtaccgtaccggtaaggccgtaaccgcgaccgttcgccccgtaccgtctccgtccgtaccccgg

SEQ ID NO: 26005 - DNA, 676 bp, Homo sapiens
  misc_feature: GYAE6OF01BICYC.25.36.D03.1.454.CMB.1.raw
  modified_base (150)..(150): a, c, t, g, unknown or other
  misc_feature (150)..(150): n is a, c, g, or t
  modified_base (241)..(241): a, c, t, g, unknown or other
  misc_feature (241)..(241): n is a, c, g, or t
tcagactgtacagtcacgaccggtgctcgatttagctgcgtcacgatctctcttgggggcagaagtctctctcagtcaggacacagcatggacatgaggtccctgctcagctcctgggactcctgctgctctggctcccagactaccagntgtgaccgtcagatcgacccagtctccactccctcctgtctgcctatcgtggtggaacacagaatcagctatcgtacgttcggccggacgngtacgaggctagttagactaatttacgtacgtacgtaggtactacaaacgaacgtaaccggaggtaacgtacttaccgtaagccttacgtagtacttactacgtcgtcctcgtacccttaccgtactacgtaccgtacggtccggtacctagtttccgtcgttacgacggtcgtaccgaggtttacgacgttcggacggtactacggtacttccgtactcctactaacgtacgtacgacgtccgtaaccgccttcggaccgtaccgtacgtataaacgggtctttacggtaaccgttacctttaaaccgttaacttaaccgttaaccgtaaagttaaacgttacgttaaacgtaccctacccgttcccttacgtaccgttacggttaaccgggtaccggaacggtacggtaaggtaccgtaaagtccgtaaacgg

SEQ ID NO: 26006 - DNA, 726 bp, Homo sapiens
  misc_feature: GYAE6OF01D4H86.25.36.D03.1.454.CMB.1.raw
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
tcagactgtacagtcacgaccggtgctcgatttagctgcgtcacgatctctcttggggacataacaaccagattcttcctctaaagaacgcccctgggagcacagctcatcaccatggactggactggagttcctctttgtggtggcagcagctacgaggtcgtccactcccaggtccagctggtgcaatcgtgggcctggaggtagaaggcggtccgtgggtcctcggtggtacgggtcctccgtaggtaacgtcgtaccggaancgtagttcgtgttcgngagacatacactcgacgtcgggtccgcgacgcctcgtcggaacgtcgggccgtggtaggtcggggaggaacaacgtaccgaaccggccacggaaccgaaacaacgacggtaacggtcgacaacgtactcgtacggttacgacgggcaacgtacgtccttaccgtttcgtacgggaactaaccggtccggaacgggtcaacgtaagtaacttacgtatagtaaccttactacgtaagtccgtaccgtgtaaccggtttacttacgggacccgtaacggacgggttacccttaaagttacgttagtacgggtaacggaaccggtaaacggtaaaacgggtacccgtttaccgtacggtaaacccttaaacgaaacggtacccggtacacggggtccgttacgggacccgtaccccgggacccggggttccggggaaaacccccggg

SEQ ID NO: 26007 - DNA, 829 bp, Homo sapiens
  misc_feature: GYAE6OF01CWL8L.25.36.D03.1.454.CMB.1.raw
tcagactgtacagtcacgaccggtgctcgatttagctgcgtcacgatctctcttggggagctctgggagaggagcccagcactagaagtcggcggtgttccattcggtgatcagcactgaacacagaggactcaccagtggtcgtttggctgagtcgttgggttttcttgttgtcttagtttaaaagtgtctagtgtgaggtgcagcgtggcggagtcgtgggaggacggtcctgactccgtacggcccgggttcggggggtccctggacgtcttccgttcccgtgtcgcctacggtcccttcggttacgggttccgacggttacggttacgtaccgaacgtacggtacctttacgttcggtacgttccgggttccggggttccccggaccggtacgggtaccggtacccgggaaagggggtaacgggggcgtaggggtcggtcgtcggttaccttacgttaagtttaagtttaacgtaacggtacgtaaacttaaacgtaaccctaaacccgtaacgtaccgtaacgtaccgtaccggttacggggtaaccggtaaccgggtccctttaatttcccttaattcccgaacgtaaggacctaactaacgttaacccgaaagtaaacccttacttctaacgtttactaaacaattcccggaaacgcccctaagggaacggaacccggtcccgggaacgggacccgtaaccgggggtttcctaggtttaaacgtcgggttagggacccgggtcggggtaaacgggttaactaagtttccgttaaggggtttctttttaacggtaaaccttcgttttacccctttaacccggg

SEQ ID NO: 26008 - DNA, 309 bp, Homo sapiens
  misc_feature: GYAE6OF01B9F7Y.25.36.D03.1.454.CMB.1.raw
  modified_base (292)..(292): a, c, t, g, unknown or other
  misc_feature (292)..(292): n is a, c, g, or t
  modified_base (298)..(309): a, c, t, g, unknown or other
  misc_feature (298)..(309): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactagtactaaaaatttgacagtgacccgtggattgttcggacccgagggaccaaggtggacatacaaacgaactgtggctgcaccatctgtcttcatccttcccgccatctagactgtacagtctgagcgggctggcaagcncatagnnnnnnnnnnnn

SEQ ID NO: 26009 - DNA, 810 bp, Homo sapiens
  misc_feature: GYAE6OF01AUIR7.25.36.D03.1.454.CMB.1.raw
  modified_base (219)..(219): a, c, t, g, unknown or other
  misc_feature (219)..(219): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctgttgcttcttttaagaggtgtccacgtgtcaggtgcacgtgggtgagtcggnggggagcgtggccaggccgtgggacgtccctgagacctctccgtgtgaacgtcctcgtggtatttacgttcaggttggttcctaggctagtcggcctacggtcggggtccccgacgacggtcccgtaccgaggggaccggtaaacggggggcccggtaggttcggggttacggacgttaaggtttaacgacgggactaacgtagttagggtaagttaggggtaaacgttttcgaaggtttaaaactttacgtttagtaccggacgtaaccgttaacccggttaccgggttaaggggaaccggggtacccgtaaacgttacccgtaaaccgtactacccgtaaccgaaacggtaaccgtaaacccgttaacgttaaccccgggtaaatttaccgtttaggtacgtttaaacggttaaggaaacgttcgggttaccgacggttaccgtacgggtacggtaacggttccgggaacggttaccggttaccggtaccgttaccgtttagggttaaccgtttacggtacggttacggtaacgggtacgggttacgggttacggggttaacgggtttgggttaaacgggttaaccggg

SEQ ID NO: 26010 - DNA, 822 bp, Homo sapiens
  misc_feature: GYAE6OF01A3QU4.25.36.D03.1.454.CMB.1.raw
tcagactgtacagtcacgaccggtgctcgatttagctgcgtcacgatctctcttggggagctctgggagaggagcccccagccctgagattcccaggttgtttccattcagtgatcagcactgaacacagaggactcaccatggagttggactagagcgtggtatttttccgttttggtacttaattttaaaaggtcgtacctaggtgtaggaagtgactaacgtggtggacgtcggtgggggaggtcgttggtacacggtccgtcggccacggtcccctaggacgtacctcgttccgtgtcgccacgtccctcgtagtactttcctaccgttttagattcgtatttacgtccgaccgtaagttcggccgtacgggttccgggtacccgacctaaccggtaccgtaccggggaaggggtacgggtacccggttagggggtacggttcgggttacgtacggttaaggtttacgtttagggtttaagaacggttagggtagggttacgtaggtaacggttacggtacgttaggtcgggtacggttacccgtttgggtacgggtaaacggggttaacccgggtaccctttaactacccggtaacctaccgttacccgaccggtaacgaaaccgggaacccaacccggtaacctaaaccggtaccctttcccgtacgttaaccgtcgtaagtaaaccctaaggtaccaaacggttcgtagtacggtacgacggtcgtaacgggacccggacggttacccggtagttttacgttaacttacgggtaaccgttaaaggttaaaacctttaaagtttaacggttaacgg

SEQ ID NO: 26011 - DNA, 499 bp, Homo sapiens
  misc_feature: GYAE6OF01BODCX.25.36.D03.1.454.CMB.1.raw
  modified_base (464)..(499): a, c, t, g, unknown or other
  misc_feature (464)..(499): n is a, c, g, or t
tcagactgtacagtcacgaccggtgctcgatttagctgcgtcacgatctctcgttgggatagtaagttattcagcaggcacacaacagaggcagttccagaattcactctcaccatcagcacgcctgcacgcctgattgtattttgactaactttattactagacctaaactaaattaattaaattaatttacgtttaccgtacctttacggtttttcgggacccggaacgggggtaaccgtaaggggtaggtaagtaacgtaaaccgaaaaaccggtaaacgttgggttacgggccgtacgaccctaacctacgtttccgtttcgtttccttacctacctttccccctttcccccggacctaacctttcgtaacgttaaaccgttgttaaccgttaacgtccgttcgggtaaccgggcgggggtcgtacggggacggaaccggggcgtaaccgtaagtgctgnnnnnnnnnnnnnnnnnnnnnnnnnnnnnnnnnnnn

SEQ ID NO: 26012 - DNA, 860 bp, Homo sapiens
  misc_feature: GYAE6OF01BKH7T.25.36.D03.1.454.CMB.1.raw
  modified_base (195)..(195): a, c, t, g, unknown or other
  misc_feature (195)..(195): n is a, c, g, or t
tcagactgtacagtcacgaccggtgctcgatttagctgcgtcacgatctctcttggggagctcgtgggagaggagcccagcactagaagtcggcggtgtttccattcggtgatcagcactgaacacagaggactcaccagtggtagtttgggctggagtcgttgggtttttcctcgttgtcttagttttaaaggnggttctcctactggtcgtaggtgacctacgtgggtggacggttcggtggggggacgtcggttacggtaccgacggtccggttgggtaccggttcccgtaggtaccgtaccgttccgttccgtaggttacggtaacgttcccgttacggtttagggtttaacttttttacggtttaccgtagggtttcggtttcgtagggtacctagtcggtaccgttacgggttccgggtcccaccggtacggtcctaccgggacgggaccgggtaacggggtccggtaggttcgggttacgacgttaaggtacgtacgacccgtaagagttacggtaagttaaggttaacgtttacgtaaaggttaaattttacgttacggtacggtaaccgtaaccgggtacccggtttaacgggtaacggggaaccccggttaccttaaacccggttacccctaacccgtttaacggttccccgtaaaacgggttaaccgaaccgttaaaccgttaaccccggtttaaccgtaacgttaacggtttaccgtagtttaacgtaaggtaccgttcgtacgacgtacgtgaacggtcgtaggtaaccgtcgtccgtagttacgttagttacgttggtagtcggaggtaggttacggtaggggttacgttaggtacggtttacggg

SEQ ID NO: 26013 - DNA, 730 bp, Homo sapiens
  misc_feature: GYAE6OF01EG6FC.25.36.D03.1.454.CMB.1.raw
  modified_base (187)..(187): a, c, t, g, unknown or other
  misc_feature (187)..(187): n is a, c, g, or t
  modified_base (385)..(385): a, c, t, g, unknown or other
  misc_feature (385)..(385): n is a, c, g, or t
  modified_base (429)..(429): a, c, t, g, unknown or other
  misc_feature (429)..(429): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagtcttgggttttcctcgtttgcttcttttaaggnggtgtccactgtcaggtgcaccgtggtggagtcggtgggggacgtcggtggtccagcccgtgggacggtccctaggacgactctccgtgtagacgtccttgtggtattttagttcagttcggttctggcagtcggcctacggtcgggcccgccgaggcctccgagggcgacggggcgtaggtggtcgacgtagtttanacgcacgtgtaggtagtagggtaatttcgaagtaacttagttancggacgtacgtaccgtccgggtaaggtaaccgggtaccttaacgttaccgaaccgtacttacccggttaaccgaaggtaaccgtaaccgttaacccggttaaccccggtaaacgttacgtttacggttaacgttaacggttaacggtaaacggttcggttacgaacggttacccgtagggtacggtacggtaccggaacggtaccgttaccggtcgttcgttaggttactttacgttcggtacggtacggtacggtaacggggttaccggggttaagggttgggttaacggtttaaacggg

SEQ ID NO: 26014 - DNA, 630 bp, Homo sapiens
  misc_feature: GYAE6OF01AU87J.25.36.D03.1.454.CMB.1.raw
  modified_base (319)..(319): a, c, t, g, unknown or other
  misc_feature (319)..(319): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctctttaagaggtgtccatgtcaggtgcaccgtgggtggagtcgtggggggaggcgtggtccaggcccgtgggacgtccctgagacctctccgtgtagaagcctcgtggtattttagttcagttggtctggcatggcacgtgggtccncaggctacgaggcgaaggggccgtagtggtgctagttanagcagntgatggattcgagtatatagngcagactcggtgaacggctattcactatccgtacagtacgaactacgttacccggaaacttagttacggtacgttaacgttagggtaaaagttccgggtaacgtacggtccgtaggaacggtaacgggtcggtaacgggtacccgtccggggttaccttcggttaacgttacgttacggttacggttacgacgggttaaggtaccgggttacgggggtagggttagggttaacggtttaacgggg

SEQ ID NO: 26015 - DNA, 836 bp, Homo sapiens
  misc_feature: GYAE6OF01DZL3T.25.36.D03.1.454.CMB.1.raw
  modified_base (172)..(172): a, c, t, g, unknown or other
  misc_feature (172)..(172): n is a, c, g, or t
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (498)..(498): a, c, t, g, unknown or other
  misc_feature (498)..(498): n is a, c, g, or t
tcagactgtacagtcacgaccggtgctcgatttagctgcgtcacgatctctcttggggagagaagacaggattcaggacaatctccagcatggccggcctcctctcctcctcaccctcctcactcactgtgcagggtcctgggccagtctgtgctgactcacgccaccctgngtcgtcgccgggaccccggnaggaggtcctcatcttcttgtcgtggancgacgccgtccggaacgtacggtaaattagtttcgtctacgtcggtaccgacgcgtacgaccgtacccgaaacggaaacccggtaccccaacgtcctaccctctacgttaccgtttaagtaaggtaaaacttcggacgttaccggaccgggtcccgtaccccgtagggtaaacgggtacctaacccgttcggaaccgttacgtttccgtacggttcggacccgttacggtaacggttccgttcggtcccttccccggtcccggtcccgttaaccccgnggaccccttaagttccgggacggttcccggggtccgttaccccgggtaccggtagggtacgttcgggacggtttactaaggttaaacgttccgtttacggttaaggttacggtacgggttttaagggttaccggtagtacccggtacgttacggttccgtagggttacgggtccggggttacccgggttaggggtttaccggtccggggaaggggtaaccgtaccggtacggtcccgttccggggaaacccgttttccggacggttaaaccgcccggtaaaccgtaccggttcccccgaccccggttaaccccggttccgttaccgtcccttacccgg

SEQ ID NO: 26016 - DNA, 967 bp, Homo sapiens
  misc_feature: GYAE6OF01CXCJX.25.36.D03.1.454.CMB.1.raw
  modified_base (478)..(478): a, c, t, g, unknown or other
  misc_feature (478)..(478): n is a, c, g, or t
tcagactgtacagtcacgaccggtgctcgatttagctgcgtcacgatctctcttggggtctggcgccaggggtcccttcaatatcagcaccatggcctggactcctctctttctgttcctcctcacttgctgcccgaggtaccaaatctcagtactggtggtgactcgaggacgccctcactgactcggtccgtcccgagggacgggacacgtcctactcctccaccgtgtcgtccttccgagccgtcgtcggtacacgtaccgaccgagtacgaaaccgtaacctaacgtaaccgtaaccggttaccggtaaccgaacgaaccgtaaaccgtaaaccgtaacggaaaccccaaaccccgtaacccggaagggaccttaaacgtaagtttaacgtttacggtaacggtacgtaaaacctaaaaaaccttaaaaacctccggtttaccggttaccggtaccccgtcggtcccgtttacnccggtaaccgtcccgtttacccggtccgggttacggggaaactaaccggtcgtacccggtacccgtaacgtaccgtcgttacgtaacgtacggtaacgtcggacggtaccacgttcgggaaacgggtacggaccggtacgtcgtaccggaaacccttaccgccgttaccgggtccttaccggttccctttaccggtccgggtttacggggttaccgggggttttcggtcccggggttttacgggtttcggggggtaccgggtttaccccgggggaacgggggtttaaaaacccctaaacccgggttaaaccgggttccccgggtacccggggttttacccgggttacggggtaaccccccgggtaaacccggttcccccggtaaaccgggggtttcccccttacccccccgggttaaaccccggggtttcgttaaacccccgttttcccccgggtttccccgggttaccccccccgggttttcccccgg

SEQ ID NO: 26017 - DNA, 301 bp, Homo sapiens
  misc_feature: GYAE6OF01BAFVO.25.36.D03.1.454.CMB.1.raw
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (295)..(301): a, c, t, g, unknown or other
  misc_feature (295)..(301): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgccaactaatataaataattattcgacctactttggaccagggaccaaggtgagatacaaacgatgtgctgccacatctgttctcatcttcccgccatctagactgtacngtctggacgcgggctggacgaggcactanagnnnnnnn

SEQ ID NO: 26018 - DNA, 750 bp, Homo sapiens
  misc_feature: GYAE6OF01ALGEB.25.36.D03.1.454.CMB.1.raw
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (249)..(249): a, c, t, g, unknown or other
  misc_feature (249)..(249): n is a, c, g, or t
  modified_base (604)..(604): a, c, t, g, unknown or other
  misc_feature (604)..(604): n is a, c, g, or t
tcagactgtacagtcacgaccggtgctcgatttagctgcgtcacgatctctcgttgggggcagaagtctctctcagtcaggacacagcatggacatggacgggtccctgctcagctcgtagggctctgctgctcgtcggcctaccagactacagagtgtcgaccgtcaggatcgacctacgtctaccgtcttccctccttggtctgacctagttcgttggtagacgaactaanacgtcanctactccgnggtccgggaccgggtacgaggtacggacgggtacctattaacggtactttaagttttaccgttacggttacccggtaagtttaacaaccggaaaccggaaaagggaaaccggtacggggtaaccttacggttaaaccctagggtacccttccggtaagtaccttcgtacgtccgtcttaccgtacccgttaactaaccggttcacccggttaccgtaccgggttacccttggttacccgtcggtaccggtacggaccggttaagacggttacggtacgtaccggttacgggtaactacggttaccgttcccttaaccaccttacgtaaccgttctacggaccgtgtacccgtcgngtacccgagtacgtacgtattccgttagttactaacttacgtttagaacgtaattaacgtaacttacgacctacgttaccctcctacggttcggttaacggtccgggacgggtaaacggtgttaaacggcgaacttaccgggtaac

SEQ ID NO: 26019 - DNA, 779 bp, Homo sapiens
  misc_feature: GYAE6OF01DAT6H.25.36.D03.1.454.CMB.1.raw
  modified_base (199)..(199): a, c, t, g, unknown or other
  misc_feature (199)..(199): n is a, c, g, or t
tcagactgtacagtcacgaccggtgctcgatttagctgcgtcacgatctctcgttggggagctcgtgggaggaggagcccagcaactagaagtcggcggttgtttccagttcggtgatcagcactgaaacacagaggacctcaccgtagtggtagtttgggctgagtcgttcgggttttcctcgttgtcttgtttaagnggtctcctacgtgtcgagtgcctacgtgggtggagtcggtgggggagtcggtacggtcacgtcggtgggacgtcctggacgtcttcgtccgtgtacgacgtcctcgttggttaatttagttcgtaggttcggtcgtggtactagtacgtccgacgtcgggtacccgccgacggtccgtaccggagggaccgggaaggggtcccggtaagggtggtggtacgtagttacgactacgacaggttagagtaggttaacgttgttaagtaattaacgttagtacgtacgtaacgtacccggttacgggtaacgggtaccggtaccgttaacgtaaccgtaccgtaccgttaccgtacgtaacggtaaaccgtaaacgtaacccgttaaccgtaacgttaaagtttcggtttaacggttaaacgtaacggttaaaggttcggtactaaccgggttaccgtagggtaaggtacccggtaggtaacccggtacgttcccgtacggttacgttaggtttacttacggttagtacggaggtaaacgggttagggtaccgggttaagggttacggttaggtttaaacggg

SEQ ID NO: 26020 - DNA, 833 bp, Homo sapiens
  misc_feature: GYAE6OF01A0E3J.25.36.D03.1.454.CMB.1.raw
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccgaggtccagctggtgcaatcgtgggcctggaggtgaagacggccgttggggtcctgggtggaggggttctccgttaggtaacgggttcgtacccgggaaagcctaggttcgttggttccggtacaaggacataccacctccgaccgtcggggtccggcacgggtcctcgtacggtaaccgtcggggtaccgtgggaggtcgggggttaacgggaacaacgtaccgaaacccggccgaaccgggaacccggaaacctaaacggaacgggacggtacccggacaacgtacgtaccggtagtttaccggacggggacctaaggtacgttaccgttacccgtttttaccgggtagggtaaacccttaccgggtacccgggaccggggtaccgacgtaacgttaacgtaacgtagtaacggtaacttaccgtaacgtaacgtaccggtaccgttacggtaacgtttacgtttacgggaaccgggaacccggttacccgggtacccgttttaaacgttaacgttttaacggtacggtaccggaggtaaacggtaaaccggtacggttaccctacggtaacccttaaaccgtaaaacgggtccgtaacgaaccggtccggtacgggtaccccgtcccggtaacccccgggttacgggggtaaccccggg

SEQ ID NO: 26021 - DNA, 364 bp, Homo sapiens
  misc_feature: GYAE6OF01CPWLK.25.36.D03.1.454.CMB.1.raw
  modified_base (155)..(155): a, c, t, g, unknown or other
  misc_feature (155)..(155): n is a, c, g, or t
  modified_base (293)..(293): a, c, t, g, unknown or other
  misc_feature (293)..(293): n is a, c, g, or t
  modified_base (316)..(316): a, c, t, g, unknown or other
  misc_feature (316)..(316): n is a, c, g, or t
  modified_base (319)..(364): a, c, t, g, unknown or other
  misc_feature (319)..(364): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgactaacttattacngacaacaatataataattactcgacctacgtttggaccgaggggaccaagggtgaagaatacgaaacgactgtggactgacaccagtctagtcttcacttcctcccgctatctagtactgtacagtcagaggtccggngtaggacgtacggcgacagtagnacnnnnnnnnnnnnnnnnnnnnnnnnnnnnnnnnnnnnnnnnnnnnnn

SEQ ID NO: 26022 - DNA, 743 bp, Homo sapiens
  misc_feature: GYAE6OF01BFVN8.25.36.D03.1.454.CMB.1.raw
  modified_base (145)..(145): a, c, t, g, unknown or other
  misc_feature (145)..(145): n is a, c, g, or t
  modified_base (174)..(174): a, c, t, g, unknown or other
  misc_feature (174)..(174): n is a, c, g, or t
  modified_base (557)..(557): a, c, t, g, unknown or other
  misc_feature (557)..(557): n is a, c, g, or t
tcagactgtacagtcacgaccggtgctcgatttagctgcgtcacgatctctcgttgggggcagaagtctctctcagtcaggacacagcatggacatggagggtccctgctcagctccgtgggacctctgctgctctggcctccanataccgagatgtgacgtcagatcgacccngtctccacttcccttcctgtactcgactattcgtggtaggactacagtaactcgatcatcctaacggtcggccgggtcgacggtcggagggtactagttacgtaacgtttaagttttacgtttagtcccgtttaggtaacctaacaaccggaaacggaaaaccggtagggtaacgtaccgtttaccgtaacgtccttccgagttactacttacgttcggtacctccgtacccttaacccgttaccgttaccgtaaccggttcccgggtacccgggttaacccttgttaccgttccgggtcacggccggtagtacgtacgttagtccggtaaggtacgtaagtacgttaccactaccttactactcgtccgacgtccacgtccngaccgtcaagtagtacgtcttacggttacttacttaacttaccgttaagaacgttaaaacttaccgtaaactttaccgtaccgttccccgttaccctttaccggttacggttacccggggtttacccggaacgggggtaacgtacccggggtaagaacgggtaacccggttaaacggtaaacccgg

SEQ ID NO: 26023 - DNA, 688 bp, Homo sapiens
  misc_feature: GYAE6OF01EGANB.25.36.D03.1.454.CMB.1.raw
  modified_base (100)..(100): a, c, t, g, unknown or other
  misc_feature (100)..(100): n is a, c, g, or t
  modified_base (162)..(162): a, c, t, g, unknown or other
  misc_feature (162)..(162): n is a, c, g, or t
  modified_base (185)..(185): a, c, t, g, unknown or other
  misc_feature (185)..(185): n is a, c, g, or t
  modified_base (265)..(265): a, c, t, g, unknown or other
  misc_feature (265)..(265): n is a, c, g, or t
tcagactgtacagtcacgaccggtgctcgatttagctgcgtcacgatctctcttggggacataacaacagattcttcctactaaagaacgcccctgggancacagctcatcaccatggactggacctggaggttcctcttgtggtggcagcagctacaggtntccactcccaggtccagctggtnacatcgtgggcctggaggtgaaggaggtccgtgggtcctcgggtgagggtcctaccgtaggtaacggtccgtaccggaanctagttgtcgttcgtcagactactacacctcgaccgtcgggtccgacgtacggccttcggtaggaaccggtcgggcctgggacgggtaggggtacggaaaccacgtaccgaaccgccgacggacccgaacgaacgaggacggtccgacactacgtacgtagttacgacgggtacacggtactccgttacccgttttcggtacggtaacctaaccggtccggacgggccgtacacggttaactacgactaggtaactacgtacaacgtacgtacgtcggtaccgtagttcggacggtaccgaccggttacttacgttacgtacgttacgtaggacgaacggtacggtacgttcccgacggtacctaaacgaacgtacggaagtccgtacgtccggaccgtccccggaccggtcgggaaccccgg

SEQ ID NO: 26024 - DNA, 480 bp, Homo sapiens
  misc_feature: GYAE6OF01A7SOB.25.36.D03.1.454.CMB.1.raw
  modified_base (367)..(367): a, c, t, g, unknown or other
  misc_feature (367)..(367): n is a, c, g, or t
  modified_base (396)..(397): a, c, t, g, unknown or other
  misc_feature (396)..(397): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (416)..(417): a, c, t, g, unknown or other
  misc_feature (416)..(417): n is a, c, g, or t
  modified_base (419)..(420): a, c, t, g, unknown or other
  misc_feature (419)..(420): n is a, c, g, or t
  modified_base (423)..(480): a, c, t, g, unknown or other
  misc_feature (423)..(480): n is a, c, g, or t
tcagactgtacagtcacgaccggtgctcgatttagctgcgtcacgagtcgtctctgggatagaagttattcagcaggcacacaacagaggcagttccagaattcactctcaccatcagcagcctgcagcctgatgtattttgactaacttattactcgaccaaactaattaactaaattaacttattccggtaacctaccgtttttacgggcccgtaagggggaacccaaagggttggaagaataccgaaaacggaacgtgtcgggctacgaccaacccaagttctcggttaccttcgaacttcccgttaccccgcctaattccgtaggaaaaccctggttaaccagtccgtggaacgggccgggtntcgggacgaaagggccgagtaactaggannancngacattcnggacntnntnngtnnnnnnnnnnnnnnnnnnnnnnnnnnnnnnnnnnnnnnnnnnnnnnnnnnnnnnnnnn

SEQ ID NO: 26025 - DNA, 806 bp, Homo sapiens
  misc_feature: GYAE6OF01B7KYF.25.36.D03.1.454.CMB.1.raw
  modified_base (758)..(758): a, c, t, g, unknown or other
  misc_feature (758)..(758): n is a, c, g, or t
tcagactgtacagtcacgaccggtgctcgatttagctgcgtcacgatctctcgttggggggggtcacaagaggcagcgctcgtcgggacgtctccaccatggcctgggctctgctgctcctcactctcctcactcgaggacacgacgggtccgtcgggccctagtcgtcggtcctacgacctaccaaccgtcgcccgttccgttcggttcgtcgggttccttaccgtcgggtaaccgtacaactcctaccttactttccgtcgtaccacgtaacggaaccacgactacgtgtagttcggttacgtactttaccgtttcgtaccgtttcggttactcgttaacgaaaccaaaccaaccggtaacccgaacgtaacgcctaacctaactacttaagtttagtttacgaaccgtaactacggtaaccggtccccggttccgtttacgggtttacgggtttaccctagggttaacctactttaccggtaacggtacggttaccctaacggttaaccgtcggtaacggaaccctaaaccggtacccgtaccctttaaacccgtaaacgttacgttccggtacgtaccgggtaccctcggaacgtacgtaacggaggtaccgtagtttctttaacgtttcttccgtaggttcgttaggtcgtaagttcgtttgggaccgttaagttaaaccgtaaaggttcggttacggacggtaccgcgggtaccggacgtacgtagtaccgtacgtacgtacgacgtaccgngtaccgtccgtaccgtcccgtacgtctacctcccttccgtcccgtccg

SEQ ID NO: 26026 - DNA, 425 bp, Homo sapiens
  misc_feature: GYAE6OF01A22TG.25.36.D03.1.454.CMB.1.raw
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (369)..(370): a, c, t, g, unknown or other
  misc_feature (369)..(370): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (384)..(425): a, c, t, g, unknown or other
  misc_feature (384)..(425): n is a, c, g, or t
tcagactgtacagtcacgaccggtgctcgatttagctgcgtcacggatctctcttgggatagaagttattcagcaggcacacaacagaggcagttccagaattcactctcaccatcagcagcctgcagcctgatagattttggacaacgtttattaactgccaactaataataaattaagttacttcgacctacctttttggccgtaaggggaccaagggtggagaacttaccaaaaccgtaacgtgtagggctgaccctaaccgattcctgttcctttccaagtttcccttccccgacctatctacgaacctgtaaccgngttaccnggaacgccggggctagggaccaagggaccacgtacgtaggnncagnatgcaggncnnnnnnnnnnnnnnnnnnnnnnnnnnnnnnnnnnnnnnnnnn

SEQ ID NO: 26027 - DNA, 631 bp, Homo sapiens
  misc_feature: GYAE6OF01EU9T4.25.36.D03.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (437)..(437): a, c, t, g, unknown or other
  misc_feature (437)..(437): n is a, c, g, or t
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
tcagactgtacagtcacgaccggtgctcgatttagctgcgtcacgatctctcgttgggggcagaagtctctctcagtcaggacacagcatggacagtggagggtccctgctcagctcgtgggactcctgctgctcgtcggcctccagataccagatgtgactccagactcgacctagtcctcctactcctcctgtctgctntcgtgtagganacagtacncagactntcgtacggtcggccgggagtacgtcggacggtactacttaacgattaagtttacgttaccgtcttaaggtaacctacgaaacggaaccggaaacggaggggtaacgttaccttaccgtacgtcttctagacttgtacgtcgtcgtccgtacctaccgtacgttccacggtccggtaccggtcctacgtcggttccggtagcggtacggtntaacggtcgtaggtccggtagactacgttactctactactactatactcncgtactcncgtacncgtacgtacagtacgtacttggtaactactttaactcttaagttacaaattaaacgtactacgttcctccgtacttaccgtagtaccggtacggaacgggtacggtagaagggacgtaagtacgtaacgg

SEQ ID NO: 26028 - DNA, 692 bp, Homo sapiens
  misc_feature: GYAE6OF01BHGAF.25.36.D03.1.454.CMB.1.raw
  modified_base (214)..(214): a, c, t, g, unknown or other
  misc_feature (214)..(214): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtcgtccgtccggggacccccgggnaggtacgggtcctccatctcgtttgttcgtgggacgcacgtccgtaccggacggttaacggaaaatttaacggttttcgtctacgtcgggtaccaggccaacgtcctaccccgaaacggaaaccccggtcccccaagtccctccctactactacgtaagtaacggtaatgactcgacgtccgccctggaacggtactaccgtacgtacctactttcgtccgtggtccttacggtacgtcgtcggtcctacccggtccgtccctccgtgcctactcggtacggtcgggtccgtccgggacgnggtagtggngtactagtagttcgttacgtggtcgtacgttagggttcggattcgtacgtgtcgtacggtcgggtccgggttcggtaccgggttggggtaccgggaggggaacgggtacgtaccgggtacgtacccgtaccgggtacgttacccgggacgtacccggcccggtaccgg

SEQ ID NO: 26029 - DNA, 386 bp, Homo sapiens
  misc_feature: GYAE6OF01DR61T.25.36.D03.1.454.CMB.1.raw
  modified_base (235)..(235): a, c, t, g, unknown or other
  misc_feature (235)..(235): n is a, c, g, or t
  modified_base (274)..(274): a, c, t, g, unknown or other
  misc_feature (274)..(274): n is a, c, g, or t
  modified_base (372)..(386): a, c, t, g, unknown or other
  misc_feature (372)..(386): n is a, c, g, or t
tcagactgtacagtcacgaccggtgctcgatttagctgcgtcacgatctctcttgggatagaattattcagcaggcacaacaacagaggcagttccagaattcactctcaccatcagcagcctgcacgtcctgtatagtattttcgactaaactttattacacacctaataataattaataacgtttactaccgtacttcgtttaggaccggtaacggggtaaccgaggtagganaactaacaaaacggtactggttcggctacacctaaccgnttcgtcttctacgtaccttccgttccccgactaggtccgtagtaacgtcgaactgtccgtaggacggtgggtccgtaggacgacggcctgaatgcaannnnnnnnnnnnnnn

SEQ ID NO: 26030 - DNA, 766 bp, Homo sapiens
  misc_feature: GYAE6OF01EXD6D.25.36.D03.1.454.CMB.1.raw
tcagactgtacagtcacgaccggtgctcgatttagctgcgtcacgatctctcttggggagctctgggagaggagcccagcactagaagtcggcggtgttccattcggtgatcagcactgaacacagaggactcaccatggagttgggctgagctgggttttcctcgttgcttcttttaaggaggtgtccactgtcaggtgcaccgtggtggagtcgtgggggaggcgtggtccagccgtgggacggtccctgagacctctcctgtagagtctcgtggtatccaccatcaatcgtacttactttagcggtccgtggactcccggacgacggcctaccggaagggggaaggggtcgtagggtggtacggtattttcgaattttagacgtaagttaaggtacggggtaaggttaagtgggtacttaattttaaacgtactacccgtagtacccgttcggtacccgggacggggtccctaccgttacctacccgtacgttccgtaaccggaacgggtaaccgaaccggtaccccaaacgtaaccttctaacccgtttcctttacgttgaccgtaacggtaacggtaaacccgggtaccgtacccgggaacgaccccgggtaacggaaccggaacccggttaccgttaaccgtaccgtttacgggttaccggtagggttaccgggtaaggggtttaccgggggttttagggggtttaactttaacgggtaggttacggtttaccggaccggtttacggggtttaaacccgg

SEQ ID NO: 26031 - DNA, 873 bp, Homo sapiens
  misc_feature: GYAE6OF01DB261.25.36.D03.1.454.CMB.1.raw
  modified_base (179)..(179): a, c, t, g, unknown or other
  misc_feature (179)..(179): n is a, c, g, or t
  modified_base (205)..(205): a, c, t, g, unknown or other
  misc_feature (205)..(205): n is a, c, g, or t
  modified_base (544)..(544): a, c, t, g, unknown or other
  misc_feature (544)..(544): n is a, c, g, or t
tcagactgtacagtcacgaccggtgctcgatttagctgcgtcacgatctctcttggggagagaagacaggattcaggacaatctccagcatggcccggcctccctctcctcctccacctcctcactcactgtgcagggtcctgggcccagtctgtcgactgacctcacgtccctacctntacgtgtccgtccggggacccccggngtaacgggcggttcctacctacttccgttcgtttcgtcggtagggacgtcgaccgtcgtacccggtacgtaacgggttaattacgtttcggccttacggtacgtaccaggcctacgccctaacccgtaaacggaaacccggtcccccaagtcctacccgtacttacgttaaccgtaaggtaacggaagttcgaccgtaccggtaccggcccggtacccgttacgggaaacggtacccttaacccggtgggaacccttacgttcctacggttaccgtaaccgggtacgtaccgtttcgtacgggttaccccttcccggtacccggtcccggttttaccgnggaacccctttaggttacccggcgggggtttacccggtcccgggttaccgggtttacccgggaaggttacggggtaccggtaacgggtaccttaaaaggttaacttaaccgttttcggtacgttacgtaccgtttagggttacggtacgtcctaccggtggttaccggtaggtacgggtttccgggtaccggtcgggtttaccgggacgggtaccgggtaccggttaacgaccgtccgggtacgtaccccggttaggtaaccggtcttaacccgggcgttaaccgggttcccttaacccgggtccccgtacgtccgttacccggtcccg

SEQ ID NO: 26032 - DNA, 459 bp, Homo sapiens
  misc_feature: GYAE6OF01BNXOD.25.36.D03.1.454.CMB.1.raw
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (415)..(459): a, c, t, g, unknown or other
  misc_feature (415)..(459): n is a, c, g, or t
tcagactgtacagtcacgaccggtgctcgatttagctgcgtcacgatctctcttgggatagaagttattcagcaggcacacaacagaggcagtccagattcactcctcaccatcagcacgcctgcacgccctgatgtattttgactaaacgttacttactcgaccaaactaataactaaattaatttacttaccgacctacgttttcgggaccgaaggggaaccctaagggtcggaacgactaaccgaaaaccgtaacgttgtcgggccttagccctaaactcttctcgttccttacactttcccccgttcccgtcctaacttcccggtaacttaaacgttcggtaacttacggccggtttaggacgggacggggtccgtacggaccggaacgggtcaccttaagcgngctangnnnnnnnnnnnnnnnnnnnnnnnnnnnnnnnnnnnnnnnnnnnnn

SEQ ID NO: 26033 - DNA, 478 bp, Homo sapiens
  misc_feature: GYAE6OF01BKCXN.25.36.D03.1.454.CMB.1.raw
  modified_base (160)..(160): a, c, t, g, unknown or other
  misc_feature (160)..(160): n is a, c, g, or t
  modified_base (404)..(405): a, c, t, g, unknown or other
  misc_feature (404)..(405): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (414)..(416): a, c, t, g, unknown or other
  misc_feature (414)..(416): n is a, c, g, or t
  modified_base (419)..(422): a, c, t, g, unknown or other
  misc_feature (419)..(422): n is a, c, g, or t
  modified_base (424)..(430): a, c, t, g, unknown or other
  misc_feature (424)..(430): n is a, c, g, or t
  modified_base (432)..(475): a, c, t, g, unknown or other
  misc_feature (432)..(475): n is a, c, g, or t
  modified_base (477)..(478): a, c, t, g, unknown or other
  misc_feature (477)..(478): n is a, c, g, or t
tcagactgtacagtcacgaccggtgctcgattttagctgcgtcacgatctctcttgggatagaagttattcagcaggcacacaacagaggcagttccagaattcactctcaccatcacgcagcctgcacgtcctgatgtattttcgctaactttattacnctaccaaactaaattaattaaattaatttattaccgtaccttacgtttttcgggacccggaacggggtaaccgaaagggtggacgtaacgttaacgaaaaccggtaagttggtacggctacgacctaacctattcttcgttcttcctaccttccctcccgactacgtaccgtaacgtacgttacgtacgtacgtcgtcggaccggtccggggtacgcgggaacgtacggacgtacgtagtcgcnncngcatngnnnacnnnncnnnnnnncnnnnnnnnnnnnnnnnnnnnnnnnnnnnnnnnnnnnnnnnnnnnann

SEQ ID NO: 26034 - DNA, 1014 bp, Homo sapiens
  misc_feature: GYAE6OF01CKDAH.25.36.D03.1.454.CMB.1.raw
  modified_base (172)..(172): a, c, t, g, unknown or other
  misc_feature (172)..(172): n is a, c, g, or t
  modified_base (402)..(402): a, c, t, g, unknown or other
  misc_feature (402)..(402): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctcgcccaggtccaaatctcagactgtggtgactcagggacnccctcacgtgactgtcgaccccgagggacgggacacgtcctaaccgtcctaccacgtgtcgtaccttccgagccggcgttcgggtacctacggtccaacgtaggtacgaaccgaacctaacttaacccgtaaaaccgttggtacccaacggacgtaaaccggtaaaaccggtcgaaaccccaaccccgtaaccggacgggaccttaccgtagttaacgtttgacggtaanaaccgtaaaaacctaaaaaccgtcctcggtacccggtaccccttcgggtcccgtacgtccgtaacgtcccgttacccggtcggttacgggggacctaaccggtccgttaccgtcccgtacgaccgtacgtaccggtacgtaagtacgttcggtactaaccggaaccgtcggttaacggggaacgggttaaccggacgggtttacccgtaaccggtaacccgttaaaccccgtacccggttaccggttacccccgttacgggtttccccttaccccgggtttaaccggttttccggggtccggggggttaacggggttttcggggtttccggggttttttccgggggggtaccccgggtttaaacgggggcccggggtaaaaaccgggttaacccccggttaaaaccgggtcccgggggtttaccccgggtttaaaccccgggggttccccgggttaaaaccgggaccccccgggtaaacccggggtttaacccggggttacccccccggtttcccccggggtttaaccccccgggttacccccgggggttacccttttaacccccgggttttcccccccggggtttaacccccggtttttcccccccccggg

SEQ ID NO: 26035 - DNA, 915 bp, Homo sapiens
  misc_feature: GYAE6OF01B8FG7.25.36.D03.1.454.CMB.1.raw
  modified_base (131)..(131): a, c, t, g, unknown or other
  misc_feature (131)..(131): n is a, c, g, or t
  modified_base (205)..(205): a, c, t, g, unknown or other
  misc_feature (205)..(205): n is a, c, g, or t
  modified_base (255)..(255): a, c, t, g, unknown or other
  misc_feature (255)..(255): n is a, c, g, or t
tcagactgtacagtcacgaccggtgctcgatttagctgcgtcacgatctctcttggggagagaagacaggattcaggacaatctccagcatggccggcctcctctcctcctcaccctcctcactcactgtncgaggtccgtggcccagtctgtgctgactcacgccctacctcgagttcgtaccggtacccggggacccccgggntaaggtacgggttcctcctaatccgtttcgtttcggtttcggagggtacnccgtaacggtccgtaccggtaccggtaacggtaaagtttacggtttctaccgttaccgtacggtaccgcgtaccgtaacgcccgttacccgaaacggaaccccgggtaccccaacggttccccttaccgtacgtaaccgttacgtaacggtaacggttaagtaccgtaacggttaccggtaaccggtccccggtacccgtaaccgggaccgggttaaacctttaccccgggttaaccggtaacccgtttaccggtttaccgtacccggttcggttaaccggttacggtaaccggtttcgggtaacccggttccccgtttcccgtacccgggttcccctaccccgggttacggtaacccgttcgttacccgggaccggggtttaccgggtaccccgtaccgggggtttacgggaacgttacccgggtagggtaaccgggttaccttaaagggttaaccgtttagttaaccggttcgtacgttcggtaaggttcggtacgtcgtacgtcgttaacggtcgtacggggttaccgttacggtcgggttccggtacgggtcggaacggtaccgtaggcccgttaacggtcccgttggaacgtcccggccgtaaaccgttcgggtaccctccccgggttcccgtaacggtccgtccgttaccccgg

SEQ ID NO: 26036 - DNA, 402 bp, Homo sapiens
  misc_feature: GYAE6OF01DVAUE.25.36.D03.1.454.CMB.1.raw
  modified_base (383)..(402): a, c, t, g, unknown or other
  misc_feature (383)..(402): n is a, c, g, or t
tcagactgtacagtcacgaccggtgctcgatttagctgcgtcacgatctctcttgggatagaagttattcagcaggcacacaacagaggcagttcagaattcactctcacatcagcagcctgcagcctgatgtattttgactaacttattactcgaccaaactaaattaattaaattaaatttattaccgtaccttacgtttttcgggaccgaagggggaaccgaagggtaggaagaactaaccgaaaacgtaacgtggtcggtactcgaccacctactcgttcgttccttactaccgttcccttccccgacctacttccgtagtaaccgttagtacgtacgtcgtaggacggcgggtcgtacggacgaacggcgactagagnnnnnnnnnnnnnnnnnnnn

SEQ ID NO: 26037 - DNA, 333 bp, Homo sapiens
  misc_feature: GYAE6OF01BQXEB.25.36.D03.1.454.CMB.1.raw
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
  modified_base (307)..(308): a, c, t, g, unknown or other
  misc_feature (307)..(308): n is a, c, g, or t
  modified_base (311)..(333): a, c, t, g, unknown or other
  misc_feature (311)..(333): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgctaacttattactgccaacaatataaataattacttcgacctacttttggcctaaggggaccaaggtgagatacaaacgactggtgctcgcaccatctgtcttcactccgttcccgctatctacgtactgtaccagtcnggacgcgggtctggcaaggcncatagnngtnnnnnnnnnnnnnnnnnnnnnnn

SEQ ID NO: 26038 - DNA, 763 bp, Homo sapiens
  misc_feature: GYAE6OF01EZTJY.25.36.D03.1.454.CMB.1.raw
  modified_base (166)..(166): a, c, t, g, unknown or other
  misc_feature (166)..(166): n is a, c, g, or t
  modified_base (173)..(173): a, c, t, g, unknown or other
  misc_feature (173)..(173): n is a, c, g, or t
tcagactgtacagtcacgaccggtgctcgatttagctgcgtcacgatctctcttggggtctggcgccaggggtcccttccaatatcagcaccatggcctggactcctctctttctgttcctctcacttgctgcccagggtccaaatctacagactggtggtgactnagggacnccctcactgacgtggtcgtccccgaggacgggactaggtccaccgtcctcgaccttggtctccttccgacggccgtcgtcgggtaccagtcgaccgtagtcgaacgaccacgtacctaaacgtcgttaccacgacgtaacgaacgtcggaaccaaccgaccgaggtacacgttagtactttagcggtaacgtaacctaaaacctaaaaactccttacgtaccgtaccccgtcgtacccgttcgacgtaccgtacctcccggtacgggtaggggtaacccagggtcctccgacccgtacgtacccgtactacggtaccgtaagggtacttcggtacgaccgtacggtaccgtaagggtacggaacggtacggacgtacccggtacctaccgtacctcgccgttccgtccgtccgttaccgttcggttacggtacgggttcttgggggggggtttacttacggggtcgggaccgggtacgggtaaccgtacggtcccggtaccgtcggtaccggtaccgtaacccggtcggtacccggtcccggacccgttcccccggttacgtccgtacccgttccggtcccctacccccg

SEQ ID NO: 26039 - DNA, 761 bp, Homo sapiens
  misc_feature: GYAE6OF01B3DPB.25.36.D03.1.454.CMB.1.raw
  modified_base (662)..(662): a, c, t, g, unknown or other
  misc_feature (662)..(662): n is a, c, g, or t
tcagactgtacagtcacgaccggtgctcgatttagctgcgtcacgatctctcttggggagctctgggagaggagcccccagccctgagacttcccgaggttgtttccattcagtgatcagcactgaacacagaggactcaccagtggagttggactgagtctggttacttttcgtttggactttaaagttttaaaggtcgttccgtaggtgtaggtaagttgacgtaacgtgggtaggtacggttcggtggggggacggtcgtttagggaaccgcggtcccgtggaccgaccgggtcccccgtggtaacggcccttccttcccgtggttcgtaccgtccgttagtggttactttcgtagtttggtttgattgaagtttcgccgataggtccgacgttccggtcgggtacccggtacgggtaacgggggttaccggggtacggtcggttagggtacggttcgggtccttcgttacgttaggtcggtaagggttgggtaaggtacgggtaacaaacgtaacccttaagtacgtacgactagtacgttggtaacgggtaacggtacgggtcccttaactacccgaccctacgtaccgaacgaacgtaacaacgtaactaaccgaacttccctacgttgtactaggacgtacgtaaagcggtaacnccgttagacaccgtagtcgtagtaccggtacccttggtttattcgttagttacgtaggtttacggaacggttaaccgggttggttcggtgggtaaacgg

SEQ ID NO: 26040 - DNA, 318 bp, Homo sapiens
  misc_feature: GYAE6OF01AEAA5.25.36.D03.1.454.CMB.1.raw
  modified_base (302)..(302): a, c, t, g, unknown or other
  misc_feature (302)..(302): n is a, c, g, or t
  modified_base (306)..(309): a, c, t, g, unknown or other
  misc_feature (306)..(309): n is a, c, g, or t
  modified_base (311)..(318): a, c, t, g, unknown or other
  misc_feature (311)..(318): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgactaactttattactgaccaacaataataataattattcgacctactttcggccgagggaccgaaggtggagatacgaaacgactgtggctcgctacatctgtcttcattcctcccgcactctagaactgtacagtctggagcgggctggacaggcgacgntagnnnngnnnnnnnn

SEQ ID NO: 26041 - DNA, 303 bp, Homo sapiens
  misc_feature: GYAE6OF02G2Z66.25.36.D03.1.454.CMB.1.raw
  modified_base (291)..(303): a, c, t, g, unknown or other
  misc_feature (291)..(303): n is a, c, g, or t
tcagactgtacagtcacgaccggtgctcgatttagctgcgtcacgagtctctcttgggatagaagttattcagcaggcacacaacagaggcagttccagaattcactctcaccatcagcagcctgcagcctgatgattttgcaacttattactgccaataatataataattattcgaccacttttggccaggggaccaaggtggagatcaaacgaactgtggctgcaccatctgtcttcatcttcccgcatctgaactgtacagtctgagcgggctggcaaggcgcatagnnnnnnnnnnnnn

SEQ ID NO: 26042 - DNA, 294 bp, Homo sapiens
  misc_feature: GYAE6OF02HWJ10.25.36.D03.1.454.CMB.1.raw
  modified_base (281)..(294): a, c, t, g, unknown or other
  misc_feature (281)..(294): n is a, c, g, or t
tcagactgtacagtcacgaccggtgctcgatttagctgcgtcacgatctctcttggatagaagttattcgagcaggcacacaacagaggcagttccagaattcactctcaccatcagcagcctgcagcctgatgatttgcaacttattactgccaacaatataataatattcgacactttggccagggaccaaggtgagatcaaacgactgtggctgcaccatctgtcttcatcttccgcatctgaactgtacagtctgagcggctggcaaggcgcatagnnnnnnnnnnnnnn

SEQ ID NO: 26043 - DNA, 297 bp, Homo sapiens
  misc_feature: GYAE6OF02IBEQT.25.36.D03.1.454.CMB.1.raw
  modified_base (291)..(297): a, c, t, g, unknown or other
  misc_feature (291)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttccgccatctgaactgtacagtctgagcgggctgggcaaggcgcatagnnnnnnn

SEQ ID NO: 26044 - DNA, 305 bp, Homo sapiens
  misc_feature: GYAE6OF02IR68I.25.36.D03.1.454.CMB.1.raw
  modified_base (292)..(305): a, c, t, g, unknown or other
  misc_feature (292)..(305): n is a, c, g, or t
tcagactgtacagtcacgaccggtgctcgatttagctgcgtcacgatcgtctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtaccagtctgagcgggctggcaaggcgcatagnnnnnnnnnnnnnn

SEQ ID NO: 26045 - DNA, 288 bp, Homo sapiens
  misc_feature: GYAE6OF02FZ46O.25.36.D03.1.454.CMB.1.raw
  modified_base (286)..(288): a, c, t, g, unknown or other
  misc_feature (286)..(288): n is a, c, g, or t
tcagactgtacagtcacgaccggtgctcgattagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccagggaccaaggtgagatcaaacgaactgtggctgcaccatctgtcttcatcttcccgcatctgaactgtacagtctgagcgggctggcaaggcgcatagnnn

SEQ ID NO: 26046 - DNA, 299 bp, Homo sapiens
  misc_feature: GYAE6OF02FNVQQ.25.36.D03.1.454.CMB.1.raw
  modified_base (286)..(299): a, c, t, g, unknown or other
  misc_feature (286)..(299): n is a, c, g, or t
tcagactgtacagtcacgaccggtgctcgatttagctgcgtcacgatctctcttggatagaagttattcagcaggcacacaacagaggcagtccagaattcactctcaccatcagcagcctgcagcctgatgattttgcaacttattactgccaacaatataataattattcgaccactttggccaggggaccaaggtggagatcaaacgactgtggctgcaccatctgtcttcatcttcccgcatctgaactgtacagtctgagcgggctggcaaggcgcatagnnnnnnnnnnnnnn

SEQ ID NO: 26047 - DNA, 294 bp, Homo sapiens
  misc_feature: GYAE6OF02GVV3B.25.36.D03.1.454.CMB.1.raw
  modified_base (291)..(294): a, c, t, g, unknown or other
  misc_feature (291)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaaactgtacagtctgagcgggctggcaaggcgcatagnnnn

SEQ ID NO: 26048 - DNA, 294 bp, Homo sapiens
  misc_feature: GYAE6OF02IRBHD.25.36.D03.1.454.CMB.1.raw
  modified_base (291)..(294): a, c, t, g, unknown or other
  misc_feature (291)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctgggcaaggcgcatagnnnn

SEQ ID NO: 26049 - DNA, 295 bp, Homo sapiens
  misc_feature: GYAE6OF02HJXHG.25.36.D03.1.454.CMB.1.raw
  modified_base (292)..(295): a, c, t, g, unknown or other
  misc_feature (292)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctgggcaaggcgcatagnnnn

SEQ ID NO: 26050 - DNA, 294 bp, Homo sapiens
  misc_feature: GYAE6OF02HUZOB.25.36.D03.1.454.CMB.1.raw
  modified_base (289)..(294): a, c, t, g, unknown or other
  misc_feature (289)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccagggaccaaggtggagatcaaacgaactgtggctgcaccatctgtcttcatcttccgccatctgaactgtacagtctgagcgggctggcaaggcgcatagnnnnnn

SEQ ID NO: 26051 - DNA, 291 bp, Homo sapiens
  misc_feature: GYAE6OF02HTFTE.25.36.D03.1.454.CMB.1.raw
  modified_base (289)..(291): a, c, t, g, unknown or other
  misc_feature (289)..(291): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccagggaccaaggtggagatcaaacgaactgtggctgcaccatctgtcttcatcttcccgcatctgaactgtacagtctgagcgggctggcaaggcgcatagnnn

SEQ ID NO: 26052 - DNA, 294 bp, Homo sapiens
  misc_feature: GYAE6OF02I2CUH.25.36.D03.1.454.CMB.1.raw
  modified_base (291)..(294): a, c, t, g, unknown or other
  misc_feature (291)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcaggctgaagatgtggcagtttattactgtcagcaatattatagtactcctccgacgttcggccaggggaccaaggtggaaatcaaacgaactgtggctgcaccatctgtcttcatcttcccgccatctgaactgtacagtctgagcgggctggcaaggcgcatagnnnn

SEQ ID NO: 26053 - DNA, 294 bp, Homo sapiens
  misc_feature: GYAE6OF02JGVWK.25.36.D03.1.454.CMB.1.raw
  modified_base (289)..(294): a, c, t, g, unknown or other
  misc_feature (289)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgactgtggctgcaccatctgtcttcatcttcccgcatctgaactgtacagtctgagcgggctggcaaggcgcatagnnnnnn

SEQ ID NO: 26054 - DNA, 316 bp, Homo sapiens
  misc_feature: GYAE6OF02IO3L5.25.36.D03.1.454.CMB.1.raw
  modified_base (293)..(316): a, c, t, g, unknown or other
  misc_feature (293)..(316): n is a, c, g, or t
tcagactgtacagtcacgaccggtgctcgatttagctgcgtcacgatctctcttgggtatagaagttattcagcaggcacacaacagaggcagttccagaattcacgtctcaccatcaggcagcctgcagcctgatgattttgcaacttattactgccaacaatataataattattcgaccacttttggccaggggaccaaggtggagatcaaacgaactgtggctgcaccatctgtcttcatcttccgcaatctgaactgtacagctgagcgggctggcaaggcgcatacgnnnnnnnnnnnnnnnnnnnnnnnn

SEQ ID NO: 26055 - DNA, 289 bp, Homo sapiens
  misc_feature: GYAE6OF02I227K.25.36.D03.1.454.CMB.1.raw
  modified_base (286)..(289): a, c, t, g, unknown or other
  misc_feature (286)..(289): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccagggaccaaggtgagatcaaacgaactgtgctgcaccatctgtcttcatcttcccgcatctgaactgtacagtctgagcgggctggcaaggcgcatagnnnn

SEQ ID NO: 26056 - DNA, 293 bp, Homo sapiens
  misc_feature: GYAE6OF02JADKQ.25.36.D03.1.454.CMB.1.raw
  modified_base (289)..(293): a, c, t, g, unknown or other
  misc_feature (289)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtgagatcaaacgactgtggctgcaccatctgtcttcatcttcccgccatctgaactgtacagtctgagcgggctggcaaggcgcatagnnnnn

SEQ ID NO: 26057 - DNA, 296 bp, Homo sapiens; identical to SEQ ID NO: 25665
  misc_feature: GYAE6OF02FP0DX.25.36.D03.1.454.CMB.1.raw
  modified_base (291)..(296): a, c, t, g, unknown or other
  misc_feature (291)..(296): n is a, c, g, or t

SEQ ID NO: 26058 - DNA, 295 bp, Homo sapiens; identical to SEQ ID NO: 25691
  misc_feature: GYAE6OF02HK9AS.25.36.D03.1.454.CMB.1.raw
  modified_base (291)..(295): a, c, t, g, unknown or other
  misc_feature (291)..(295): n is a, c, g, or t

SEQ ID NO: 26059 - DNA, 298 bp, Homo sapiens
  misc_feature: GYAE6OF02F5HOX.25.36.D03.1.454.CMB.1.raw
  modified_base (289)..(298): a, c, t, g, unknown or other
  misc_feature (289)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatctcccgcatctgaactgtacagtctgagcgggctggcaaggcgcatagnnnnnnnnnn

SEQ ID NO: 26060 - DNA, 295 bp, Homo sapiens; identical to SEQ ID NO: 25691
  misc_feature: GYAE6OF02HDPR0.25.36.D03.1.454.CMB.1.raw
  modified_base (291)..(295): a, c, t, g, unknown or other
  misc_feature (291)..(295): n is a, c, g, or t

SEQ ID NO: 26061 - DNA, 313 bp, Homo sapiens
  misc_feature: GYAE6OF02JEFJ3.25.36.D03.1.454.CMB.1.raw
  modified_base (185)..(185): a, c, t, g, unknown or other
  misc_feature (185)..(185): n is a, c, g, or t
  modified_base (214)..(214): a, c, t, g, unknown or other
  misc_feature (214)..(214): n is a, c, g, or t
  modified_base (306)..(313): a, c, t, g, unknown or other
  misc_feature (306)..(313): n is a, c, g, or t
tcagactgtacagtcacgaccggtgctcgattagctgcgtcacgatctctcttgggatagaagttattcagcaggcacacaacagaggcagttccagaattcactctcaccatcagcagcctgcagcctgatgatttgcaactattactgcacatatatattatgcacttgcaggaccgagtagngatcaaacgaactagtggctgcaccactntgtctttcactcttcccgcccgtactacttgtaactaggttacacgtacgtcgatccgggggcgtcggtccaaaggaccggtcgactagagnnnnnnnn

SEQ ID NO: 26062 - DNA, 295 bp, Homo sapiens; identical to SEQ ID NO: 25656
  misc_feature: GYAE6OF02F6BRV.25.36.D03.1.454.CMB.1.raw
  modified_base (290)..(295): a, c, t, g, unknown or other
  misc_feature (290)..(295): n is a, c, g, or t

SEQ ID NO: 26063 - DNA, 294 bp, Homo sapiens
  misc_feature: GYAE6OF02IGRFL.25.36.D03.1.454.CMB.1.raw
  modified_base (289)..(294): a, c, t, g, unknown or other
  misc_feature (289)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacacttttggccagggaccaaggtggagatcaaacgaactgtggctgcaccatctgtcttcatcttcccgccatctgaactgtacagtctgagcgggctggcaaggcgcatagnnnnnn

SEQ ID NO: 26064 - DNA, 293 bp, Homo sapiens
  misc_feature: GYAE6OF02H70PA.25.36.D03.1.454.CMB.1.raw
  modified_base (290)..(293): a, c, t, g, unknown or other
  misc_feature (290)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttccgccatctgaactgtacagtctgagcgggctggcaaggcgcatagnnnn

SEQ ID NO: 26065 - DNA, 224 bp, Homo sapiens
  misc_feature: GYAE6OF02G1RKP.25.36.D03.1.454.CMB.1.raw
  modified_base (221)..(224): a, c, t, g, unknown or other
  misc_feature (221)..(224): n is a, c, g, or t
tcagactgtacagtcacgaccggtgctcgatttagctgcgtcacgatctctcttggggccagggttccctggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnnnn

SEQ ID NO: 26066 - DNA, 296 bp, Homo sapiens
  misc_feature: GYAE6OF02HS4S2.25.36.D03.1.454.CMB.1.raw
  modified_base (290)..(296): a, c, t, g, unknown or other
  misc_feature (290)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttccgccatctgaactgtacagtctgagcgggctggcaaggcgcatagnnnnnnn

SEQ ID NO: 26067 - DNA, 312 bp, Homo sapiens
  misc_feature: GYAE6OF02HHGI8.25.36.D03.1.454.CMB.1.raw
  modified_base (291)..(312): a, c, t, g, unknown or other
  misc_feature (291)..(312): n is a, c, g, or t
tcagactgtacagtcacgaccggtgctcgatttagctgcgtcacgagtcgtctcttggatagaagttattcagcaggcacacaacagaggcagttccagaattcactctcaccatcagcagcctgcagcctgatggattttgcaacttattactgccaacaatataataattattcgaccacttttggccaggggaccaaggtggagatcaaacgaactgtggctgcaccatctgtcttcatcttccgccatctgaactgtacagtctgagcggctggcaaggcgcatagnnnnnnnnnnnnnnnnnnnnnn

SEQ ID NO: 26068 - DNA, 295 bp, Homo sapiens; identical to SEQ ID NO: 25691
  misc_feature: GYAE6OF02H9CO5.25.36.D03.1.454.CMB.1.raw
  modified_base (291)..(295): a, c, t, g, unknown or other
  misc_feature (291)..(295): n is a, c, g, or t

SEQ ID NO: 26069 - DNA, 293 bp, Homo sapiens
  misc_feature: GYAE6OF02I192H.25.36.D03.1.454.CMB.1.raw
  modified_base (289)..(293): a, c, t, g, unknown or other
  misc_feature (289)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgatttgcaacttattactgccaacaatataataattattcgaccactttggccaggggaccaaggtggagatcaaacgaactgtggctgcaccatctgtcttcatcttcccgccatctgaactgtacagtctgagcgggctggcaaggcgcatagnnnnn

SEQ ID NO: 26070 - DNA, 289 bp, Homo sapiens
  misc_feature: GYAE6OF02H4XSC.25.36.D03.1.454.CMB.1.raw
  modified_base (279)..(279): a, c, t, g, unknown or other
  misc_feature (279)..(279): n is a, c, g, or t
  modified_base (285)..(289): a, c, t, g, unknown or other
  misc_feature (285)..(289): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgatttgcaacttattactgccaacaatataataattattcgaccacttttggccagggaccaaggtgagatcaaacgaactgtgctgcaccatctgtcttcatcttccgccatctgaactgtacagtctgagcggctggcaaggcncatagnnnnn

SEQ ID NO: 26071 - DNA, 350 bp, Homo sapiens
  misc_feature: GYAE6OF02GVAOU.25.36.D03.1.454.CMB.1.raw
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (300)..(301): a, c, t, g, unknown or other
  misc_feature (300)..(301): n is a, c, g, or t
  modified_base (303)..(350): a, c, t, g, unknown or other
  misc_feature (303)..(350): n is a, c, g, or t
tcagactgtacagtcacgaccggtgctcgatttagctgcgtcacgatctcgtcttgggatagaagttattcagcaggcacacaacagaggcagttccagaattcactctcaccatcaggcagcctgcagcctgatgattttgcaacttattactgccaacaatataataattattcgaccacttttggccaggggaccaaggtggagatctaaacgaactgtggctgacaccatctgtcttcatcttcccgcatctgaactgtacagtctgancgggctggcgaaggcgcacgtagngcnncnnnnnnnnnnnnnnnnnnnnnnnnnnnnnnnnnnnnnnnnnnnnnnnn

SEQ ID NO: 26072 - DNA, 344 bp, Homo sapiens
  misc_feature: GYAE6OF02F949V.25.36.D03.1.454.CMB.1.raw
  modified_base (312)..(344): a, c, t, g, unknown or other
  misc_feature (312)..(344): n is a, c, g, or t
tcagactgtacagtcacgaccggtgctcgatttagctgcgtcacggaagtcctctcttgggatagaagttattccagccaggcacacaacagaggcaagttccagaattcactctccaccatcagcagccctcgcagccgtgatcgattttgcaacttattactggccaacgaactataataattattacgacctacttttggccaggggaccaacggtggacgatcaaacgaactgtggctgcaccatctgtcttcatccttcccgccatctgaacctgtacagtctgagcgggctggcaaggcgcatagnnnnnnnnnnnnnnnnnnnnnnnnnnnnnnnnn

SEQ ID NO: 26073 - DNA, 292 bp, Homo sapiens; identical to SEQ ID NO: 25650
  misc_feature: GYAE6OF02G0HF0.25.36.D03.1.454.CMB.1.raw
  modified_base (291)..(292): a, c, t, g, unknown or other
  misc_feature (291)..(292): n is a, c, g, or t

SEQ ID NO: 26074 - DNA, 293 bp, Homo sapiens
  misc_feature: GYAE6OF02I6X34.25.36.D03.1.454.CMB.1.raw
  modified_base (289)..(293): a, c, t, g, unknown or other
  misc_feature (289)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgatttgcaacttattactgccaacaatataataattattcgaccacttttggccagggaccaaggtggagatcaaacgaactgtggctgcaccatctgtcttcatcttcccgccatctgaactgtacagtctgagcgggctggcaaggcgcatagnnnnn

SEQ ID NO: 26075 - DNA, 295 bp, Homo sapiens
  misc_feature: GYAE6OF02JT9E6.25.36.D03.1.454.CMB.1.raw
  modified_base (289)..(295): a, c, t, g, unknown or other
  misc_feature (289)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttcccgcatctgaactgtacagtctgagcgggctggcaaggcgcatagnnnnnnn

SEQ ID NO: 26076 - DNA, 316 bp, Homo sapiens
  misc_feature: GYAE6OF02H07LG.25.36.D03.1.454.CMB.1.raw
  modified_base (299)..(316): a, c, t, g, unknown or other
  misc_feature (299)..(316): n is a, c, g, or t
tcagactgtacagtcacgaccggtgctcgatttagctgcgtcacgagttcgtcgtcttgggatagaagttattcaggcaggcacacaacagaggcagttccagaattccactctcaccatcagcagcctgcagcctgatgattttgcaacttattactgcccaacaatataataattattcgacacttttggccagggaccaaggtgagatcaaacgaactgtggctgcaccatctgtacttcatccttcccgccatctgaactgtacagtctgacgcgggctggcaaggtcacatagnnnnnnnnnnnnnnnnnn

SEQ ID NO: 26077 - DNA, 295 bp, Homo sapiens
  misc_feature: GYAE6OF02JIRE2.25.36.D03.1.454.CMB.1.raw
  modified_base (279)..(279): a, c, t, g, unknown or other
  misc_feature (279)..(279): n is a, c, g, or t
  modified_base (285)..(295): a, c, t, g, unknown or other
  misc_feature (285)..(295): n is a, c, g, or t
tcagactgtacagtcacgaccggtgctcgatttagctgcgtcacgatctctcttggatagaagttattcagcaggcacacaacagaggcagttccagaattcactctcaccatcagcagcctgcagcctgatgattttgcaacttattactgccaacaatataataattattcgaccacttttggccagggaccaaggtggagatcaaacgaactgtggctgcaccatctgtcttcatctccgcatctgaactgtacagtctgagcggctggcaaggcncatagnnnnnnnnnnn

SEQ ID NO: 26078 - DNA, 296 bp, Homo sapiens; identical to SEQ ID NO: 25665
  misc_feature: GYAE6OF02GYJ14.25.36.D03.1.454.CMB.1.raw
  modified_base (291)..(296): a, c, t, g, unknown or other
  misc_feature (291)..(296): n is a, c, g, or t

SEQ ID NO: 26079 - DNA, 294 bp, Homo sapiens; identical to SEQ ID NO: 25651
  misc_feature: GYAE6OF02G3CMN.25.36.D03.1.454.CMB.1.raw
  modified_base (290)..(294): a, c, t, g, unknown or other
  misc_feature (290)..(294): n is a, c, g, or t

SEQ ID NO: 26080 - DNA, 295 bp, Homo sapiens; identical to SEQ ID NO: 25691
  misc_feature: GYAE6OF02INZKE.25.36.D03.1.454.CMB.1.raw
  modified_base (291)..(295): a, c, t, g, unknown or other
  misc_feature (291)..(295): n is a, c, g, or t

SEQ ID NO: 26081 - DNA, 294 bp, Homo sapiens; identical to SEQ ID NO: 25651
  misc_feature: GYAE6OF02GEPTG.25.36.D03.1.454.CMB.1.raw
  modified_base (290)..(294): a, c, t, g, unknown or other
  misc_feature (290)..(294): n is a, c, g, or t

SEQ ID NO: 26082 - DNA, 541 bp, Homo sapiens
  misc_feature: GYAE6OF02G76XP.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgtttacactcagggtcccatctcggttcagcggcagtgaatctgggacagagttcactctcactatcagcagcctgcagcctgaacgtatgttgctaaaccttatttaactagttactaaaagttattaaattaaccttacggtacccccttacgttaccctaaccgtttttccgggaccgggtaacggggtaaccccgaaaggggttacgggtaaggtattaaacccgg

SEQ ID NO: 26083 - DNA, 472 bp, Homo sapiens
  misc_feature: GYAE6OF02FYV56.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcagggtcccatctcggttcagcggcagtgaatctgggacagagttcactctcactatcagcagcctgcagcctgaagatgttgctaacttattactgtacaaagtataatactgccctctcactttcggcgtaggaccaaggtggagataacg

SEQ ID NO: 26084 - DNA, 295 bp, Homo sapiens; identical to SEQ ID NO: 25691
  misc_feature: GYAE6OF02GJJEU.25.36.D03.1.454.CMB.1.raw
  modified_base (291)..(295): a, c, t, g, unknown or other
  misc_feature (291)..(295): n is a, c, g, or t

SEQ ID NO: 26085 - DNA, 297 bp, Homo sapiens
  misc_feature: GYAE6OF02I61I0.25.36.D03.1.454.CMB.1.raw
  modified_base (291)..(297): a, c, t, g, unknown or other
  misc_feature (291)..(297): n is a, c, g, or t
tcagactgtacagtcacgaccggtgctcgatttagctgcgtcacgatctctcttgggatagaagttattcagcaggcacacaacagaggcagttccagaattcactctcaccatcggcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcgcatagnnnnnnn

SEQ ID NO: 26086 - DNA, 295 bp, Homo sapiens; identical to SEQ ID NO: 25691
  misc_feature: GYAE6OF02I2QGH.25.36.D03.1.454.CMB.1.raw
  modified_base (291)..(295): a, c, t, g, unknown or other
  misc_feature (291)..(295): n is a, c, g, or t

SEQ ID NO: 26087 - DNA, 293 bp, Homo sapiens; identical to SEQ ID NO: 25694
  misc_feature: GYAE6OF02GVP0L.25.36.D03.1.454.CMB.1.raw
  modified_base (290)..(293): a, c, t, g, unknown or other
  misc_feature (290)..(293): n is a, c, g, or t

SEQ ID NO: 26088 - DNA, 295 bp, Homo sapiens; identical to SEQ ID NO: 25656
  misc_feature: GYAE6OF02GGMGL.25.36.D03.1.454.CMB.1.raw
  modified_base (290)..(295): a, c, t, g, unknown or other
  misc_feature (290)..(295): n is a, c, g, or t

SEQ ID NO: 26089 - DNA, 293 bp, Homo sapiens
  misc_feature: GYAE6OF02JX7VJ.25.36.D03.1.454.CMB.1.raw
  modified_base (289)..(293): a, c, t, g, unknown or other
  misc_feature (289)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgactgtggctgcaccatctgtcttcatcttcccgcatctgaactgtacagtctgagcgggctggcaaggcgcatagnnnnn

SEQ ID NO: 26090 - DNA, 297 bp, Homo sapiens; identical to SEQ ID NO: 25702
  misc_feature: GYAE6OF02I7Z5R.25.36.D03.1.454.CMB.1.raw
  modified_base (291)..(297): a, c, t, g, unknown or other
  misc_feature (291)..(297): n is a, c, g, or t

SEQ ID NO: 26091 - DNA, 172 bp, Homo sapiens
  misc_feature: GYAE6OF02JIQ61.25.36.D03.1.454.CMB.1.raw
  modified_base (166)..(172): a, c, t, g, unknown or other
  misc_feature (166)..(172): n is a, c, g, or t
tcagactgtacagtcacgaccggtgctcgatttagctgcgtcacgatctctcttggtattcggcggaggaccaagctgaccgtcctaagtcagcccaaggctgcccctcggtcactctgttcccgcctctcactgtacagtctgagcggctggcaaggcgcatagnnnnnnn

SEQ ID NO: 26092 - DNA, 293 bp, Homo sapiens
  misc_feature: GYAE6OF02HD3I9.25.36.D03.1.454.CMB.1.raw
  modified_base (289)..(293): a, c, t, g, unknown or other
  misc_feature (289)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttcccgcatctgaactgtacagtctgagcgggctggcaaggcgcatagnnnnn

SEQ ID NO: 26093 - DNA, 198 bp, Homo sapiens
  misc_feature: GYAE6OF02GUT50.25.36.D03.1.454.CMB.1.raw
  modified_base (175)..(198): a, c, t, g, unknown or other
  misc_feature (175)..(198): n is a, c, g, or t
tcagactgtacagtcacgaccggtgctcgatttagctgcgtcacgagtctctcttgggtattcggcggagggaccaagctgaccgtcctaagtcagcccaaggctgccccctcggtcactctgttcccgccctcctcactgtacagtctgagcgggctgggtcaaggcgcatagnnnnnnnnnnnnnnnnnnnnnnnn

SEQ ID NO: 26094 - DNA, 293 bp, Homo sapiens; identical to SEQ ID NO: 26092
  misc_feature: GYAE6OF02FT10K.25.36.D03.1.454.CMB.1.raw
  modified_base (289)..(293): a, c, t, g, unknown or other
  misc_feature (289)..(293): n is a, c, g, or t

SEQ ID NO: 26095 - DNA, 296 bp, Homo sapiens; identical to SEQ ID NO: 26066
  misc_feature: GYAE6OF02H1E3S.25.36.D03.1.454.CMB.1.raw
  modified_base (290)..(296): a, c, t, g, unknown or other
  misc_feature (290)..(296): n is a, c, g, or t

SEQ ID NO: 26096 - DNA, 299 bp, Homo sapiens; identical to SEQ ID NO: 25729
  misc_feature: GYAE6OF02JPSB0.25.36.D03.1.454.CMB.1.raw
  modified_base (291)..(299): a, c, t, g, unknown or other
  misc_feature (291)..(299): n is a, c, g, or t

SEQ ID NO: 26097 - DNA, 294 bp, Homo sapiens; identical to SEQ ID NO: 25662
  misc_feature: GYAE6OF02G6SCX.25.36.D03.1.454.CMB.1.raw
  modified_base (291)..(294): a, c, t, g, unknown or other
  misc_feature (291)..(294): n is a, c, g, or t

SEQ ID NO: 26098 - DNA, 292 bp, Homo sapiens; identical to SEQ ID NO: 25650
  misc_feature: GYAE6OF02G9RZA.25.36.D03.1.454.CMB.1.raw
  modified_base (291)..(292): a, c, t, g, unknown or other
  misc_feature (291)..(292): n is a, c, g, or t

SEQ ID NO: 26099 - DNA, 489 bp, Homo sapiens
  misc_feature: GYAE6OF02F7H64.25.36.D03.1.454.CMB.1.raw
tcagactgtacagtcacgaccggtgctcgatttagctgcgtcacgatctctcttgggggcagaagtctctctcagtcaggacacaacatggacatgagggtccctgctcagctcctgggactcctgctgctctggctcccagataccagatgtgacgtccagatgacccagtctccatcctccctgtctgcatctgttggagacagaatcagcatcacttgccggcgagtcagggcattagcaattatttagcctggtatcaacagaaaccagggagagttcctaagctcctgatctatgctgcctccacgttacactcaggggtcccatctcggttcagcggcagtgaatctgggacagagttcactctcactatcagcagcctgcagcctgaagatgttgactaacttattactgtacaaagttataatactcgtccctctctacctttcggacggtacggaccgaaggtggagtacgtactaaacg

SEQ ID NO: 26100 - DNA, 371 bp, Homo sapiens
  misc_feature: GYAE6OF02H6Y29.25.36.D03.1.454.CMB.1.raw
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (305)..(306): a, c, t, g, unknown or other
  misc_feature (305)..(306): n is a, c, g, or t
  modified_base (308)..(308): a, c, t, g, unknown or other
  misc_feature (308)..(308): n is a, c, g, or t
  modified_base (310)..(371): a, c, t, g, unknown or other
  misc_feature (310)..(371): n is a, c, g, or t
tcagactgtacagtcacgaccggtgctcgatttagctgcgtcacgattcgtcctcttgggatagaagttattcagcagggccacacaacacgaggcagttccagaagttcactctcaccatcagcaggcctgcagcctgatgattttgcaacttattactgccaacaatactaataattattcgaccacttttggccaggggaccaaggtggagatcaaacgaactgtaggctgcacatctgtacttcatcttcccgccatcctgaactcgtacagtctganggctggcaaggcgcatagnangnngnannnnnnnnnnnnnnnnnnnnnnnnnnnnnnnnnnnnnnnnnnnnnnnnnnnnnnnnnnnnnn

SEQ ID NO: 26101 - DNA, 512 bp, Homo sapiens
  misc_feature: GYAE6OF02IPGBQ.25.36.D03.1.454.CMB.1.raw
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
  modified_base (491)..(491): a, c, t, g, unknown or other
  misc_feature (491)..(491): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagcctgggaggtccctgagactctcctgtgaagcctctggatttagtttcagtggttctggcatgcacgtggggtcccnccaggcctccgaggcgaagggggccggagtgggttggcagttanagcacatgatggaagttcagaatattatgcagctcgngaaggccgattcactatcncagagacaagttcccggaanttgtgtacttaggaatgtcagcctgagagtcgaggactcggctctgtattctgtgcgagngtcggggagttggtattacgg

SEQ ID NO: 26102 - DNA, 295 bp, Homo sapiens
  misc_feature: GYAE6OF02JGVO8.25.36.D03.1.454.CMB.1.raw
  modified_base (285)..(285): a, c, t, g, unknown or other
  misc_feature (285)..(285): n is a, c, g, or t
  modified_base (291)..(295): a, c, t, g, unknown or other
  misc_feature (291)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggtcaggggaccaaggtggagatcaaacgaactgtggctgcaccatctgtcttcatcttcccgccatctgaactgtacagtctgagcgggctggcaaggcncatagnnnnn

SEQ ID NO: 26103 - DNA, 298 bp, Homo sapiens
  misc_feature: GYAE6OF02I5WQ4.25.36.D03.1.454.CMB.1.raw
  modified_base (292)..(298): a, c, t, g, unknown or other
  misc_feature (292)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgatttgcaacttattactgccaacaatataataattattcgaccacttttggccaggggaccaaggtggagatcaaacgaactgtgtctgcaccatctgtcttcatcttcccgccatctgaactgtacagtctgagcgggctgggcaaggcgcagtagnnnnnnn

SEQ ID NO: 26104 - DNA, 296 bp, Homo sapiens; identical to SEQ ID NO: 25678
  misc_feature: GYAE6OF02IYADD.25.36.D03.1.454.CMB.1.raw
  modified_base (290)..(296): a, c, t, g, unknown or other
  misc_feature (290)..(296): n is a, c, g, or t

SEQ ID NO: 26105 - DNA, 324 bp, Homo sapiens
  misc_feature: GYAE6OF02F8EC1.25.36.D03.1.454.CMB.1.raw
  modified_base (301)..(324): a, c, t, g, unknown or other
  misc_feature (301)..(324): n is a, c, g, or t
tcagactgtacagtcacgaccggtgctcgatttagctgcgtcacgatctctcttggggatagaagttattcagcaggcacacaacagaggcagttccagaattcactctcaccatcagcagcctgcagcctgatgattttgcaacttatactgccaacaatactaataatttattcgaccgaactttggccaggggaccaaggtggagagtcaaacgactgtggctgcaccatctgtcttcactcttcccgaccatcctgaacctcgtacagtcctgagtcgggctggcaaggcgcatagnnnnnnnnnnnnnnnnnnnnnnnn

SEQ ID NO: 26106 - DNA, 325 bp, Homo sapiens
  misc_feature: GYAE6OF02GDDOG.25.36.D03.1.454.CMB.1.raw
  modified_base (213)..(213): a, c, t, g, unknown or other
  misc_feature (213)..(213): n is a, c, g, or t
  modified_base (302)..(325): a, c, t, g, unknown or other
  misc_feature (302)..(325): n is a, c, g, or t
tcagactgtacagtcacgaccggtgctcgatttagctgcgtcacgatctctcgttgggatagaagttattcagcaggcacacaacagaggcagttccaggaattcactctcaccatcagcagcctggcagccgtgagtgtattttgacaacttattactgccaacaatataataattattcgacctactttggccgaggggaccaaggtgganatacaaacgactgtggctgcaccatctgtcttcatccttcccgctatctgaactgtacagtctgacgcgggactggcaaggcgcatagnnnnnnnnnnnnnnnnnnnnnnnn

SEQ ID NO: 26107 - DNA, 298 bp, Homo sapiens
  misc_feature: GYAE6OF02JGYUK.25.36.D03.1.454.CMB.1.raw
  modified_base (292)..(294): a, c, t, g, unknown or other
  misc_feature (292)..(294): n is a, c, g, or t
  modified_base (296)..(298): a, c, t, g, unknown or other
  misc_feature (296)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgatttgctaacttattactgccaacaatataataattattcgaccacttttggccaggggaccaaggtggagatcaaacgaactgtggctgcaccatctgtcttcatcttcccgccatctgaactgtacagtctgagcgggctggcaaggcgcgatagnnntnnn

SEQ ID NO: 26108 - DNA, 292 bp, Homo sapiens; identical to SEQ ID NO: 25664
  misc_feature: GYAE6OF02GQPM2.25.36.D03.1.454.CMB.1.raw
  modified_base (288)..(292): a, c, t, g, unknown or other
  misc_feature (288)..(292): n is a, c, g, or t

SEQ ID NO: 26109 - DNA, 380 bp, Homo sapiens
  misc_feature: GYAE6OF02JK4F6.25.36.D03.1.454.CMB.1.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (353)..(380): a, c, t, g, unknown or other
  misc_feature (353)..(380): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgtctaacttattactcgaccaaacaaataataaattaaattaattacgtacctacttttacggtccgacgggaaccgaaggtaggagatacgaaacgaactagtggcgtcgcncaactanctgtcttctactacttcccncgtcccactacttcgtaacgtacgtacgtacgtacgtcggtagacgggcgtcggcgaacggacgcgatagagnnnnnnnnnnnnnnnnnnnnnnnnnnnn

SEQ ID NO: 26110 - DNA, 295 bp, Homo sapiens
  misc_feature: GYAE6OF02I2A2X.25.36.D03.1.454.CMB.1.raw
  modified_base (292)..(295): a, c, t, g, unknown or other
  misc_feature (292)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcgaccatctgtcttcatcttcccgccatctgaactgtacagtctgagcgggctggcaaggcgcatagnnnn

SEQ ID NO: 26111 - DNA, 526 bp, Homo sapiens
  misc_feature: GYAE6OF02GFS9P.25.36.D03.1.454.CMB.1.raw
  modified_base (216)..(216): a, c, t, g, unknown or other
  misc_feature (216)..(216): n is a, c, g, or t
tcagactgtacagtcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggctactttgaccttgtctcttggtaccaacaacacccggacaaaggctccaaactcataatttttgagaccagtaagcggccctctggggtttctagtcgattcactggctcaagtctggcaacacggcctccctaacaatcctctggtctccaggctgaggacgaggctgattattacgtgtctttctcactattgtcggctagtagctacgtttgggtgttcggcagagggaccaagtgaccggtcgtgggtccagcccaggctcgccccgtggcactctcccg

SEQ ID NO: 26112 - DNA, 295 bp, Homo sapiens
  misc_feature: GYAE6OF02HCNAE.25.36.D03.1.454.CMB.1.raw
  modified_base (290)..(295): a, c, t, g, unknown or other
  misc_feature (290)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccccatctgaactgtacagtctgagcgggctggcaaggcgcatagnnnnnn

SEQ ID NO: 26113 - DNA, 298 bp, Homo sapiens; identical to SEQ ID NO: 25661
  misc_feature: GYAE6OF02FK1GU.25.36.D03.1.454.CMB.1.raw
  modified_base (291)..(298): a, c, t, g, unknown or other
  misc_feature (291)..(298): n is a, c, g, or t

SEQ ID NO: 26114 - DNA, 505 bp, Homo sapiens
  misc_feature: GYAE6OF02IHS50.25.36.D03.1.454.CMB.1.raw
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccggcagagggtctccatctcttgttctgggagcagctccgacgtcggaaatagttgtctactggtaccagcagctccagaaacgccccaagctcctcatctataggaatgatcagcggccctcagggatacctgaccgattctctggctcgaagtctggctcctcggcctccctggccatcagtcggctccggtcgaggatgagctgaatattactgtgctagtttggatgcagtctgagtggtccgaggtggtcggcggaggaccagcgtggaccgtctaggtcacgcccgaggcctcgccccctcggtccactccg

SEQ ID NO: 26115 - DNA, 297 bp, Homo sapiens
  misc_feature: GYAE6OF02HK492.25.36.D03.1.454.CMB.1.raw
  modified_base (290)..(297): a, c, t, g, unknown or other
  misc_feature (290)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccagggaccaaggtggagatcaaacgaactgtggctgcaccatctgtcttcatccttccgccatctgaactgtacagtctgagcgggctggcaaggcgcatagnnnnnnnn

SEQ ID NO: 26116 - DNA, 528 bp, Homo sapiens
  misc_feature: GYAE6OF02FU95R.25.36.D03.1.454.CMB.1.raw
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (395)..(397): a, c, t, g, unknown or other
  misc_feature (395)..(397): n is a, c, g, or t
  modified_base (399)..(400): a, c, t, g, unknown or other
  misc_feature (399)..(400): n is a, c, g, or t
  modified_base (415)..(417): a, c, t, g, unknown or other
  misc_feature (415)..(417): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
  modified_base (449)..(452): a, c, t, g, unknown or other
  misc_feature (449)..(452): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (458)..(459): a, c, t, g, unknown or other
  misc_feature (458)..(459): n is a, c, g, or t
tcagactgtacagtcacgaccggtgctcgatttagctgcgtcacgatcgtcgtcttgggatagaagttattcagcaggcacacaacagaggcaggttccagaattcactctcaccatcagcagcctgcagcctgatcgattttgcaacttatactgccaacaatataactaattattcgaccacttttggccaggggaccaaggtcggacgacctaacgaacgtacgtaggtcgtacgtcgacctacgtacttcggtcgttccttactacgtttcccggtccccacgttacttcgaaacttacgttaccgtaaggtacttacgtaccggaacgggtccggtaggtcggttaacggacgggtccgactaacgtaggctcagngtcatcanctngcnnncnncacacgctctcacannntctcncgcgcgcgngcgngtntntatntgngnnnntntntnntgtagtgtgtagtgacgcgagagcgcgcgcgacgacgacgtacgcgtacgccgtccgtctctcgtctcc

SEQ ID NO: 26117 - DNA, 296 bp, Homo sapiens
  misc_feature: GYAE6OF02H96JZ.25.36.D03.1.454.CMB.1.raw
  modified_base (290)..(296): a, c, t, g, unknown or other
  misc_feature (290)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccagggaccaaggtggagatcaaacgaactgtggctgcacatctgtcttcatccttcccgcctatctgaactgtacagtctgagcgggctggcaaggcgcatgnnnnnnn

SEQ ID NO: 26118 - DNA, 291 bp, Homo sapiens
  misc_feature: GYAE6OF02FY1GH.25.36.D03.1.454.CMB.1.raw
  modified_base (288)..(291): a, c, t, g, unknown or other
  misc_feature (288)..(291): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttccgcatctgaactgtacagtctgagcgggctggcaaggcgcatagnnnn

SEQ ID NO: 26119 - DNA, 519 bp, Homo sapiens
  misc_feature: GYAE6OF02HU520.25.36.D03.1.454.CMB.1.raw
  modified_base (316)..(316): a, c, t, g, unknown or other
  misc_feature (316)..(316): n is a, c, g, or t
  modified_base (370)..(370): a, c, t, g, unknown or other
  misc_feature (370)..(370): n is a, c, g, or t
  modified_base (458)..(458): a, c, t, g, unknown or other
  misc_feature (458)..(458): n is a, c, g, or t
  modified_base (492)..(492): a, c, t, g, unknown or other
  misc_feature (492)..(492): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggaagcagtgtgttcgtcagacatacactcacctgggtccggcaggcctctggaactgggcctgagtgggnggacatcgaaccgccacgccggaacacagagtcgcacatcagtttcagggcagngtcaccgttttcgtggacaagtccacgggcgcagtatacatgaatctcaatgaacctgacgatttgcggacacggccgtagtattacngtgcgagaagagtccgtgcctacgaaagtcgaanagcgtggcctcgaccccgtgggacccg

SEQ ID NO: 26120 - DNA, 314 bp, Homo sapiens
  misc_feature: GYAE6OF02GGZ1K.25.36.D03.1.454.CMB.1.raw
  modified_base (293)..(314): a, c, t, g, unknown or other
  misc_feature (293)..(314): n is a, c, g, or t
tcagactgtacagtcacgaccggtgctcgatttagctgcgtcacgatctctcttggggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagccgggctggcaaggcgtcatagnnnnnnnnnnnnnnnnnnnnnn

SEQ ID NO: 26121 - DNA, 297 bp, Homo sapiens; identical to SEQ ID NO: 25702
  misc_feature: GYAE6OF02HO89W.25.36.D03.1.454.CMB.1.raw
  modified_base (291)..(297): a, c, t, g, unknown or other
  misc_feature (291)..(297): n is a, c, g, or t

SEQ ID NO: 26122 - DNA, 735 bp, Homo sapiens
  misc_feature: GYAE6OF02JV0ZO.25.36.D03.1.454.CMB.1.raw
tcagactgtacagtcacgaccggtgctcgatttagctgcgtcacgatctctcgttggggagagaagacaggattcaggacaatctccagcatggccggcctccctctcctcctcaccctcctcactcactgtgcagggtcctgggcccagtctgtgctgactcagcccaccctcagtgtcgtcgggacccccgggcaggacgggtctccatctcttgttcgtgggagcagctccgacgtcggaaatagtttgtctactggtaccagcagctccgagaaaccggccccaagcctcctcatctagtaggaatgactcgacgccggccctacgagggtactaccgtaggaccgtatttccgtcgtcggaccttacggaaacggttccgtcggtccgttcccgtcccggggtccctttcccccgtcgggtacccctaacgttccggtacgggttccggggcccgttcccggggtacccggaagggtacgtacggacgggtcctaggtaaacgttacgtttacgtcggttacggccgttaagggtttcgggaacgttcggaccgttaaggttccgttagggtacggttcgggttacccggtacggggtttcggttaccggggaccggggtaacgggtaaccgacggtccgttaacgggaacccggttcgtaacgggtaccgtaccggacccgtaagggtcccgtaccccggtccccgttcggtaccctaccgtttcccgg

SEQ ID NO: 26123 - DNA, 295 bp, Homo sapiens
  misc_feature: GYAE6OF02HHGQ5.25.36.D03.1.454.CMB.1.raw
  modified_base (290)..(295): a, c, t, g, unknown or other
  misc_feature (290)..(295): n is a, c, g, or t
tcagactgtacagtcacgaccggtgctcgatttagctgcgtcacgatctctcttgggatagaagttattcagcagtcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctggcaaggcgcatagnnnnnn

SEQ ID NO: 26124 - DNA, 507 bp, Homo sapiens
  misc_feature: GYAE6OF02JIMHP.25.36.D03.1.454.CMB.1.raw
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggatttagttcagtggttctggcatgcactgggtccgcaggctccaggcaaggggccgagtggttggcagttatagcacatgatggaagttctgaatattatgcagactccgtgaagggccattcacatctccagagacaattcccggaatattgtgtacttggaaatggtacagcctgagagtcgaggactcggctcgtgtattactgtgcgagagtcggggaggtggtagttacgg

SEQ ID NO: 26125 - DNA, 294 bp, Homo sapiens; identical to SEQ ID NO: 25662
  misc_feature: GYAE6OF02GHDJA.25.36.D03.1.454.CMB.1.raw
  modified_base (291)..(294): a, c, t, g, unknown or other
  misc_feature (291)..(294): n is a, c, g, or t

SEQ ID NO: 26126 - DNA, 587 bp, Homo sapiens
  misc_feature: GYAE6OF02I9DGX.25.36.D03.1.454.CMB.1.raw
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
  modified_base (493)..(493): a, c, t, g, unknown or other
  misc_feature (493)..(493): n is a, c, g, or t
tcagactgtacagtcacgaccggtgctcgatttagctgcgtcacgatctctcttggggcgagaagtctctctcagtcaggacacagcatggacatgagggtccctgctcagctcctgggactcctgctgctctggctcccagataccagatgtgacgtccagatgacccagtcctccatcctcctgctgacatctgttagganacagaatcagcatcacttgccggcagtcagggcattagctaattatttagccttggtactanaacagaaaccgagggtagtacgttcaacgtctaccgtgactcgtatcgctacgctcctacgttacacgtccgaggtcccattcctcggttcacggtcggctacgtgaacgtcgtacgggactagtacgttcgacttactcaactctacgagcagcccgtagcacgtcctaagaaacgtgttcgttgaaccgttaactttactacgttaaggtaaccttaaaaaggttnttaaacctacgttcccggcccctttactaaccgttaacgtttttcccgggaacggggtaccgtaaccgaagggttcggaacggttactaaaccg

SEQ ID NO: 26127 - DNA, 511 bp, Homo sapiens
  misc_feature: GYAE6OF02I1VOX.25.36.D03.1.454.CMB.1.raw
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggaagcagtgtgttcgtcagacatacactcacctgggtccggcaggcctctggaactgggcctgagtgggtgggaacaatcaaccgcacgccggaacaacagaggtcgcacatcagtttcagggcagagtcacctttcgtggacaagtccacgggcgcagtatacatgaatctcaatgacctgcgatttgcggacacggccgtatattactgtgcgagaagagtacctgcctcaaagtcgacagctggctcgaccctgggacccgg

SEQ ID NO: 26128 - DNA, 671 bp, Homo sapiens
  misc_feature: GYAE6OF02F5SYI.25.36.D03.1.454.CMB.1.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaatagtttgtctactggtaccagcagctccagaaaccggccccaagctcctcatctataggaatgatcagcggccctcagggatacctgaccgattctcgtggcttacgaacgttctcggccttccgtccggcccttcccgtcgggcccaacgtccgacggttcgggccgttcccgggtccgagggtagtaggacggtccgttagaaattagttaacgttgtcgtcgtaaggtttgggattcggtacccgtaggttccgttaggtacgggttacgggttcccgggtacgggtttcggttccggggacggggtaacggggaccgtaaggtccgtacgggtaccccggttacccggttaacgggtcccgaaccggaccccgtaaacgggtccgttaccccgggtccccccgtccggggttaccctacccgttccccg

SEQ ID NO: 26129 - DNA, 172 bp, Homo sapiens; identical to SEQ ID NO: 25775
  misc_feature: GYAE6OF02HR7YE.25.36.D03.1.454.CMB.1.raw
  modified_base (172)..(172): a, c, t, g, unknown or other
  misc_feature (172)..(172): n is a, c, g, or t

SEQ ID NO: 26130 - DNA, 531 bp, Homo sapiens
  misc_feature: GYAE6OF02GJJCJ.25.36.D03.1.454.CMB.1.raw
  modified_base (207)..(207): a, c, t, g, unknown or other
  misc_feature (207)..(207): n is a, c, g, or t
  modified_base (400)..(400): a, c, t, g, unknown or other
  misc_feature (400)..(400): n is a, c, g, or t
  modified_base (418)..(418): a, c, t, g, unknown or other
  misc_feature (418)..(418): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgtctgggagcagctccgacgtcggaaatagtttgtctactggtaccagcagctcccagaacggccccaagctcctcatctatagaatgatcagcgcctcaggatacctgaccgattctctggctcgagtctggcctcctcggcctcctggccatcagtcggctccggtccgaggntggagctgaatatttacnggtgctaggtttgggattgcctagtctgtagttcggtccgacgggttcggttcgggcgggaggggaccaacggcgtacggacccggttccgtagggtcacggccccgaacggg

SEQ ID NO: 26131 - DNA, 296 bp, Homo sapiens
  misc_feature: GYAE6OF02I80SY.25.36.D03.1.454.CMB.1.raw
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (289)..(296): a, c, t, g, unknown or other
  misc_feature (289)..(296): n is a, c, g, or t
tcagactgtacagtcacgaccggtgctcgatttagctgcgtcacgatctctcttggatagaagttattcagcaggcacacaacagaggcagttccagaattcactctcaccatcagcagcctgcagcctgatgattttgctaacttattactgccaacaatataataattattcgacctacttttggtcaggggaccaaggtgagatacaacgactgtgctgcaccatctgtcttcatccttcccgctatctgaactgtacagtctgacgcggctggcaggcncntagnnnnnnnn

SEQ ID NO: 26132 - DNA, 288 bp, Homo sapiens
  misc_feature: GYAE6OF02FHO7C.25.36.D03.1.454.CMB.1.raw
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (287)..(288): a, c, t, g, unknown or other
  misc_feature (287)..(288): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttatactgccaacaatataataattattcgaccactttggccaggggaccaaggtggagatcaaacgactgtggctgcaccatctgtcttcatcttcccgcatcngaactgtacagtctgancgggctggcaaggcgcatagnn

SEQ ID NO: 26133 - DNA, 224 bp, Homo sapiens; identical to SEQ ID NO: 26065
  misc_feature: GYAE6OF02G7VFL.25.36.D03.1.454.CMB.1.raw
  modified_base (221)..(224): a, c, t, g, unknown or other
  misc_feature (221)..(224): n is a, c, g, or t

SEQ ID NO: 26134 - DNA, 525 bp, Homo sapiens
  misc_feature: GYAE6OF02GRBC1.25.36.D03.1.454.CMB.1.raw
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtgtccccaggagggacagtcactctcacctgtgcttccagcgctgggtcagtcaccagtgagaaccatccaaaactggttccagcagaaacctggacaaccacccagggcactgatttatggtgcaactaaaaacactcttggacccctgcccggttctcaggctcctccttggggcaaagctgccctgacactgtcagatgtgcagcctgaggacgaggctgactaccactgcctgctctcctctggtgtgcgttgggtgttcggcggagggaccaacgtgaccgtcgtgggtcacggcccgaaggcctcggccccgtcggtccactccgtcgttcccccg

SEQ ID NO: 26135 - DNA, 478 bp, Homo sapiens
  misc_feature: GYAE6OF02F4JGZ.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggcgagtcagggcattagcaattatttagcctggtatcaacagaaaccagggagagttcctaagctcctgatctatgctgcctccacgttacactcagggtcccatctcggttcagcggcagtgaatctgggacagagttcactctcactatcagcagcctgcagcctgaagatgttgctaacttattactgtacaaagtataatactcgcccctctctactttcggcggtacgggaccaaggtggagataaccg

SEQ ID NO: 26136 - DNA, 296 bp, Homo sapiens; identical to SEQ ID NO: 25665
  misc_feature: GYAE6OF02IRAI7.25.36.D03.1.454.CMB.1.raw
  modified_base (291)..(296): a, c, t, g, unknown or other
  misc_feature (291)..(296): n is a, c, g, or t

SEQ ID NO: 26137 - DNA, 297 bp, Homo sapiens
  misc_feature: GYAE6OF02IQP8U.25.36.D03.1.454.CMB.1.raw
  modified_base (292)..(297): a, c, t, g, unknown or other
  misc_feature (292)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttccccgccatctgaactgtacagtctgagcgggctggcaaggcgcatagnnnnnn

SEQ ID NO: 26138 - DNA, 295 bp, Homo sapiens; identical to SEQ ID NO: 25691
  misc_feature: GYAE6OF02IWEL7.25.36.D03.1.454.CMB.1.raw
  modified_base (291)..(295): a, c, t, g, unknown or other
  misc_feature (291)..(295): n is a, c, g, or t

SEQ ID NO: 26139 - DNA, 333 bp, Homo sapiens
  misc_feature: GYAE6OF02GVAJY.25.36.D03.1.454.CMB.1.raw
  modified_base (283)..(283): a, c, t, g, unknown or other
  misc_feature (283)..(283): n is a, c, g, or t
  modified_base (307)..(333): a, c, t, g, unknown or other
  misc_feature (307)..(333): n is a, c, g, or t
tcagactgtacagtcacgaccggtgctcgatttagctgcgtcacgatcgttctcttgggatagtaaagttattcagcaggcacacaacagaggcagttccgagaattcactctcaccgactcagcagcctgcagcctgatgattttgctaacttattactgccaacaatataataattagttcgaccacttttggccaggggaccaaggtggagagtcaaacgaactgtaggctgacaccgatctgtcttcatcttcccgcatctgaacctgtacagtctgancgggctggccaaggacgccatagnnnnnnnnnnnnnnnnnnnnnnnnnnn

SEQ ID NO: 26140 - DNA, 322 bp, Homo sapiens
  misc_feature: GYAE6OF02HKEW6.25.36.D03.1.454.CMB.1.raw
  modified_base (296)..(296): a, c, t, g, unknown or other
  misc_feature (296)..(296): n is a, c, g, or t
  modified_base (301)..(322): a, c, t, g, unknown or other
  misc_feature (301)..(322): n is a, c, g, or t
tcagactgtacagtcacgaccggtgctcgatttagctgcgtcacggagtctctcgttgggatagaagttatcagcaggcacaccaacagaggcagttccagaattcactctcaccatcagcagcctgcaagcctggatgattttgcaacttattactgccaacaatataactaagttattcgaccacttttggccaggggaccaagggtgagatcaaacgaactgtggactagcaccatctgtcttcatcttacccgcatctgaactgtacagtctgacgcggctggccaaggcgnatagnnnnnnnnnnnnnnnnnnnnnn

SEQ ID NO: 26141 - DNA, 293 bp, Homo sapiens
  misc_feature: GYAE6OF02F4EK2.25.36.D03.1.454.CMB.1.raw
  modified_base (282)..(282): a, c, t, g, unknown or other
  misc_feature (282)..(282): n is a, c, g, or t
  modified_base (288)..(293): a, c, t, g, unknown or other
  misc_feature (288)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgcaccatctgtcttcatcttcccgcatctgaactgtacagtctgagcggctggcaaggcncatagnnnnnn

SEQ ID NO: 26142 - DNA, 321 bp, Homo sapiens
  misc_feature: GYAE6OF02I45IW.25.36.D03.1.454.CMB.1.raw
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (304)..(321): a, c, t, g, unknown or other
  misc_feature (304)..(321): n is a, c, g, or t
tcagactgtacagtcacgaccggtgctcgatttagctgcgtcacgatctctcttggatagaagttattcagcaggcacacaacagaggcagttccagaattcactctcaccatcagcagcctgcagcctgatgattttgctaacttattacctgccaacaatataataattattcgaccacttttggcctaggggaccaaggtgagatacaaacgaactgtaggctagcaccatctgtcttcatcgtcccnccatctgaactgtacagtctgagtcggctggcaaggcgacatagcngattcannnnnnnnnnnnnnnnnn

SEQ ID NO: 26143 - DNA, 510 bp, Homo sapiens
  misc_feature: GYAE6OF02FX55F.25.36.D03.1.454.CMB.1.raw
  modified_base (316)..(316): a, c, t, g, unknown or other
  misc_feature (316)..(316): n is a, c, g, or t
  modified_base (454)..(454): a, c, t, g, unknown or other
  misc_feature (454)..(454): n is a, c, g, or t
  modified_base (505)..(505): a, c, t, g, unknown or other
  misc_feature (505)..(505): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgtctactggtaccagcagctcccagaaacggcccccaagctcctcatctataggaatgatcagcggccctnagggatacctgaccgattctctggctcgaagtctggctcctcggcctccctggccatcagtggctccggtccgaggatgaggctagaatattactgtgcagtttggatgccagtctgagtggtccgacggtgttcggnggaggaccagctgaccgtctaggtcagcccaggcctcgccccctggtaccnctccg

SEQ ID NO: 26144 - DNA, 296 bp, Homo sapiens; identical to SEQ ID NO: 25665
  misc_feature: GYAE6OF02GQOF5.25.36.D03.1.454.CMB.1.raw
  modified_base (291)..(296): a, c, t, g, unknown or other
  misc_feature (291)..(296): n is a, c, g, or t

SEQ ID NO: 26145 - DNA, 294 bp, Homo sapiens; identical to SEQ ID NO: 25747
  misc_feature: GYAE6OF02GOY3A.25.36.D03.1.454.CMB.1.raw
  modified_base (290)..(294): a, c, t, g, unknown or other
  misc_feature (290)..(294): n is a, c, g, or t

SEQ ID NO: 26146 - DNA, 293 bp, Homo sapiens; identical to SEQ ID NO: 26092
  misc_feature: GYAE6OF02FFUDI.25.36.D03.1.454.CMB.1.raw
  modified_base (289)..(293): a, c, t, g, unknown or other
  misc_feature (289)..(293): n is a, c, g, or t

SEQ ID NO: 26147 - DNA, 297 bp, Homo sapiens
  misc_feature: GYAE6OF02IBQ9T.25.36.D03.1.454.CMB.1.raw
  modified_base (289)..(297): a, c, t, g, unknown or other
  misc_feature (289)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacacttttggccaggggaccaaggtggagatcaaacgaactgtggctgcaccatctgtcttcatcttccgccatctgaactgtacagtctgagcgggctggcaaggcgcatagnnnnnnnnn

SEQ ID NO: 26148 - DNA, 524 bp, Homo sapiens
  misc_feature: GYAE6OF02JB1HY.25.36.D03.1.454.CMB.1.raw
  modified_base (384)..(384): a, c, t, g, unknown or other
  misc_feature (384)..(384): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggaagcagtgtgttcgtcagacatacactcacctgggtccggcaggcctctggaactgggcctgaggtgggtggaacgatcaccgcacgccggaacaacagagtcgcacatcagtttcagggcagagtcacctttccgngacacgtccgacgggcgcagtactacatgaatctacatcgactgcgtatttggcggacgaccggccgttatattactgtgcgagaagagtcctgccctagaaacgtcgaacagacgtggacctcgacccgtgggacccgg

SEQ ID NO: 26149 - DNA, 293 bp, Homo sapiens
  misc_feature: GYAE6OF02H4EJ1.25.36.D03.1.454.CMB.1.raw
  modified_base (282)..(282): a, c, t, g, unknown or other
  misc_feature (282)..(282): n is a, c, g, or t
  modified_base (288)..(293): a, c, t, g, unknown or other
  misc_feature (288)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacacttttggccagggaccaaggtggagatcaaacgaactgtggctgcaccatctgtcttcatcttccgccatctgaactgtacagtctgagcggctggcaagggcncatagnnnnnn

SEQ ID NO: 26150 - DNA, 510 bp, Homo sapiens
  misc_feature: GYAE6OF02F4T8L.25.36.D03.1.454.CMB.1.raw
  modified_base (347)..(347): a, c, t, g, unknown or other
  misc_feature (347)..(347): n is a, c, g, or t
  modified_base (454)..(454): a, c, t, g, unknown or other
  misc_feature (454)..(454): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggtatttagttcagtggttctggcatgcacgtgggtccgcaggctccgaggcaaggggccggagtggttggcagttangcacatgatggaagttctgaatattatgcagactcgtgaggcattcacatctccagagacacgttcccgaactattgtagtacttaggaatcggtacagcctagagngtacgaggactcggctctgtattctgtgcgagacgtcgggaggttggtagttacgg

SEQ ID NO: 26151 - DNA, 484 bp, Homo sapiens
  misc_feature: GYAE6OF02F1OK7.25.36.D03.1.454.CMB.1.raw
  modified_base (385)..(385): a, c, t, g, unknown or other
  misc_feature (385)..(385): n is a, c, g, or t
  modified_base (473)..(484): a, c, t, g, unknown or other
  misc_feature (473)..(484): n is a, c, g, or t
tcagactgtacagtcacgaccggtgctcgatttagctgcgtcacgatctctcttgggcagtccaggggagggcctgaagtgggtcggcctcatgagaccgagggcctctggagggacagtggagcatgacgcgtctctgatgggcaggttcagcctctcaagggacgactctaaagccatcgcctatctgcaaatgaccagcctgacagtcgaagactcagccatctattattgtgcgagactgcctgtctctgattcggggacttattggacgaactacttcacttattcccacatggacgttttggggcaaggggaccacggtcatcgtctcctccacctccaccaaggcccatccggtctcccctgcaccctcctccaagcncacctctcgggggcacgacgcggccctgggctgccgtggtcaacggactacttcacttacagtctgagcgggctggcaggcgcatagnnnnnnnnnnnn

SEQ ID NO: 26152 - DNA, 294 bp, Homo sapiens
  misc_feature: GYAE6OF02IMX7V.25.36.D03.1.454.CMB.1.raw
  modified_base (285)..(285): a, c, t, g, unknown or other
  misc_feature (285)..(285): n is a, c, g, or t
  modified_base (291)..(294): a, c, t, g, unknown or other
  misc_feature (291)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcncatagnnnn

SEQ ID NO: 26153 - DNA, 529 bp, Homo sapiens
  misc_feature: GYAE6OF02FSD6Y.25.36.D03.1.454.CMB.1.raw
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtgtccccaggagggacagtcactctcacctgtgcttccagcgctgggtcagtcaccagtgagaaccatccaaactggttccagcagaaacctggacaaccacccagggcactgatttatgttgcaactaaaaaacactcttggacccctgcccggttctcaggctccctccttgggggcaaagctgccctgacactgtcagatgtgcagcctgaggacgaggctgactaccactgcctgctctcctctggtgtgcgttgggtgttcggcggtagggaccaacgtgaccgtccgtgggtcacggcccgaaggcctcggccccctcggtccacgtcctgttacccccc

SEQ ID NO: 26154 - DNA, 677 bp, Homo sapiens
  misc_feature: GYAE6OF02I4AS8.25.36.D03.1.454.CMB.1.raw
  modified_base (165)..(165): a, c, t, g, unknown or other
  misc_feature (165)..(165): n is a, c, g, or t
  modified_base (180)..(180): a, c, t, g, unknown or other
  misc_feature (180)..(180): n is a, c, g, or t
  modified_base (313)..(313): a, c, t, g, unknown or other
  misc_feature (313)..(313): n is a, c, g, or t
tcagactgtacagtcacgaccggtgctcgatttagctgcgtcacgatctctcttggggagctctgggagaggagcccagcactagaagtcggcggtgttccattcggtgatcagcactgaacacagaggactcaccatggagtttgggctgagctgggttttccncgttgctctttaagnggtgtccatgtcaggtgcacctggtggagtcgtgggggagcgtggtccaggcctgggacgtccctgagtactctcctgtgaagcctcgtggtatttagttcaggtggttctggctagtgcacgtcgggtcccnccgaggtcctaccgagggcgaacgggggtccgaaggtcgggttcggactaaggtttacacggcaactagttggaacgttagggtaacgttcgtagtaaattacgttatcggacctaacggtaccgtcccggtaagggaaacgggtcccgtaagtttacccgaacccgtaacgttcccgtaccgtaagggtaaccgtaaccgttaaccgtttaccccgggaacttagtttacggttacggttaaccgttagggtaaacgttcgggtactacggtccgttaggaggtaacgttaccgggaggtaccgtcgggtactcgtgttaattccgtggtacgtgtacgtgtcggggagttaggtagttacgg

SEQ ID NO: 26155 - DNA, 238 bp, Homo sapiens
  misc_feature: GYAE6OF02FY46W.25.36.D03.1.454.CMB.1.raw
  modified_base (225)..(238): a, c, t, g, unknown or other
  misc_feature (225)..(238): n is a, c, g, or t
tcagactgtacagtcacgaccggtgctcgatttagctgcgtcacgagtctctacttggggccagggttccctggtcaccgtctcctcagcctccaaccaagggcccatcggtcttccccctggcgccctgctccaggagcacctccgagagcacagcggccctgggctgcctggtcaaggactacttccactgtacagtctgagcgggctggcaaggcgcatagnnnnnnnnnnnnnn

SEQ ID NO: 26156 - DNA, 526 bp, Homo sapiens
  misc_feature: GYAE6OF02FZCG7.25.36.D03.1.454.CMB.1.raw
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggattttcctttggctattttaaaaggtgtccagtgtgaagtgcaactggtggagtctgggggaggcttggtacagcctggcaggcccctgagactctcctgtgcagcctctggattcacctttgatgattatgccatgcacgtgggtccggcaagctccgaggggaaggccgtggagtgggtctcgaggtattagttggaatagtggtagcagtaggctagtgcggactctgtgaagggccgattccaccatctccagagaccaacgccaaagaacctccctagtactctgacaaatcgaaacagtctgagagcgtggaggacacggtcctttagtacttacgtagtagaactaaaagtttattaacg

SEQ ID NO: 26157 - DNA, 950 bp, Homo sapiens
  misc_feature: GYAE6OF02JB6DC.25.36.D03.1.454.CMB.1.raw
tcagactgtacagtcacgaccggtgctcgatttagctgcgtcacgatctctcttgggggggtcacaagaggcagcgctctcgggacgtctccaccatggcctgggctctgctgctcctcactctcctcactcgacggacacgacgggtccgtcgggcccagtcgtcggcctgacctaccaacctcgtcccgttccggttcgttcggttcgggttccttccggtacgggtacggtactaactccaccttactttccgtcgacctacgtacggaaccacgccacgtagagttggttcggtctttactttcgtaccttgtccttcgttacgtaaccaaacaacccgaacccggaaacgaaacggtccctaaccctaaacttcctaaattttaacgttttaggaaccgtaaccgtaaggtaaccggcccggttaccccttacgggtttcggggttttacctacggttaccgttaactttaccgacggttcggtacccttaacccgtaagttccggttacgggaaaccctaaaccggtaccccgggttaccccctttaaaccccttaaaacgtaacccgttttcccgttaccgggttaccgggggtaccccttaacccgggtaacgggttaccgttaaaacgggaaaaccgggtaaccgggtaacgggtttccgttttaacggttttttaaacctttccggttacgtacggtttttcggttacgttacctttaaggttcgggtacggttacctaaaacggtaaaaccgtttgggttttcggtaccggtaccggttaaccggggaccggggtaaccggtaaacccttaagtttacccgggacccgttttaaacggttaaccgtccggaacccggtacccggtaacggtcccgttccccggtaccccgttcggtacccttaaccggttccctttaccccggtacccccctaaccccg

SEQ ID NO: 26158 - DNA, 296 bp, Homo sapiens
  misc_feature: GYAE6OF02GURXS.25.36.D03.1.454.CMB.1.raw
  modified_base (290)..(296): a, c, t, g, unknown or other
  misc_feature (290)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgccaacaatataataattattcgaccacgttttggcaggggaccaaggtggagatcaaacgactgtggctgcaccatctgtcttcatcttcccgcatctgaactgtacagtctgagcgggctggcaaggcgcatagnnnnnnn

SEQ ID NO: 26159 - DNA, 314 bp, Homo sapiens
  misc_feature: GYAE6OF02GE8GZ.25.36.D03.1.454.CMB.1.raw
  modified_base (296)..(314): a, c, t, g, unknown or other
  misc_feature (296)..(314): n is a, c, g, or t
tcagactgtacagtcacgaccggtgctcgatttagctgcgtcacgatctcttcgttgggatagaagttattcagcaggcacacaacagaggcagttccacgaattcactctcaccgatcagcagcctgcagcctgatgattttgcaacttattactgccaacaactataataattattcgaccacttttggccaggggaccaaggtggagatcaaacgaactgtggctgcaccatctgtcttcatcttcccgcattctagaactgtacagtctgagcggctggcaaggcgcatagnnnnnnnnnnnnnnnnnnn

SEQ ID NO: 26160 - DNA, 297 bp, Homo sapiens
  misc_feature: GYAE6OF02HMXXC.25.36.D03.1.454.CMB.1.raw
  modified_base (294)..(297): a, c, t, g, unknown or other
  misc_feature (294)..(297): n is a, c, g, or t
tcagactgtacagtcacgaccggtgctcgatttagctgcgtcacgagtctctcttgggatagaagttacttcagcaggcacacgaacagaggcaggttccagaattcactctctaccatcagcagcctgcagcctgatgatttgcaacttattactgccaacaatataataattattcgaccacttttggccagggaccaaggtggagatcaaacgaactgtggctgcaccatctgtcttcatcttcccgccatctgaactgtacagtctgagcgggctggcaaggcgcatagnnnn

SEQ ID NO: 26161 - DNA, 291 bp, Homo sapiens
  misc_feature: GYAE6OF02H0C46.25.36.D03.1.454.CMB.1.raw
  modified_base (288)..(291): a, c, t, g, unknown or other
  misc_feature (288)..(291): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacacttttggccagggaccaaggtggagatcaaacgaactgtggctgcaccatctgtcttcatcttcccgccatctgaactgtacagtctgagcggctggcaaggcgcatagnnnn

SEQ ID NO: 26162 - DNA, 498 bp, Homo sapiens
  misc_feature: GYAE6OF02GMMH2.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttgccggcgagtcagggcattagcaattattagcctggtatcaacagaaaccagggagagttcctaagctcctgatctatgctgcctccacgttacactcagggtcccatctcgttcagcgcagtgatctgggacagagttcactctcactatcagcagcctgacagcctgaagagtgttacgactaacttaattacgtacgtactaaagtataatacgtcgaccccttcgtacctacgtttccggacggtacgggaccgaaggtcggatacgtaaccg

SEQ ID NO: 26163 - DNA, 521 bp, Homo sapiens
  misc_feature: GYAE6OF02ISFYC.25.36.D03.1.454.CMB.1.raw
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggagcagtgtgttcgtcagacatacactcacctgggtccggcaggcctctggaactgggcctgagtgggtggacaatcaaccgcacgccggaacaacagagtcgcacatcagttcagggcagngtcacttttccgnggacaagtccacgggcgcagtatacatgatctcaatcgacctgcgtatttgacggtacaccggcgtagtattacgtgtgcgagaagacgtcctggcctacgaaacgtcgaacgagctggctccgaccccgtgggacccgg

SEQ ID NO: 26164 - DNA, 502 bp, Homo sapiens
  misc_feature: GYAE6OF02GWX98.25.36.D03.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (309)..(309): a, c, t, g, unknown or other
  misc_feature (309)..(309): n is a, c, g, or t
  modified_base (404)..(404): a, c, t, g, unknown or other
  misc_feature (404)..(404): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagttgctactggtaccagcagctccagaaacgcccccaagctcctcatctataggaatgatcagcgccctnagggatacctgaccgattctctggctcgagtctgctcctcgcctcctgccatcagtggctccggccgaggatggaggctagaatattacgtgtgngagtttgggatggccagtctgagtggtccgaggttgtcggcggaggaccagcgtcgccgtctaggtcacgcccaggctccgcccctggtccacgtccg

SEQ ID NO: 26165 - DNA, 297 bp, Homo sapiens
  misc_feature: GYAE6OF02HZ2NG.25.36.D03.1.454.CMB.1.raw
  modified_base (285)..(285): a, c, t, g, unknown or other
  misc_feature (285)..(285): n is a, c, g, or t
  modified_base (290)..(297): a, c, t, g, unknown or other
  misc_feature (290)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgactactttggccagggaccaaggtggagatcaaaacgaactgtggctgcaccatctgtcttcatccttccgccatctgaactgtacagtctgagcgggctggcaaggcgnatagnnnnnnnn

SEQ ID NO: 26166 - DNA, 298 bp, Homo sapiens
  misc_feature: GYAE6OF02I4I95.25.36.D03.1.454.CMB.1.raw
  modified_base (294)..(298): a, c, t, g, unknown or other
  misc_feature (294)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgactacttttggccagggaccaaggtgagatacaaacgaactgtggactgcaccatctgtcttcatcgtcccgcatcgtgaactgtacagtctgacgcggctaggcaacggcgtcaatgnnnnn

SEQ ID NO: 26167 - DNA, 313 bp, Homo sapiens
  misc_feature: GYAE6OF02JL0RW.25.36.D03.1.454.CMB.1.raw
  modified_base (294)..(294): a, c, t, g, unknown or other
  misc_feature (294)..(294): n is a, c, g, or t
  modified_base (301)..(302): a, c, t, g, unknown or other
  misc_feature (301)..(302): n is a, c, g, or t
  modified_base (304)..(309): a, c, t, g, unknown or other
  misc_feature (304)..(309): n is a, c, g, or t
  modified_base (311)..(313): a, c, t, g, unknown or other
  misc_feature (311)..(313): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgaccaacaatataataattattcgacctacttttggaccaggggaccaaggttggagatacaaacgacgtgtaggctgcaccatctgtcttcattccttccgctatctgaacctgtacagtctgacggcggtctggcaggcncgatagnngnnnnnntnnn

SEQ ID NO: 26168 - DNA, 296 bp, Homo sapiens; identical to SEQ ID NO: 25665
  misc_feature: GYAE6OF02GKA7T.25.36.D03.1.454.CMB.1.raw
  modified_base (291)..(296): a, c, t, g, unknown or other
  misc_feature (291)..(296): n is a, c, g, or t

SEQ ID NO: 26169 - DNA, 298 bp, Homo sapiens; identical to SEQ ID NO: 25881
  misc_feature: GYAE6OF02GUV3D.25.36.D03.1.454.CMB.1.raw
  modified_base (290)..(298): a, c, t, g, unknown or other
  misc_feature (290)..(298): n is a, c, g, or t

SEQ ID NO: 26170 - DNA, 508 bp, Homo sapiens
  misc_feature: GYAE6OF02H5O3V.25.36.D03.1.454.CMB.1.raw
  modified_base (201)..(201): a, c, t, g, unknown or other
  misc_feature (201)..(201): n is a, c, g, or t
  modified_base (338)..(338): a, c, t, g, unknown or other
  misc_feature (338)..(338): n is a, c, g, or t
  modified_base (407)..(407): a, c, t, g, unknown or other
  misc_feature (407)..(407): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctcctgtctgcatctgttggancagaatcagcatcacttgccggcgagtcagggcattagcaattattagcctggtatcaaacagaaaccaggagagttacctaagctcctgatctatgctgcctcctacgttacactcacgggtcccatctcgttacngcggctagtgaatacgtggactagagttcacgtctacacgtatccgagcagtcctgcacgctagaagtntacgttgactaattattactagttaacaaatactaattacgtctacccttcaccttacgttcggtacggaacggtaccgtaaggtacggtacgataaccgg

SEQ ID NO: 26171 - DNA, 294 bp, Homo sapiens
  misc_feature: GYAE6OF02F3CYF.25.36.D03.1.454.CMB.1.raw
  modified_base (290)..(294): a, c, t, g, unknown or other
  misc_feature (290)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttgccaggggaccaaggtggagatcaaacgaactgtggctgcaccatctgtcttcatcttcccgccatctgaactgtacagtctgagcgggctggcaaggcgcatagnnnnn

SEQ ID NO: 26172 - DNA, 633 bp, Homo sapiens
  misc_feature: GYAE6OF02I9WC7.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgaccgtccagatgacccagtcctccatcctccctgtctgcatctgttggagacagaatcagcatctacgttcggccgggcgaggtcgagggctatttacgactaatttatttagcctggtatacaacgaacgaaaccgagggagtacgttacctaacggccttacctagtactctaatcgctcggtcctacctacgtttacacgtcgacgggtccacttcgtcggttcacgtcgcagtacgtatcggtggacgtagtacgttcactctactactatacgacgtaccgtacgccgttgccgaacggtcctaaggaacgttacgttacggttacgtaacctttaaacgtttacttaaacgtcgttaaaacctaaagtttaacttaacggtaccttcccggtaaccctttcgacctttacggtttccgggtaccgggtaaccgggtaaccgttaagggtacgggtacggtaactaaacccggg

SEQ ID NO: 26173 - DNA, 364 bp, Homo sapiens
  misc_feature: GYAE6OF02HY3O7.25.36.D03.1.454.CMB.1.raw
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (320)..(322): a, c, t, g, unknown or other
  misc_feature (320)..(322): n is a, c, g, or t
  modified_base (324)..(364): a, c, t, g, unknown or other
  misc_feature (324)..(364): n is a, c, g, or t
tcagactgtacagtcacgaccggtgctcgatttagctgcgtcacgatctctcgttgggatagaagttattcagcaggcacacaacagaggacagtccagaattcactctcaccatcagcagcctgccagcctgatgattttgctaacttagttactgacccaacaaactataaactaattattacgacctacgttttgggccaggggacccaaggtcggagatcaaaacgactgtggacttgctacctatctgtcttnactccttaccgccatcngaaccngtacagtctggagcggctaggcaaggcgcatacgncnannnannnnnnnnnnnnnnnnnnnnnnnnnnnnnnnnnnnnnnnnn

SEQ ID NO: 26174 - DNA, 505 bp, Homo sapiens
  misc_feature: GYAE6OF02HV7OX.25.36.D03.1.454.CMB.1.raw
  modified_base (202)..(202): a, c, t, g, unknown or other
  misc_feature (202)..(202): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggcgagtcagggcattagcaattattagcctggtatcaacagaaaccgagggagtagttacctaagctcctgatctatgctgcctcctacgtacactcgacgggtccatctcgttcagcggcagtgaactcgtgggactagagttcactctacactatacacgcacgcctgacagtcctagaagatgttagactaacttattacgtagtaactaaagtactaataccgtcgccctatccgtacgtttcggacggaggaccgaaggtacggagtagtaaccg

SEQ ID NO: 26175 - DNA, 295 bp, Homo sapiens; identical to SEQ ID NO: 25656
  misc_feature: GYAE6OF02FGOS8.25.36.D03.1.454.CMB.1.raw
  modified_base (290)..(295): a, c, t, g, unknown or other
  misc_feature (290)..(295): n is a, c, g, or t

SEQ ID NO: 26176 - DNA, 320 bp, Homo sapiens
  misc_feature: GYAE6OF02FQDZP.25.36.D03.1.454.CMB.1.raw
  modified_base (298)..(320): a, c, t, g, unknown or other
  misc_feature (298)..(320): n is a, c, g, or t
tcagactgtacagtcacgaccggtgctcgatttagctgcgtcacgatcgtctcttgggatagaagttattcagcaggcacacaaccagaggcagttccagaattcactctcaccatcagcagcctgcaagcctgatgattttgcaacttattactcgccaacaatataataattagttcgaccactttcggccaggggaccaaggtggagatacaaacgaactgtggctgcaccatctgtacttcatcttcccgcatcctgaactgtacagtctgagcgggctggcaaggcgcatagnnnnnnnnnnnnnnnnnnnnnnn

SEQ ID NO: 26177 - DNA, 298 bp, Homo sapiens
  misc_feature: GYAE6OF02F9GZV.25.36.D03.1.454.CMB.1.raw
  modified_base (292)..(298): a, c, t, g, unknown or other
  misc_feature (292)..(298): n is a, c, g, or t
tcagactgtacagtcacgaccggtgctcgatttagctgcgtcacgatctctctgggatagaagttattcagcaggcacacaacagaggcagttccagaattcactctcaccatcagcagcctgcagcctgatgattttgcaacttattactgccaacaatataataattattcgaccacttttggccaggggaccaaaggtggagatcaaacgaactgtggctgcaccaatctgtcttcatcttcccgcatctgaactgtaccagtctgagcggctggcaaggcgacatagnnnnnnn

SEQ ID NO: 26178 - DNA, 593 bp, Homo sapiens
  misc_feature: GYAE6OF02ISP18.25.36.D03.1.454.CMB.1.raw
  modified_base (363)..(363): a, c, t, g, unknown or other
  misc_feature (363)..(363): n is a, c, g, or t
  modified_base (436)..(436): a, c, t, g, unknown or other
  misc_feature (436)..(436): n is a, c, g, or t
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaggctaccaaactcattaatttgagaccagtaacgcgccctgttgggtttctagtcgattcactgctcagtctggcaacncgcctaccctaacatctcgtggctccgagctgaagacgaggcttgtttattctgtcttgttgcttagtgtggntagtaaaactagtttggtcgtcgtcgggacggaacgggtaaccctaagttcggaccgttacgtttaacggtccgtaacggcccgtaagggtcccgttaccggtccccccgttacgggttaccctaccgtttccgttcccggttcccccgtacccccg

SEQ ID NO: 26179 - DNA, 504 bp, Homo sapiens
  misc_feature: GYAE6OF02G2ANZ.25.36.D03.1.454.CMB.1.raw
  modified_base (491)..(504): a, c, t, g, unknown or other
  misc_feature (491)..(504): n is a, c, g, or t
tcagactgtacagtcacgaccggtgctcgatttagctgcgtcacgatctctcttgggcagtccaggggagggcctgaagtgggtcggcctcatgagaccgagggcctctggagggacagtggagcatgacgcgtctctgatgggcaggttcagcctctcaagggacgactctaaagccatcgcctatctgcaaatgaccagcctgacagtcgaagactcagccatctattattgtgcgagactgcctgtctctgattcggggacttattggacgaactacttcacttattcccacatggacgtttggggcaaggggaccacggtcatcgtctcctccacctccaccaggcccatcgtctccccctgccaccctcctccaacgacgcacctcgtcgggggcacgacgccggcccgtcgggctcgccgtcggtcgaacggactaccttccactcgtacacgtctgagccgggcgtcggacgaggcgcagtagnnnnnnnnnnnnnn

SEQ ID NO: 26180 - DNA, 296 bp, Homo sapiens; identical to SEQ ID NO: 25678
  misc_feature: GYAE6OF02IPGWL.25.36.D03.1.454.CMB.1.raw
  modified_base (290)..(296): a, c, t, g, unknown or other
  misc_feature (290)..(296): n is a, c, g, or t

SEQ ID NO: 26181 - DNA, 294 bp, Homo sapiens; identical to SEQ ID NO: 25747
  misc_feature: GYAE6OF02GDQ2L.25.36.D03.1.454.CMB.1.raw
  modified_base (290)..(294): a, c, t, g, unknown or other
  misc_feature (290)..(294): n is a, c, g, or t

SEQ ID NO: 26182 - DNA, 608 bp, Homo sapiens
  misc_feature: GYAE6OF02JBVTL.25.36.D03.1.454.CMB.1.raw
  modified_base (506)..(506): a, c, t, g, unknown or other
  misc_feature (506)..(506): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggagcagctccgacgtcggaaataagtttgctactggtaccagcagctcccagaaaccggcccccaagctcctcatctataggaatgatcagccggccctcgagggatacctgaccgtattcctctggctcgaagtctcggctccgtcggccctcccgtggcccatcgagtcgggccttccgggtccgaggacgtggaggcttaggaaatacttactggtgtacgtaggttttggggatcggaccctaggtcgtggagttcgggttcccggtacgggttggttccgggngggaacggggtaccaggtccgtacgggtacccggttccgaacggttccgaaccggacccgagggtcctacccggcccccgttcgggtaccctaccttcccgg

SEQ ID NO: 26183 - DNA, 427 bp, Homo sapiens
  misc_feature: GYAE6OF02GZ1ZP.25.36.D03.1.454.CMB.1.raw
  modified_base (345)..(346): a, c, t, g, unknown or other
  misc_feature (345)..(346): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (357)..(358): a, c, t, g, unknown or other
  misc_feature (357)..(358): n is a, c, g, or t
  modified_base (362)..(362): a, c, t, g, unknown or other
  misc_feature (362)..(362): n is a, c, g, or t
  modified_base (370)..(373): a, c, t, g, unknown or other
  misc_feature (370)..(373): n is a, c, g, or t
  modified_base (376)..(427): a, c, t, g, unknown or other
  misc_feature (376)..(427): n is a, c, g, or t
tcagactgtacagtcacgaccggtgctcgattttagctgcgtcacgatctctcgttgggatagaagttattcagcaggcacacaacagaggcagttcccagaattcactctcaccatcagcagcctgcacgccgttgagttcgtatttttcgactaacctttattacctgacccaactaattataattaagtttattccgacctacgttttgggccgaggggaccaagggtgggatatacaaacgactggtggctgccaccatctgttcttcattccttccccgctatcctgaactggtaccagtctgacgccggggacttggctaagggccgacctagtacggnngnctgntcganngtcngtctgacnnnngannnnnnnnnnnnnnnnnnnnnnnnnnnnnnnnnnnnnnnnnnnnnnnnnnnn

SEQ ID NO: 26184 - DNA, 321 bp, Homo sapiens
  misc_feature: GYAE6OF02G8SP3.25.36.D03.1.454.CMB.1.raw
  modified_base (297)..(321): a, c, t, g, unknown or other
  misc_feature (297)..(321): n is a, c, g, or t
tcagactgtacagtcacgaccggtgctcgatttagctgcgtcacgatctctcttgggatagaagttattccaggctaggcacacaacagaggcagttccagaattcactctcaccatcagcagcctgcagcctgatgattttgcaacttattactgccaacaatataataattattcgaccacttttggccaggggaccaaggtggagatcgaaacgaactgtggctgcaccatctgtcttcatcttcccgcatctgaactgtacagtctgagcgggctgggcaaggcgcgataggnnnnnnnnnnnnnnnnnnnnnnnnn

SEQ ID NO: 26185 - DNA, 653 bp, Homo sapiens
  misc_feature: GYAE6OF02IVMI6.25.36.D03.1.454.CMB.1.raw
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggattttccttttggctattttaaaggtgtccagtgtgaagtgcaactggtggagtcgtgggggaggcttggtacagcctggcaggcccctgagactctcctgtgcagcctcgtggattctacctttgattgtattatcgcatgcacgtcgggtccggcaagcctcgaggggaacgggcctggagtgggtctcgaggtatttaggtggaattaggtggtagctagtagggctagtcggacggtactcgtggtagggtaacggggtccgtaattcccaacccgtacgttccctacccgaaggtaaccggaaaccgaaacccgtacccgaaaacggtaaccccttccccggttagttaactccgttaggaaccaaagttacgaaacgtacgtacgtaggtacgacgtacgtacgggaacggaaccgtaacggtacccgttttaggttaactttacggtaggttaacgtaaacgttaaaaagtttacgtttaaaccggg

SEQ ID NO: 26186 - DNA, 297 bp, Homo sapiens
  misc_feature: GYAE6OF02GO91B.25.36.D03.1.454.CMB.1.raw
  modified_base (291)..(297): a, c, t, g, unknown or other
  misc_feature (291)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtaggctgcaccatctgtcttcatcttcccgcatctgaactgtacagtctgagcgggctggcaaggcgcatagnnnnnnn

SEQ ID NO: 26187 - DNA, 325 bp, Homo sapiens
  misc_feature: GYAE6OF02JCF20.25.36.D03.1.454.CMB.1.raw
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (312)..(325): a, c, t, g, unknown or other
  misc_feature (312)..(325): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacacttttggcctagggaccaaggtgagatacaaagaactgtaggctgcaccagtctgtcttcatctcccgcatctgaactcgtacagtcctgagcgggctgggctaaagggccacagtacggntgancgnantngnnnnnnnnnnnnnn

SEQ ID NO: 26188 - DNA, 295 bp, Homo sapiens
  misc_feature: GYAE6OF02H2AQZ.25.36.D03.1.454.CMB.1.raw
  modified_base (291)..(295): a, c, t, g, unknown or other
  misc_feature (291)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatacaaacgaactgtggctgcaccatctgtcttcatcttcccgccatctgaactgtacagtctgagcggctggcaaggcgcatagnnnnn

SEQ ID NO: 26189 - DNA, 307 bp, Homo sapiens
  misc_feature: GYAE6OF02JX4XE.25.36.D03.1.454.CMB.1.raw
  modified_base (281)..(281): a, c, t, g, unknown or other
  misc_feature (281)..(281): n is a, c, g, or t
  modified_base (288)..(289): a, c, t, g, unknown or other
  misc_feature (288)..(289): n is a, c, g, or t
  modified_base (291)..(294): a, c, t, g, unknown or other
  misc_feature (291)..(294): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (300)..(307): a, c, t, g, unknown or other
  misc_feature (300)..(307): n is a, c, g, or t
tcagactgtacagtcacgaccggtgctcgatttagctgcgtcacgatctctcttggatagaagttattcagcaggcacacaacagaggcagttccagaattcactctcaccatcagcagcctgcagcctgatgattttgcaacttattactgccaacaatataataattatcgacacttttgccagggaccaaggtgagatacgaacgaactgtaggctgcaccatctgtcttcatctcccgcatctgaactgtacagtctgacgtcggactggcaaggcncagtagnngnnnncntncnnnnnnnn

SEQ ID NO: 26190 - DNA, 538 bp, Homo sapiens
  misc_feature: GYAE6OF02IP5PM.25.36.D03.1.454.CMB.1.raw
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggattttcctttggctattttaaaaggtgtccagtgtgaagtgcaactggtggagtcgtgggggaggcttggtacagcctggcaggccctgagactctcctgtgcagcctntggattcacctttgatgattatgccatgcacgtgggtccgnaagctccgaggggaggcctggagtgggtctcgaggttattaggttggaataggtggtagcagtagggctagtgcggactcgtgtggaagggccgattcaccatcctcgagacgacaacgcaagactccctagtactctagacaaagtcgaaacagtactaggacgagcgtaggacggaccaccggtcctttagtacttacgtggtacgaacgttaaaattagttaacgg

SEQ ID NO: 26191 - DNA, 295 bp, Homo sapiens
  misc_feature: GYAE6OF02GOUTL.25.36.D03.1.454.CMB.1.raw
  modified_base (290)..(295): a, c, t, g, unknown or other
  misc_feature (290)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcggctggcaaggcgcatagnnnnnn

SEQ ID NO: 26192 - DNA, 295 bp, Homo sapiens; identical to SEQ ID NO: 25656
  misc_feature: GYAE6OF02F9JC5.25.36.D03.1.454.CMB.1.raw
  modified_base (290)..(295): a, c, t, g, unknown or other
  misc_feature (290)..(295): n is a, c, g, or t

SEQ ID NO: 26193 - DNA, 571 bp, Homo sapiens
  misc_feature: GYAE6OF02IEIBZ.25.36.D03.1.454.CMB.1.raw
  modified_base (313)..(313): a, c, t, g, unknown or other
  misc_feature (313)..(313): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgctaggtttattactttgtctcctgtaccaacaacacccaggacaaacgaccccctaaacttatcctatttangacggaccaactaagccggccctacgaggtacgtttactaatcgtcttactctggctaccgaagtctggcacgcacggccctccngacaatctcgtggctcgngctggacgacgagctgtattatactgtcctatcgatactgaacacatcaactaacgttccccgtacgtttaccggaccgtacggaccgtaccgggttaccacccggttccggtacgggttcccaaccggacccgaacccgggcccctaaaccccg

SEQ ID NO: 26194 - DNA, 296 bp, Homo sapiens
  misc_feature: GYAE6OF02GUHVW.25.36.D03.1.454.CMB.1.raw
  modified_base (291)..(296): a, c, t, g, unknown or other
  misc_feature (291)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctggcaaggccgcatagnnnnnn

SEQ ID NO: 26195 - DNA, 301 bp, Homo sapiens
  misc_feature: GYAE6OF02IQKRF.25.36.D03.1.454.CMB.1.raw
  modified_base (288)..(288): a, c, t, g, unknown or other
  misc_feature (288)..(288): n is a, c, g, or t
  modified_base (294)..(301): a, c, t, g, unknown or other
  misc_feature (294)..(301): n is a, c, g, or t
tcagactgtacagtcacgaccggtgctcgatttagctgcgtcacgatctctcttggatagaagttattcagcaggcacacaacagaggcagttccagaattcactctcaccatcagcagcctgcagcctgatgattttgcaacttattactgccaacaatataataattatcgaccacttttggcctagggaccaaggtgagatcaaacgaacgtgtaggctgcaccatctgtcttcatccttcccgccatcctgtaacctgtacagtctgagcggctggccaaggcncatagnnnnnnnn

SEQ ID NO: 26196 - DNA, 297 bp, Homo sapiens
  misc_feature: GYAE6OF02FW3F0.25.36.D03.1.454.CMB.1.raw
  modified_base (290)..(297): a, c, t, g, unknown or other
  misc_feature (290)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctggcaaggcgcatagnnnnnnnn

SEQ ID NO: 26197 - DNA, 617 bp, Homo sapiens
  misc_feature: GYAE6OF02JEOLO.25.36.D03.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaatagtttgtctactggtaccagcagctcccagaaacggcccccaagctcctcatctataggaatgatcagcgcctcaggatacctgaccgatttctcgtggctcgaagtctggctccgtcggccctcccgtggccatcaggtcgggccttccgggtccgaggtactggacgggtcttaggaatttacgttaccgttggtcggtaccgttagggttttggggattcggccgtaaggttccgtaggtacggttcgggttacccggtagggttcggtttccgggggaccgggtaacgggggtaacccaaggtccgttacgggtaccccggttcggttaccgggtccgtacgggtccccgtaaccgggg

SEQ ID NO: 26198 - DNA, 534 bp, Homo sapiens
  misc_feature: GYAE6OF02H7UCC.25.36.D03.1.454.CMB.1.raw
  modified_base (304)..(304): a, c, t, g, unknown or other
  misc_feature (304)..(304): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtgtccccaggagggacagtcactctcacctgtgcttccagcgctgggtcagtcaccagtgagaaccatccaaactggttccagcagaaacctggacaaccaccaggcactgattagtggtnacaaactaaaaacactcttcgaccctgccgttctcacgctcctcgtggggcaagctcgccctgacactgtcagatgtgcagcctggaggacgaggctgactaccatcgcctgcctctcctcgtggtgtgcgttgggtgttcggcggtaggacctaacgtcgaccggtccgtgggtccacggacccgaggtccgtccgcccccgtcggtaccctacttccgtcgtcccccg

SEQ ID NO: 26199 - DNA, 570 bp, Homo sapiens
  misc_feature: GYAE6OF02HIYBS.25.36.D03.1.454.CMB.1.raw
  modified_base (313)..(313): a, c, t, g, unknown or other
  misc_feature (313)..(313): n is a, c, g, or t
  modified_base (351)..(351): a, c, t, g, unknown or other
  misc_feature (351)..(351): n is a, c, g, or t
  modified_base (380)..(380): a, c, t, g, unknown or other
  misc_feature (380)..(380): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgcttcttttaagaggtgtccactgtcaggtgcacctgggtggagtcgtgggggagcgtggtccaggcctggggacgtccctgagactctcctgtgaagtcctctggatttagttcagtggttctggcatgctacgtgggtccnccaggcctcgaggcgaaggggccgagtggtgcagttanagcacagtgagtggtaattctagaaattnttatgcagactcggagaacgggcctatccactatccacagagacaacgttcccgaatatgtgtacttaggaacgtggtcacgcctaggagacgtacggaggtaccgttcggccttcgttaggttactttacgtggtacggtacggtaagggacggttaccgggggtaggtttcgggtaaggtttaacggg

SEQ ID NO: 26200 - DNA, 532 bp, Homo sapiens
  misc_feature: GYAE6OF02HBV2B.25.36.D03.1.454.CMB.1.raw
  modified_base (191)..(191): a, c, t, g, unknown or other
  misc_feature (191)..(191): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctggcccagtctgtgctgactcagccaccctcagtgtctgggacccccgggnagagggtctccatctcttgttctgggagcagctccgacgtcggaaataagtttgtctactggtaccagcagctcccagaaaccggcccccaagcctcctcatctataggaatgatcagccggccctcagggatacctgaccgtattctctgctcgaagtctggctcctcggcctccctgccatcagtggctccggtcgaggatgagctgaatattactgtgctagtttgggatcgcagtctgtagtcggtccgtacggttggttcggcgggaggaccgagctcggaccgtccgtaggtccagcccgaaggcctccggcccccgtcggtcctaccgttcccg

SEQ ID NO: 26201 - DNA, 297 bp, Homo sapiens; identical to SEQ ID NO: 25702
  misc_feature: GYAE6OF02FY7JD.25.36.D03.1.454.CMB.1.raw
  modified_base (291)..(297): a, c, t, g, unknown or other
  misc_feature (291)..(297): n is a, c, g, or t

SEQ ID NO: 26202 - DNA, 546 bp, Homo sapiens
  misc_feature: GYAE6OF02JE2NR.25.36.D03.1.454.CMB.1.raw
  modified_base (162)..(162): a, c, t, g, unknown or other
  misc_feature (162)..(162): n is a, c, g, or t
  modified_base (208)..(208): a, c, t, g, unknown or other
  misc_feature (208)..(208): n is a, c, g, or t
  modified_base (253)..(253): a, c, t, g, unknown or other
  misc_feature (253)..(253): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtntccactcccaggtccagctggtgcaatctgggcctggaggtgaagnggcctgggtcctgggtgagggtctccgtgtaaggtctccgggaancagtgtgttcgcagacatacactcaccgttgggccggcaggccctcgtggaactgggcctggagtcggggtggaacacgtacgaccgccgaacggtccggaacaacgtagacggtcacactatcagttcgagggctaggatcactttcgagacagtcgaggcngatactanatanatactananacgacngctagtgacgacgacgcgtattattactagtcgagagagtacgtacgtcgtactacgtaacgtacgtacgacgtacgtcgtacgtccgtaccggtacggacgg

SEQ ID NO: 26203 - DNA, 294 bp, Homo sapiens
  misc_feature: GYAE6OF02IHHNX.25.36.D03.1.454.CMB.1.raw
  modified_base (289)..(294): a, c, t, g, unknown or other
  misc_feature (289)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcacatctgtcttcatcttccgccatctgactgtacagtctgacgcgggctggcaaggcgcatagnnnnnn

SEQ ID NO: 26204 - DNA, 294 bp, Homo sapiens
  misc_feature: GYAE6OF02IKRGT.25.36.D03.1.454.CMB.1.raw
  modified_base (288)..(294): a, c, t, g, unknown or other
  misc_feature (288)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgatttgcaacttattactgccaacaatataataattattcgacacttttggccagggaccaaggtgagatcaaacgaactagtggctgcaccatctgtcttcatcttcccgccatcctgaactgtacagtctgagcggctggcaaggcgcatagnnnnnnn

SEQ ID NO: 26205 - DNA, 306 bp, Homo sapiens
  misc_feature: GYAE6OF02JBJ3F.25.36.D03.1.454.CMB.1.raw
  modified_base (289)..(292): a, c, t, g, unknown or other
  misc_feature (289)..(292): n is a, c, g, or t
  modified_base (294)..(306): a, c, t, g, unknown or other
  misc_feature (294)..(306): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgccagcctgatgatttgcaacttattactgccaacaatataataattatcgaccacttttggccaggggaccaaggtggagatcaaacgaactgtgctgcaccatctgtcttcatccttcccgccatctgaactgtacatctgagcggctggcacggcgtcaatgnnnntnnnnnnnnnnnnn

SEQ ID NO: 26206 - DNA, 298 bp, Homo sapiens
  misc_feature: GYAE6OF02JCJ21.25.36.D03.1.454.CMB.1.raw
  modified_base (292)..(298): a, c, t, g, unknown or other
  misc_feature (292)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaagggcgcatagnnnnnnn

SEQ ID NO: 26207 - DNA, 296 bp, Homo sapiens
  misc_feature: GYAE6OF02JKD0H.25.36.D03.1.454.CMB.1.raw
  modified_base (290)..(296): a, c, t, g, unknown or other
  misc_feature (290)..(296): n is a, c, g, or t
tcagactgtacagtcacgaccggtgctcgatttagctgcgtcacgatctctcttggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgccaccatctgtcttcatcttcccgcatctgaactgacagtctgagcgggctgggcaaggcgcatagnnnnnnn

SEQ ID NO: 26208 - DNA, 530 bp, Homo sapiens
  misc_feature: GYAE6OF02FPLCK.25.36.D03.1.454.CMB.1.raw
  modified_base (335)..(335): a, c, t, g, unknown or other
  misc_feature (335)..(335): n is a, c, g, or t
  modified_base (461)..(461): a, c, t, g, unknown or other
  misc_feature (461)..(461): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgctactggtaccagcagctcccagaaacggcccccaagctcctcatctataggaatgatcagcggccctcagggatacctgaccgattcnctggctcgaagtctggcctcctcggcctccctggccatcaggtgggcctccggtccgaggatggaggctgaatattactgtgcgtagtttgggatgccagtctgagtggtccgtagggtgttcggnggagggaccaggctggtacccgtcgtaggtcgagcccgaaggcctccggccccctggtcccacttcccg

SEQ ID NO: 26209 - DNA, 295 bp, Homo sapiens
  misc_feature: GYAE6OF02IK9V9.25.36.D03.1.454.CMB.1.raw
  modified_base (290)..(295): a, c, t, g, unknown or other
  misc_feature (290)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccagggaccaaggtggagatcaaacgaactgtggctgcaccatctgtcttcatcttcccgccatctgaactgtacagtctgagcgggctggcaaggcgcatagnnnnnn

SEQ ID NO: 26210 - DNA, 294 bp, Homo sapiens; identical to SEQ ID NO: 25662
  misc_feature: GYAE6OF02FYY65.25.36.D03.1.454.CMB.1.raw
  modified_base (291)..(294): a, c, t, g, unknown or other
  misc_feature (291)..(294): n is a, c, g, or t

SEQ ID NO: 26211 - DNA, 716 bp, Homo sapiens
  misc_feature: GYAE6OF02HMUML.25.36.D03.1.454.CMB.1.raw
  modified_base (208)..(208): a, c, t, g, unknown or other
  misc_feature (208)..(208): n is a, c, g, or t
  modified_base (277)..(277): a, c, t, g, unknown or other
  misc_feature (277)..(277): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttcgtgggagcagctccgacgtcggaaattaagtttgtctactggtaccngcagcctcccaagaaacccggcccccaagcctcctcatcctataggaatgatcgagccggcctcgaagggactaccgtgacccgtatttcctacgtcggtcctacggtaaacgttcgtacggccttcccgtccggtccccgttccccgtcggacccctagtcccgtacgggttacggggcccgttcccggggtacccggtaagggtacgttcgggtaacggtaccgttaggtaaacgtttaactttaccgttggttacggttaccgttaagggttttcggggtaagttcgtaccgttacgttcgtagggtacggttccgggttaccggtacggggtttcgggttccggggaccggggtacggggaaacccgtaacgggtccgtccgggtaacccggttaccgttaacggggtacccgtacgggtaccccgtaaccgggg

SEQ ID NO: 26212 - DNA, 606 bp, Homo sapiens
  misc_feature: GYAE6OF02FFDIP.25.36.D03.1.454.CMB.1.raw
  modified_base (353)..(353): a, c, t, g, unknown or other
  misc_feature (353)..(353): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgaggggtctcctgtaaggtctccgggaagcagtgtgttcgtcagacatacactcaccgtgggtccggcaggcctctggactgggcctgagtgggtggacatcaaccgccacgccggaacacgagaggtcncacatcagttcgagggtcaggacgtcaccttttcggtaggacaacgtccgacgggcgcgagtatacatgaatctactaagtcgaccttgccgtagtttcggacggtacaccgggtaccgttattacgttacgtcggtacgaccgaagtaacggacgtcccgtacggtacccgttaaccgtaaaacggttcccgaaacgtacggtaccgtccgggtaccctacccgggtacccccggttagggggaacccccgg

SEQ ID NO: 26213 - DNA, 522 bp, Homo sapiens
  misc_feature: GYAE6OF02F2O3Y.25.36.D03.1.454.CMB.1.raw
  modified_base (191)..(191): a, c, t, g, unknown or other
  misc_feature (191)..(191): n is a, c, g, or t
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
  modified_base (410)..(410): a, c, t, g, unknown or other
  misc_feature (410)..(410): n is a, c, g, or t
  modified_base (458)..(458): a, c, t, g, unknown or other
  misc_feature (458)..(458): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagtcaccctcagtgtctgggacccccggnagagggtctccatctcttgttctgggagcagctccgacgtcggaaattagtttgtctactggtaccagcagctcccagaaaccggcccccaagcctcctcatctataggaatgatcagcggccctnagggatacctgaccgattctctggctcgaatctggctccncgcctcctggccatcagtgggcctccggtcgaggatgaggctgaatagttacngtgctaggttggatgccagtctggtagtggtaccgacggtgttcgggngacgggccagctgacccgtctacggtcacgcccgaggtcctccgtccccctggtccagttcccg

SEQ ID NO: 26214 - DNA, 887 bp, Homo sapiens
  misc_feature: GYAE6OF02H2Y24.25.36.D03.1.454.CMB.1.raw
  modified_base (182)..(182): a, c, t, g, unknown or other
  misc_feature (182)..(182): n is a, c, g, or t
tcagactgtacagtcacgaccggtgctcgatttagctgcgtcacgatctctcttggggagctctgggagaggagcccagcactagaagtcggcggtgttccattcggtgatcagcactgaacacagaggactcaccatggagttgggctgagctgggttttcctcgttgtcttcttttaagnggtgtccactgtcaggtgcacctggtggagtcgtgggggaggcgtggtccaggccgtgggacgtccctgacgactctcctgtgaacgcctcgtgtatttacgttcgaggttcggttctggctacgtgcctacggttcgggtaccccgccgtacggtcctacccggacgggtaccggaaacggggggtcccggtaagggttcggggttcgggtaccgttaaaggtttaacgtacggaccgtaacgtagttacggtaaggtttaacgggtaaacgtttaccgttaaggtaaaactttagttaacgttacggtacccgtaaggttaacccggtttaccccgggtaaggggtaaacccgggggtacccgttaaacttttacccgaaacccgttaaccgttaccccgttaaccggtaaaacgggtaccggtaaaacccgttaaaccgtttaccccccgggtaaaaattaccggtttaaccgggtttaacggttaaaccgtttaacgggtaaaacgtttccggggtaaccctaacgggttaaccccgttaaggggtaaacggtaaccgggttaccgggaacggggttacccgttcccggggttaacttaaccggttaacggtttaaccgtacggtttaccggagggttaaccgaacgggttagggtttacccggggggtaaggtttcggggttaaacggttttaaccgggg

SEQ ID NO: 26215 - DNA, 618 bp, Homo sapiens
  misc_feature: GYAE6OF02JGT0B.25.36.D03.1.454.CMB.1.raw
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgcgtccccaggagggacagtcactctcacctgtgcttccagcgctgggtcagtcaccagtgagaaccatccaaactggttccagcagaaacctggacaaccacccagggcactcgattacgtggtagacaaactaaaaacactcgttcgaccccgtcgtacccggttctccagcctccctccgttcggggacaaacgtctcgccctgacactgtccagtatgtcggcagcgtgacggacgaggctcgacttaccacgtcgcctcgtctcctcctcgttggtcggtgtccgttaggggttcgttaccggggacggtaacgggtacccgtaaacgtcgggtaacccgttccggtcgggttaccgacggtaccccgtaaggtcccgttaccggtccccccgttggggtacccctaccgttccgtccgtttaaccccccg

SEQ ID NO: 26216 - DNA, 296 bp, Homo sapiens; identical to SEQ ID NO: 25678
  misc_feature: GYAE6OF02GTMTM.25.36.D03.1.454.CMB.1.raw
  modified_base (290)..(296): a, c, t, g, unknown or other
  misc_feature (290)..(296): n is a, c, g, or t

SEQ ID NO: 26217 - DNA, 545 bp, Homo sapiens
  misc_feature: GYAE6OF02H72V1.25.36.D03.1.454.CMB.1.raw
  modified_base (470)..(470): a, c, t, g, unknown or other
  misc_feature (470)..(470): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtgtccccaggagggacagtcactctcacctgtgcttccagcgctgggtcagtcaccagtgagaaccatccaaaactggttccagcagaaacctggacaaccaccagggcactgattatggtgacaaactaaaaaacactacttacggacccctgccccggttctcacggtcctccctccgttgggggacaaagctcgccctgacactgtcagatgtcgcagcctggaggacgaggctagacctaccatcgcctgctcctctcgtggtgtcgcgttgggtgttcgggnggacggaccaacgtcgaccgttcgcggtcacgcccgaaggcctcgccccgtcggtccacgttcctcgttaccccc

SEQ ID NO: 26218 - DNA, 298 bp, Homo sapiens
  misc_feature: GYAE6OF02HTC2T.25.36.D03.1.454.CMB.1.raw
  modified_base (285)..(285): a, c, t, g, unknown or other
  misc_feature (285)..(285): n is a, c, g, or t
  modified_base (291)..(298): a, c, t, g, unknown or other
  misc_feature (291)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccagggaccaaggtggagatcaaacgaactgtggctgcaccatctgtcttcattcttcccgccatctgaactgtacagtctgagcgggctggcaaggcncatagnnnnnnnn

SEQ ID NO: 26219 - DNA, 382 bp, Homo sapiens
  misc_feature: GYAE6OF02I7PA5.25.36.D03.1.454.CMB.1.raw
  modified_base (330)..(330): a, c, t, g, unknown or other
  misc_feature (330)..(330): n is a, c, g, or t
  modified_base (340)..(382): a, c, t, g, unknown or other
  misc_feature (340)..(382): n is a, c, g, or t
tcagactgtacagtcacgaccggtgctcgatttagctgcgtcacgagtctctcttgggatagaagttattcagcaggacacacaacagaggcagttcccagaattcactctcaccatcagcagcctgcagcctgatgattttgctaaccttattacctgccaacaatataataattattcgaccacgtttttggaccaggggtaccaaaggtggacgagtcaaaaggaactgtaggctgcaccgatctgtcttcattccttccccgctaatcctgaaacctgtacgagtcctggagccgggtcctgggcaaacgggtcaacgataggctnagcagccagnnnnnnnnnnnnnnnnnnnnnnnnnnnnnnnnnnnnnnnnnnn

SEQ ID NO: 26220 - DNA, 678 bp, Homo sapiens
  misc_feature: GYAE6OF02G40SF.25.36.D03.1.454.CMB.1.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttctgggancagctccgacgtcggaaataagtttgtctactggtaccagcagcctcccagaaaccggcccccaagcctcctcatctataggaatgatcagccggccctcgagggactaccgtcgaccgtatttctcgtggactacgaacgtcgtcggtcctccgtccggcccttccccgtgggccctagtctacggtcgggccttcccgggtccggaggtagtcgggacggtctagaaatttacgttaccttggtcggtaccgttaggggttttcggggaacgttcggtacccgtaaggttccgttagggtacgggtttccggggtacccgggttacggggtttcgggttccgggggaccggggtaacggggtaccccgtaagggtcccggttaccgggtaaccccggtttccggtaacgggttcccgaccgggtacccccggtaacgggg

SEQ ID NO: 26221 - DNA, 300 bp, Homo sapiens
  misc_feature: GYAE6OF02GPY39.25.36.D03.1.454.CMB.1.raw
  modified_base (289)..(300): a, c, t, g, unknown or other
  misc_feature (289)..(300): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggccaggggaccaaggtggagatcaaacgaactgtggctgacaccatctgtcttcatcttcccgcatctgaactgtacagtctgagcggctggcaaggcgcatagnnnnnnnnnnnn

SEQ ID NO: 26222 - DNA, 296 bp, Homo sapiens
  misc_feature: GYAE6OF02IFC9T.25.36.D03.1.454.CMB.1.raw
  modified_base (290)..(296): a, c, t, g, unknown or other
  misc_feature (290)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgactgtacagtctgagcgggctggcaaggcgcatagnnnnnnn

SEQ ID NO: 26223 - DNA, 653 bp, Homo sapiens
  misc_feature: GYAE6OF02F8N0U.25.36.D03.1.454.CMB.1.raw
  modified_base (409)..(409): a, c, t, g, unknown or other
  misc_feature (409)..(409): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
tcagactgtacagtcacgaccggtgctcgatttagctgcgtcacgaggtctcttccttggggattacgaagtttattcagcaggcacacaacaataggcaggttcccagaacttcacgtcttcgacccatcagcgagttccctttggccagttaacccgtgactggatttttggactaacttattacgtgccgaacgaatataaggtaagttatttcggacccacgttttcggccgaggggaccgaacggtggaggaacttccaaaaccgaacgttgtcgggactcgtccacccgaattcctaggtccttttcgaattccgttaccccgtcctagtcctagaacctgtaacctaggttccgtgaaggccgggtcctagggggacgaacgggtcggaccgtaggtacggnagtatagtcgatagtgtagataggactgtgcggatntgngagcgacgtcgacgacncnctcgacgacgacaacgacgactactacctagtactactacaactacgacgtacgtacgtacgagacgcgtagaggacgtacgtacgttacgttacgttacgtacgtacgagtaagtacgttagttaaggttagtacggtagtacgtacgttacgttacgtacggttaggtacggtacgtcgtacgg

SEQ ID NO: 26224 - DNA, 298 bp, Homo sapiens; identical to SEQ ID NO: 25881
  misc_feature: GYAE6OF02I3YVQ.25.36.D03.1.454.CMB.1.raw
  modified_base (290)..(298): a, c, t, g, unknown or other
  misc_feature (290)..(298): n is a, c, g, or t

SEQ ID NO: 26225 - DNA, 293 bp, Homo sapiens
  misc_feature: GYAE6OF02IO52M.25.36.D03.1.454.CMB.1.raw
  modified_base (280)..(280): a, c, t, g, unknown or other
  misc_feature (280)..(280): n is a, c, g, or t
  modified_base (286)..(293): a, c, t, g, unknown or other
  misc_feature (286)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattatcgaccacttttgccagggaccaaggtggagatacaaacgaactgtaggctgcaccatctgtcttcatcttccgcatctgaactgtacagtctgagcggctgcaaggcncatagnnnnnnnn

SEQ ID NO: 26226 - DNA, 742 bp, Homo sapiens
  misc_feature: GYAE6OF02J27TV.25.36.D03.1.454.CMB.1.raw
  modified_base (171)..(171): a, c, t, g, unknown or other
  misc_feature (171)..(171): n is a, c, g, or t
  modified_base (219)..(219): a, c, t, g, unknown or other
  misc_feature (219)..(219): n is a, c, g, or t
  modified_base (387)..(387): a, c, t, g, unknown or other
  misc_feature (387)..(387): n is a, c, g, or t
  modified_base (483)..(483): a, c, t, g, unknown or other
  misc_feature (483)..(483): n is a, c, g, or t
tcagactgtacagtcacgaccggtgctcgatttagctgcgtcacgatctctcttggggcagaagtctctctcagtcaggacacagcatggacatgaggtcctgctcagctcctggactctgctgctctggctccagactaccagatcgtacgcgtaccgagactcgaaccngtcctcctactcctcctcgtctcgctactcgttggtacggacacgaanactacgacgtactactccgtacgttcgggaccggtacgtacggtacggacggtactaacgttaccgtaacttaacgtttacgttaaccgcgttaacggtaacctaacgaaacgaacgaacggtaaggtacgtaaccgtacgtacgtcctacgtcgtactactacgtcncgtaccgtcctacgtacttcgacgtacggtaccggtctacgtcgtacgtcgacggtcgagtacgtacgacgtcggacgttacacgttacgttaccncgttactacgaacgtcgacggaccacggtacctcgaacgtccgaacgttacgtaaacgtcggttaacgtttcgtaacgttaaccgtttaaacgttaaccgttaagaaaccggtttaacttaaaaccggttccttaaaaccggtcccgtttaaacccggtccctttacggttaaacccgggttaccgggtaacggggtaccggttaaaaccggggtacggttaacggtaaccggtaaacggtttaccttaaaacccgggg

SEQ ID NO: 26227 - DNA, 309 bp, Homo sapiens
  misc_feature: GYAE6OF02GYSM7.25.36.D03.1.454.CMB.1.raw
  modified_base (293)..(309): a, c, t, g, unknown or other
  misc_feature (293)..(309): n is a, c, g, or t
tcagactgtacagtcacgaccggtgctcgatttagctgcgtcacgagtctctcttgggatagaagttattcagcaggcacacaacagaggcagttccagaattcactctcaccatcagcagcctgcagcctgatgattttgctaacttattactgccaacaatataataattattcgaccacttttggccaggggaccaaggtgagatcaaacgactgtggctgcaccatctgtcttcatcttcccgcatctgaactgtacagtctgacgcgggctggcaagggcgcagtagnnnnnnnnnnnnnnnnn

SEQ ID NO: 26228 - DNA, 301 bp, Homo sapiens
  misc_feature: GYAE6OF02ILW8K.25.36.D03.1.454.CMB.1.raw
  modified_base (159)..(159): a, c, t, g, unknown or other
  misc_feature (159)..(159): n is a, c, g, or t
  modified_base (203)..(203): a, c, t, g, unknown or other
  misc_feature (203)..(203): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (294)..(301): a, c, t, g, unknown or other
  misc_feature (294)..(301): n is a, c, g, or t
tcagactgtacagtcacgaccggtgctcgatttagctgcgtcacgatctctcttggatagaagttattcagcaggcacacaacagagcagttccagaattcactctcaccatcagctacgcctgcagtcctgatgatttgctacttattactgaccaanaatataaatactattcgactactttggcagggacaaggtgacgntacgaacgaatgtcggatgcaccatcgtgtctcatctccggcatctggaactgtacagtctgagtcggctaggacttagcgntatagnacnnnnnnnn

SEQ ID NO: 26229 - DNA, 296 bp, Homo sapiens
  misc_feature: GYAE6OF02HT6AI.25.36.D03.1.454.CMB.1.raw
  modified_base (236)..(236): a, c, t, g, unknown or other
  misc_feature (236)..(236): n is a, c, g, or t
  modified_base (289)..(296): a, c, t, g, unknown or other
  misc_feature (289)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacacttttggccagggaccaaggtggagatcaaacgaactgtggctgcaccatctgtcttnactcttccgcatctgaactgtacagtctgacgcgggctggcaaggcgcatagnnnnnnnn

SEQ ID NO: 26230 - DNA, 613 bp, Homo sapiens
  misc_feature: GYAE6OF02GS8DW.25.36.D03.1.454.CMB.1.raw
  modified_base (222)..(222): a, c, t, g, unknown or other
  misc_feature (222)..(222): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctcgggacccccgggcaggagggtctccatctcttgttctgggancagctccgacgtcggaaattagtttgtctactggtaccagcagcctccagaaccggcccccaagctcctcatctataggatgatcagccgccctgagggactacctgaccgtattcctcgtggctcgaagttctcggcctccgtcggccctcccgtggcctatcgaggtcgggccgtccgggtacgaggatggagtctagtaatagttacgtgtgtcgtaggttggatcgccgtagtcgtaggtaggttcgggtacccggtagggtttcggtaccgggacgggtacgggtaacccgaggtccgtacgggtaacccggttccggtacgggtccgacggtacccgaacgggtccctcccggtccccccgttcggtaccctacccgttccccgg

SEQ ID NO: 26231 - DNA, 295 bp, Homo sapiens; identical to SEQ ID NO: 25691
  misc_feature: GYAE6OF02IFZ0R.25.36.D03.1.454.CMB.1.raw
  modified_base (291)..(295): a, c, t, g, unknown or other
  misc_feature (291)..(295): n is a, c, g, or t

SEQ ID NO: 26232 - DNA, 573 bp, Homo sapiens
  misc_feature: GYAE6OF02JBVZY.25.36.D03.1.454.CMB.1.raw
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatcctcttgttctgggancagctccgacgtcggaaataagttgtctactggtaccagcagctcccagaaaccggcccccaagcctcctcatctataggaatgatcagccggccctcagggactacctgaccgatttctcgtggcctacgaagtctggctccgtcggccctccctggccagtcagtcgggctcccgggtccgaggtacgtgacggtctagaattatttacgtgtgacgttaggtttgggatcgacctaggtctggagtcgggtaccggtaggtcggttcgggacgggtacgggaccctaaggccgttacggacccggttccgtagggtcaccggcccgtaaccggg

SEQ ID NO: 26233 - DNA, 174 bp, Homo sapiens
  misc_feature: GYAE6OF02GVOZX.25.36.D03.1.454.CMB.1.raw
  modified_base (172)..(174): a, c, t, g, unknown or other
  misc_feature (172)..(174): n is a, c, g, or t
tcagactgtacagtcacgaccggtgctcgatttagctgcgtcacgatctctcttgggtattcggcggagggaccaagctgaccgtcctaagtcagcccaaggctgccccctcggtcactctgttcccaccctcctcactgtacagtctgagcgggctggcaaggcgcatagnnn

SEQ ID NO: 26234 - DNA, 295 bp, Homo sapiens
  misc_feature: GYAE6OF02I7PTL.25.36.D03.1.454.CMB.1.raw
  modified_base (282)..(282): a, c, t, g, unknown or other
  misc_feature (282)..(282): n is a, c, g, or t
  modified_base (287)..(295): a, c, t, g, unknown or other
  misc_feature (287)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattatcgaccacttttggccaggggaccaaggtggagatcaaacgaactgtggctgcaccatctgtcttcatcttcccgccatctgaactgtacagtctgagcggctggcaggcnatagnnnnnnnnn

SEQ ID NO: 26235 - DNA, 294 bp, Homo sapiens
  misc_feature: GYAE6OF02HW94W.25.36.D03.1.454.CMB.1.raw
  modified_base (290)..(294): a, c, t, g, unknown or other
  misc_feature (290)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcggctggcaaggcgcatagnnnnn

SEQ ID NO: 26236 - DNA, 569 bp, Homo sapiens
  misc_feature: GYAE6OF02JLULF.25.36.D03.1.454.CMB.1.raw
  modified_base (200)..(200): a, c, t, g, unknown or other
  misc_feature (200)..(200): n is a, c, g, or t
tcagactgtacagtcacgaccggtgctcgatttagctgcgtcacgatctctcttggggcagaagtctctctcagtcaggacacagcatggacatgaggtccctgctcagctcctggactctgctgctctggctacccagataccagatgtgacgtccagatgacccagtctccatccgtcctgtctgacatctgttgganacagatcagcatcacttgcgcgagtcaggcgatagcattattagtctgggggtatacaacagtaacgaggagtagtactacgtactactgtacgtactactacgtctacgctcctacgtactactacgtacggtccgtactctcgttcgtacgtcgtacgacgtacgacgtcgtacggtacgtacgtacgtcgtactctctactactacgtacgcgtacgcgtcgtcacgtacgtacgtacgagtacgttagtacgtaacttacgttacttacgttacgtaaacgtattaacgtacgtaccgtacctacctaccgttaccgttacgtaccggtaacggtaccgtaacggtacggtacgtacgtaaccgg

SEQ ID NO: 26237 - DNA, 291 bp, Homo sapiens
  misc_feature: GYAE6OF02FHK1G.25.36.D03.1.454.CMB.1.raw
  modified_base (290)..(291): a, c, t, g, unknown or other
  misc_feature (290)..(291): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctggcaaggcgcatagnn

SEQ ID NO: 26238 - DNA, 301 bp, Homo sapiens
  misc_feature: GYAE6OF02HOMBP.25.36.D03.1.454.CMB.1.raw
  modified_base (293)..(301): a, c, t, g, unknown or other
  misc_feature (293)..(301): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatacaaacgaactgtggctgcaccatctgtcttcatcttcccgccatctgaactgtacagtctgagcgggctggcaaggcgacatagnnnnnnnnn

SEQ ID NO: 26239 - DNA, 294 bp, Homo sapiens; identical to SEQ ID NO: 26235
  misc_feature: GYAE6OF02H7EV8.25.36.D03.1.454.CMB.1.raw
  modified_base (290)..(294): a, c, t, g, unknown or other
  misc_feature (290)..(294): n is a, c, g, or t

SEQ ID NO: 26240 - DNA, 295 bp, Homo sapiens; identical to SEQ ID NO: 25691
  misc_feature: GYAE6OF02G3SUR.25.36.D03.1.454.CMB.1.raw
  modified_base (291)..(295): a, c, t, g, unknown or other
  misc_feature (291)..(295): n is a, c, g, or t

SEQ ID NO: 26241 - DNA, 344 bp, Homo sapiens
  misc_feature: GYAE6OF02JDU4G.25.36.D03.1.454.CMB.1.raw
  modified_base (162)..(162): a, c, t, g, unknown or other
  misc_feature (162)..(162): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (306)..(307): a, c, t, g, unknown or other
  misc_feature (306)..(307): n is a, c, g, or t
  modified_base (310)..(344): a, c, t, g, unknown or other
  misc_feature (310)..(344): n is a, c, g, or t
tcagactgtacagtcacgaccggtgctcgatttagctgcgtcacgatctctcttgggatagaagttattcagcaggcacacaacagaggcagttccagaattcactctcaccatcagcgagcctgcagcctgatgtattttgacaacttattactgccaaanaatataataagttattcgacctagttttggccaggggaccaaaggtggagatacaaagaactgtggactgcaccatctgtctcatctccgccatcagaactgtacngtctggagccgggntgggccaaagggccgtacataggnnctnnnnnnnnnnnnnnnnnnnnnnnnnnnnnnnnnnn

SEQ ID NO: 26242 - DNA, 298 bp, Homo sapiens
  misc_feature: GYAE6OF02JCS03.25.36.D03.1.454.CMB.1.raw
  modified_base (292)..(298): a, c, t, g, unknown or other
  misc_feature (292)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatacaaacgaactgtaggctgcaccatctgtcttcatcttcccgccatctgaactgtacagtctgagcggctggcaaggcgcatagnnnnnnn

SEQ ID NO: 26243 - DNA, 294 bp, Homo sapiens
  misc_feature: GYAE6OF02HR6N7.25.36.D03.1.454.CMB.1.raw
  modified_base (288)..(294): a, c, t, g, unknown or other
  misc_feature (288)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccagggaccaaggtggagatcaaacgaactgtggctgcaccatctgtcttcatcttccgccatctgaactgtacagtctgagcggctggcaaggcgcatagnnnnnnn

SEQ ID NO: 26244 - DNA, 300 bp, Homo sapiens
  misc_feature: GYAE6OF02I33XW.25.36.D03.1.454.CMB.1.raw
  modified_base (291)..(300): a, c, t, g, unknown or other
  misc_feature (291)..(300): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgatttgcaacttattactgccaacaatataataattattcgaccacttttggccaggggaccaaggtggagatcaaacgaactgtggctgcaccatctgtcttcatcttcccgccatctgaactgtacagtctgacgcgggctggcaaggcgcatagnnnnnnnnnn

SEQ ID NO: 26245 - DNA, 690 bp, Homo sapiens
  misc_feature: GYAE6OF02FHNT6.25.36.D03.1.454.CMB.1.raw
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtactgacgcagccgccctcagtgtctggggccccaggcgagagggtcaccatctcctgcactggggacagttccaatatcggggcaccttataatgttcactggtatcaacaacttccagggacacgacccccaaactcgtcattcatgctgataacaatcgtcctcaggtcgtccctgaccgattccgtccggctaccaagtctcggaccacctcacgtccctcccgtcggtacacgttccaccgtcgggcctccgacgtaccgttaggaacggtacgttagggaaacgggttgtaacttttaaccttaccgttacggtaccctaaggtttacccttaagttaccgaaacctaaaccgacggtacccgttagggtccggttttcggggttttacgggtttacccgggtttccgggggtacccgggggtaacccgggggtaacccgtaaagggggttccggttacccggtttaccggttaacccgttaaacgggttcccgtaaaccgggttaaccccccggg

SEQ ID NO: 26246 - DNA, 599 bp, Homo sapiens
  misc_feature: GYAE6OF02FS8BM.25.36.D03.1.454.CMB.1.raw
  modified_base (271)..(271): a, c, t, g, unknown or other
  misc_feature (271)..(271): n is a, c, g, or t
tcagactgtacagtcacgaccggtgctcgatttagctgcgtcacgagtctctcttggggagctctgggagaggagccccagccctgagattcccaggtgtttccattcagtgatcagcactgaacacagaggactcaccatggagttgggactgagctggattttcctttggctatttaaaggtgtccagtgtgaagtgcaactggtggagtcgtgggggagcttggtacagcctggcaggcccctagacgactctacctgtagcagcctntggacttaccacctttgactgtattatgcctatgctagtcgggtccgacaagtcctcgaaggggacggcctggaggtgggtctgacggtagttaggttggaataggtggtagctagtaggctagtcgacggtactcgtggtagaacgggtcctattaccaccgtatctaccgagacgtaccaacgtacccaaagacccttcctagtactcgtacgacgtaacggttcgaactcgtactaggacctaccgttgaacgttcggaaccctacccgttacgtttagttaacgtttacgttcggttaggtacggtaaacgggtcggtttacgg

SEQ ID NO: 26247 - DNA, 844 bp, Homo sapiens
  misc_feature: GYAE6OF02JXZJ0.25.36.D03.1.454.CMB.1.raw
  modified_base (206)..(206): a, c, t, g, unknown or other
  misc_feature (206)..(206): n is a, c, g, or t
  modified_base (230)..(230): a, c, t, g, unknown or other
  misc_feature (230)..(230): n is a, c, g, or t
tcagactgtacagtcacgaccggtgctcgatttagctgcgtcacgatctctcttggggcagaagtctctctcagtcaggacacagcatggacatgagggtccctgctcagctcctgggactcctgctgctctggctcccagactaccagatgtgacgtccagatgacccagtctccatcctccctgtacctgcatccttgtcgganacagaatcagcatcacttgccggngacgtcgagggcagttacgcgtaaattagtttaacgccgtaggttaactacaaacgtaacgaaaaccgagggtaacgtacgtttaccgtaaacgtaccgttacccttaaggtacttacgttaacgttcggtaaccttccgggtaccccttacccgttaaacccgggtttaacctaaccgtttaccgggtaacccgggggtttaccccctaacgtttacccggttcccgggttttaaccaaaccggggttcccgggaacgttacggttaaccggtaacgtttaccggtacgggtaaaccgtacgggtaacgtttaccggaacctttaccgtaaccgtaaccttacgttaccgtaacgtaccgaacggtacccgtacgacctaccgggtaacctaacggttaaacgtaccgttacggtttaaccggaaccttaaaaccgttttaacttaaacccgttacggttaaaacctaaaagggtttaacttaaccgtttaaccgtacccggtttacccccctttaagttaaccccggtttaccgtttaccggggtaacccgggttaaccggggtaacccggttaaagggtaccgggttaaagtaacccggttaaaacccggg

SEQ ID NO: 26248 - DNA, 296 bp, Homo sapiens
  misc_feature: GYAE6OF02IEL6J.25.36.D03.1.454.CMB.1.raw
  modified_base (285)..(285): a, c, t, g, unknown or other
  misc_feature (285)..(285): n is a, c, g, or t
  modified_base (291)..(296): a, c, t, g, unknown or other
  misc_feature (291)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggcaaggcncatagnnnnnn

SEQ ID NO: 26249 - DNA, 295 bp, Homo sapiens
  misc_feature: GYAE6OF02GO6R7.25.36.D03.1.454.CMB.1.raw
  modified_base (289)..(295): a, c, t, g, unknown or other
  misc_feature (289)..(295): n is a, c, g, or t
tcagactgtacagtcacgaccggtgctcgatttagctgcgtcacgatcgtctcttgggatagaagttattcagcaggcacacaacagaggcagttccagaattcactctcaccatcagcagcctgcagcctgatgattttgcaacttattactgccaacaatataataattatcgaccacttttggccagggaccaaggtggagatacaaacgaactgtggctgcaccatctgtctcatcctcccgcatctgaactgtacagtctgagcgggctggcaaggcgcatagnnnnnnn

SEQ ID NO: 26250 - DNA, 621 bp, Homo sapiens
  misc_feature: GYAE6OF02GHCW3.25.36.D03.1.454.CMB.1.raw
  modified_base (193)..(193): a, c, t, g, unknown or other
  misc_feature (193)..(193): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (411)..(411): a, c, t, g, unknown or other
  misc_feature (411)..(411): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctggggacccccgggnagagggtctccatctcttgttctgggagcagctccgacgtcggaaataagtttgctactggtaccagcagctccaagaaaccgccccaagctccnatctanaggaatgatcagccggccctgagggactaccgtgaccgtattcctctggctacggaagtcgtggctccgtccggccctcccgtcggcctatcgaggtcgggcctccgggtccgaggntggagcgtagaactagttactgtcgcgttaggtttggggattcggacctagttccgtaggtacggtcgggttaccggacgggttggttaccggggacgggtaacgggacccaggccgtcggtaaccccgttccgttaacgggtccaaccgggaccccgtaagggtcccgtaccccggtacccccccgttcgggtaccctaccgtttcccg

SEQ ID NO: 26251 - DNA, 543 bp, Homo sapiens
  misc_feature: GYAE6OF02ITK9Q.25.36.D03.1.454.CMB.1.raw
  modified_base (207)..(207): a, c, t, g, unknown or other
  misc_feature (207)..(207): n is a, c, g, or t
  modified_base (223)..(223): a, c, t, g, unknown or other
  misc_feature (223)..(223): n is a, c, g, or t
tcagactgtacagtcacgaccggtgctcgatttagctgcgtcacgatctctcttggggagcttcagctgtggtagagaagacaggattcaggacaatctccagcatgaccggcctccctctcctcctcaccctcctcactcactgtgcagggtcctgggcccagtctgtgctgactcagccaccctcagtgtctgggacccccgggnagagggtctccatctnttgttcgtgggagcagctccgacgtcggaaataagtttgtctactggtaccagcagctccccagaaaccggcccccaagctcctcatctataggaatgatcagcggccctgagggactacctgaccgtatttcctactggctcgaagtctggctccgtcgcctcccgtggccatcgagtggccgtccggccgaggatcggaggcctagaattattacgtggttgcgttaggtttgggatcgacctagtcgtgacgtggtccggtacggtcggttcggcgggagggaccgaagcgtcgaccgtcgtaggcacgcctaacgg

SEQ ID NO: 26252 - DNA, 299 bp, Homo sapiens; identical to SEQ ID NO: 25729
  misc_feature: GYAE6OF02GQDKP.25.36.D03.1.454.CMB.1.raw
  modified_base (291)..(299): a, c, t, g, unknown or other
  misc_feature (291)..(299): n is a, c, g, or t

SEQ ID NO: 26253 - DNA, 307 bp, Homo sapiens
  misc_feature: GYAE6OF02G24LZ.25.36.D03.1.454.CMB.1.raw
  modified_base (293)..(307): a, c, t, g, unknown or other
  misc_feature (293)..(307): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctgggcaaggcgcagtagnnnnnnnnnnnnnnn

SEQ ID NO: 26254 - DNA, 710 bp, Homo sapiens
  misc_feature: GYAE6OF02GU8NA.25.36.D03.1.454.CMB.1.raw
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctcctgtctgcatctgtgganacagtatcagcatcacttggccggcgagtccagggcagttagctaattattagctggtatacaactacgaaaccgaggagtacgtactaacgctcctactatctagtnctgctactacctacttgtactaacgtttcggggtcccttctcggttacttacggacggtcgggaccgtagggtcgggttaccgtaggggaacctaacggtaaacgtttccgtaacctaccgtacctaaaccgagttaccgaacgccctaaccgggtccttacggtaccgaccgttacccggttaggaaaacgttcgtttacgttacggtaacccttaaacgttttaccttaaacggtttacttaaaacgtttaaaaaccgttttacggaaccggtacgttaaaccccgggggtaacccggttaggttaacccgttttacggggttaccccgggtaacccccgggtaagggtaaacccggttaaaccgggggttacggttaaaccgtaacgttaaaaacccgg

SEQ ID NO: 26255 - DNA, 763 bp, Homo sapiens
  misc_feature: GYAE6OF02JGAOM.25.36.D03.1.454.CMB.1.raw
  modified_base (239)..(239): a, c, t, g, unknown or other
  misc_feature (239)..(239): n is a, c, g, or t
  modified_base (738)..(738): a, c, t, g, unknown or other
  misc_feature (738)..(738): n is a, c, g, or t
  modified_base (740)..(740): a, c, t, g, unknown or other
  misc_feature (740)..(740): n is a, c, g, or t
  modified_base (746)..(746): a, c, t, g, unknown or other
  misc_feature (746)..(746): n is a, c, g, or t
  modified_base (757)..(757): a, c, t, g, unknown or other
  misc_feature (757)..(757): n is a, c, g, or t
  modified_base (759)..(759): a, c, t, g, unknown or other
  misc_feature (759)..(759): n is a, c, g, or t
tcagactgtacagtcacgaccggtgctcgatttagctgcgtcacgatctctcttgggcagtccaggggaggcctgaagtgggtcggcctcatgagaccgagggcctctgggagggacaggtggagcatgacgcgtctctgatgggcaggttcagcctctcaagggacgactctaaagccatcgcctatctgcaaatgaccagcctgacagtcgaagactcagccaattctattagttgngacgagactcgcctgtctccgtagttcggggtacttagtcggacgaacttacttacacctttaacttccccaactacgttcgggtaccggttttacgggggccgtaaaacgggggccctaaccggggttctaacgttccggttaccctccccgttaccaaccccttacccgaacccgtaaccggggtacccctaacgttcccgggttacccttttccccccccgcggggtaccccctaacccccgttcccgtaccctaaaacgggcccggtaccccgtaaccccggttacccggttccgggggggaccctacccggtaacgggtcccgggtccccgggttcggggtcccggtccgtacccggttccgggttaaccgtaaccggtaccgttaacccgttcccgtaaccgttaccgttaaccgtaaccggttccgttacgggtacccggtaccggggccgttacgggacgtaaccgggtacggaccgtacgtagggtccgngngcgcgngcgcgcgcgcncngtgc

SEQ ID NO: 26256 - DNA, 543 bp, Homo sapiens
  misc_feature: GYAE6OF02IR8D5.25.36.D03.1.454.CMB.1.raw
  modified_base (317)..(317): a, c, t, g, unknown or other
  misc_feature (317)..(317): n is a, c, g, or t
  modified_base (487)..(487): a, c, t, g, unknown or other
  misc_feature (487)..(487): n is a, c, g, or t
tcagactgtacagtcacgaccggtgctcgatttagctgcgtcacgatctctcttgggtctggcgccaggggtcccttccaatatcagcaccatggcctggactcctctctttctgttcctcctcacttgctgcccagggtccaaatctcagactgtggtgactcaggagccctcactgactgtgtccccaggagggacagtcactctcacctgtgcttccagcgctgggtcagtcaccagtgagaaccatccaaactggttccagcagaacctggacaaccacccaggcactgatttagtggtgacaactaaaaacnctacttcggacccctgcccgttctcacggctccctccgttggggcaacgctgccctgactactgtcagtactgtcgctagcctgaggcgacggctacgactacgactcgcctgcctctctcgtgtgtcgtcgttgggtcgtcggcggtaggacctaagtcgaccgttcgnggtaccacgtccgaacggtctaccggcccgttacgtccacgttcctcgttaccccg

SEQ ID NO: 26257 - DNA, 599 bp, Homo sapiens
  misc_feature: GYAE6OF02IMMRA.25.36.D03.1.454.CMB.1.raw
  modified_base (207)..(207): a, c, t, g, unknown or other
  misc_feature (207)..(207): n is a, c, g, or t
  modified_base (342)..(342): a, c, t, g, unknown or other
  misc_feature (342)..(342): n is a, c, g, or t
tcagactgtacagtcacgaccggtgctcgatttagctgcgtcacgatctctcttggggagcttcagctgtggtagagaagacaggattcaggacaatctccagcatggccggcctcctctctcctcaccctcctcactcactgtgcagggtcctgggcccagtctgtgctgactcagcctaccctcagtgtctcggggacccccggnaaggcgggtcctccattcctcttgttccgtgggaacgcagctccgacgtcggaaatagtttgtctactggtacagcagctccagaaccgccccagctcctcatctatagatgatcacgcgcctgaggtataccgngaccgatttctcgtacggtctcggtaatcgtcgtactcctacggtccctcccgtcggccctactcgtaggtccggcgtcccgggttacggaggtacgtcggacggtcgtaaggtaactacgttacgttcgtcgtaccgttggtttacggagtcgaccgtaggtcgtggtagtcggtcggtaacggttcggttcgggcggtaaccgggacgtaacggtgtacgtccggtaccgttcggtacgccggaccgtaaccggg

SEQ ID NO: 26258 - DNA, 592 bp, Homo sapiens
  misc_feature: GYAE6OF02GWKZE.25.36.D03.1.454.CMB.1.raw
  modified_base (219)..(219): a, c, t, g, unknown or other
  misc_feature (219)..(219): n is a, c, g, or t
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctggcctgactcaacctgcctccgtgtctgggtctccgtggacggtcaatcacctatttccngcactggaaccagcactgatgttggctacttgaccttgtctcttggtaccaacaacacccgacaagctaccaactcaataattttgagtaccagtaacgccggccctcgtgggtttctagtcgattcactggctacaagtctgcaacgacgtcctaccctaacactctcgtacgggcctacgacggctaggaacggacgaggtcttagtttactttcgtagtcttgttgtcttatggtgtactagtaaactagtttcggtgtcgtcgggtacgggacggtaccgtaagttggacccgttattaacgtcgtaacgaccgtaacggtcctccgtccccgtcggtacctaccgtccgttcccgttccccgtccccg

SEQ ID NO: 26259 - DNA, 556 bp, Homo sapiens
  misc_feature: GYAE6OF02F1S5X.25.36.D03.1.454.CMB.1.raw
  modified_base (380)..(380): a, c, t, g, unknown or other
  misc_feature (380)..(380): n is a, c, g, or t
  modified_base (417)..(417): a, c, t, g, unknown or other
  misc_feature (417)..(417): n is a, c, g, or t
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggattttccttttggctattttaaaaggtgtccactgtgaggtgcagctggtggagtcgtgggggaggcttggtgaaaccgtgggggatcccgtcagactctcctgtgcagcctctaggttccctttcaagaacgcctggatgagttggtccgcaggctccgagggagggctggagtgggttggcgtattagaccaatagtgaaggtggacaagagactacgntgcatccgtagaagacagattcacatctagaagggangattacgaaacgaccgacgtctagtatctgacagatagaacagccgtagaaggtcgaaggacacgaacggtccgttaatttacgtacgttaccttcgttagaaacgtccgtaacggtcggggtacctaggtacccgggg

SEQ ID NO: 26260 - DNA, 557 bp, Homo sapiens
  misc_feature: GYAE6OF02H43BC.25.36.D03.1.454.CMB.1.raw
  modified_base (217)..(217): a, c, t, g, unknown or other
  misc_feature (217)..(217): n is a, c, g, or t
  modified_base (312)..(312): a, c, t, g, unknown or other
  misc_feature (312)..(312): n is a, c, g, or t
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggcttactttgacttgtctcttggtaccaacaacacccggacaaaggctaccaaacctcattaatttttganaccagtaagcggccctcgtgggtttctagtcgattcactggctcaagtctggcaacacgcctccctaacatctctggctcagctagagacgaggctagtttatttcgtgcttgtgtcttatgtgacgttagaaaatagtttggtgtcgttcggacggagggaccctagttcgaccgttacgttacgtcacgtcccgaaggtctaccgccccgttcggctacccgtcttcccgttccctacccccg

SEQ ID NO: 26261 - DNA, 582 bp, Homo sapiens
  misc_feature: GYAE6OF02FL6OT.25.36.D03.1.454.CMB.1.raw
  modified_base (513)..(513): a, c, t, g, unknown or other
  misc_feature (513)..(513): n is a, c, g, or t
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggattttccttttggctattttaaaaggtgtccagtgtgaagtgcaactggtggagtcgtgggggaggcttggtacagcctggcaggcccctgagactctcctgtgcagcctctggattcacctttgatgattatgccatgcacgtgggtccgcaagctccgaggggacggcctggagtgggtctcgaggttattagtggaataggtggtagcagtaggctagtggcggacttcgtggtaggaacggggtcccgtaattcccaaccctattcccgtacccaaggacgaaccaaaccgcccaaagtaaccctcccgtagttactccttagactaaaagtcgaaactagtctaggganagacgtaggaacggaccgtacggtcctttaggtaacttacgtgtagtaacttaaaaatttacgttaacg

SEQ ID NO: 26262 - DNA, 297 bp, Homo sapiens
  misc_feature: GYAE6OF02ID486.25.36.D03.1.454.CMB.1.raw
  modified_base (267)..(267): a, c, t, g, unknown or other
  misc_feature (267)..(267): n is a, c, g, or t
  modified_base (292)..(297): a, c, t, g, unknown or other
  misc_feature (292)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcacttattactgccaacaatataataattattcgaccacttttggccaggggaccaaggtggagatcaaacgaactgtggctgcaccatctgtcttcatcttcccgccatctgaacctgtacagtcngagcgggctggcaagggcgcatagnnnnnn

SEQ ID NO: 26263 - DNA, 295 bp, Homo sapiens; identical to SEQ ID NO: 25656
  misc_feature: GYAE6OF02FUVBC.25.36.D03.1.454.CMB.1.raw
  modified_base (290)..(295): a, c, t, g, unknown or other
  misc_feature (290)..(295): n is a, c, g, or t

SEQ ID NO: 26264 - DNA, 592 bp, Homo sapiens
  misc_feature: GYAE6OF02F58UO.25.36.D03.1.454.CMB.1.raw
  modified_base (170)..(170): a, c, t, g, unknown or other
  misc_feature (170)..(170): n is a, c, g, or t
  modified_base (201)..(201): a, c, t, g, unknown or other
  misc_feature (201)..(201): n is a, c, g, or t
  modified_base (367)..(367): a, c, t, g, unknown or other
  misc_feature (367)..(367): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccngtctccatcctccctgtctgcatctgtgganacagatcagcatcacgttgccgggcgagtcgagggcattagctaattatttacgccttaggtatcctaaacgaggaaaccgagggtagagttacctaagctccgtgatcgtatgctcgcctcacgttacactcgagggtcccagtctcggttcacggcggcagtanacgtcgtgggacagtagttcactctacctatactcacgcacgtccgtagccacggcctaggaacgtagttcgttcgtaaccttaactttaacgtttacgtagtaaacctaaaagtttactaaacttaccgttaccgtacccccttacgttacccgttaccgtttaccggggaccgggtaacgggttaaccggaaggggttacgggtaccgtaacttaaacccggg

SEQ ID NO: 26265 - DNA, 655 bp, Homo sapiens
  misc_feature: GYAE6OF02HFG45.25.36.D03.1.454.CMB.1.raw
  modified_base (225)..(225): a, c, t, g, unknown or other
  misc_feature (225)..(225): n is a, c, g, or t
  modified_base (365)..(365): a, c, t, g, unknown or other
  misc_feature (365)..(365): n is a, c, g, or t
tcagactgtacagtcacgaccggtgctcgatttagctgcgtcacgatctctcttgggggagagaagacaggattcaggacaatctccagcatggccggcctccctctcctcctcaccctcctcactcactgtgcagggtcctgggcccagtctgtgctgactcagcccaccctcagtgtcgtcgggacccccgggcaggagggtctccatctcttgttctgggancagctccgacgtcggaaattagtttgtctactggtaccagcagctcccaaggaaaccggcccccaagcctcctcactactagtaggaatgatcgaggccggccctcgaacgggactaccgtcgaaccgtattcttttcgnggtctacggaacgtcgtggcctccgtccggtccctcccgtgcctatcgaggtcgggtcctccgggtcgaggagtgacggtcgtagtaattacgttacgtggttcgacgttagggttcgggtactcggtccgtaggttccgtaggtacggttcgggtccgggtacgggttcgggttcgggacggggtacgggacctacggtccgtacgggtacccgttacggtacggtaccgaccggacccggtaacgggtcccgtcccggtcccccgttccgggtacctaccgttccccg

SEQ ID NO: 26266 - DNA, 674 bp, Homo sapiens
  misc_feature: GYAE6OF02IPVD0.25.36.D03.1.454.CMB.1.raw
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaagtcgtgggcctggaggtgaagaggccgtgggtcctcggtgagggtctccgtgtaaggtcctcggaagcagtgtggttcgtcaggacagtacactcaccgtgggtaccggcgaggcccttcgtggaactgggccctgacgtggggtagggaacaagtcaaccgccaccgaccggaacaaccgagaacggtcgacacgatcaggtttacgagggccaaggtacgtactaccgttttccgtagacgtaacgtccgaacggcgacgagtacgtacacgtagtaactctacaatcgtaaccgtaggaccgttaagtttcggacggtaaccgtacccgggaccgttaaacgttaacgtttaccgttaggttaacggacgtaaacgggtaaacggaacggttacccgtccgggtacctttaaaccgaaaacggttccgtaaccgtaacgtcgtacggtcccggtacccgtaccccggtaccgggtaaccccgg

SEQ ID NO: 26267 - DNA, 506 bp, Homo sapiens
  misc_feature: GYAE6OF02G7NZA.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaaagctcctgatctatgctcgcctccacgttacactcagggtccatctcgttcagcggcagtgaatcgtggacagagttcactctcactatcagcacgcctgcacgcctaggaagtatgttgacttaaacttattactagtactaaagtataattactcgtaccccttctacctacgtttcggacggtaccgggaacgaagggtcggtaacgagtaaccgg

SEQ ID NO: 26268 - DNA, 306 bp, Homo sapiens
  misc_feature: GYAE6OF02FE64Z.25.36.D03.1.454.CMB.1.raw
  modified_base (294)..(306): a, c, t, g, unknown or other
  misc_feature (294)..(306): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtggagatcaaacgactgtggctgcaccatctgtcttcactcttcccgcatctgaactgtacagtctggacgcgggctggcaaggcgcagtagnnnnnnnnnnnnn

SEQ ID NO: 26269 - DNA, 225 bp, Homo sapiens
  misc_feature: GYAE6OF02HME8Y.25.36.D03.1.454.CMB.1.raw
  modified_base (221)..(225): a, c, t, g, unknown or other
  misc_feature (221)..(225): n is a, c, g, or t
tcagactgtacagtcacgaccggtgctcgatttagctgcgtcacgatctctcttggggccagggttccctggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnnnnn

SEQ ID NO: 26270 - DNA, 308 bp, Homo sapiens
  misc_feature: GYAE6OF02JAH8Y.25.36.D03.1.454.CMB.1.raw
  modified_base (236)..(236): a, c, t, g, unknown or other
  misc_feature (236)..(236): n is a, c, g, or t
  modified_base (296)..(308): a, c, t, g, unknown or other
  misc_feature (296)..(308): n is a, c, g, or t
tcagactgtacagtcacgaccggtgctcgatttagctgcgtcacgatctcgtcttgggatagaagttattcagcaggcacacaacagaggcagttccagaattcactctcaccatcagcagcctgcagcctgatgattttgctaacttattactgccaacaatataataattattcgaccacttttggccaggggaccaaggtcggagatcaaacggaactgtggctgcaccatcngtcttcatcttcccgcatctgaactgtacagtcctgacgtcggctggcaaggcgcatagnnnnnnnnnnnnn

SEQ ID NO: 26271 - DNA, 373 bp, Homo sapiens
  misc_feature: GYAE6OF02G0VPR.25.36.D03.1.454.CMB.1.raw
  modified_base (204)..(204): a, c, t, g, unknown or other
  misc_feature (204)..(204): n is a, c, g, or t
  modified_base (276)..(276): a, c, t, g, unknown or other
  misc_feature (276)..(276): n is a, c, g, or t
  modified_base (292)..(294): a, c, t, g, unknown or other
  misc_feature (292)..(294): n is a, c, g, or t
  modified_base (298)..(299): a, c, t, g, unknown or other
  misc_feature (298)..(299): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (312)..(373): a, c, t, g, unknown or other
  misc_feature (312)..(373): n is a, c, g, or t
tcagactgtacagtcacgaccggtgctcgatttagctgcgtcacgagtctctcttgggatagaagttattcagcaggcacacaacagaggcagttccagaattcactctcaccatcagcagcctgcagcctgatgattttgcaacttattactgccaacaatataataattattcgacactttggccaggggaccaaggtgganatcaaacgactgtggactgcaccatctgtcttcattccttcccgcatctgaacctgtaccagtctgagcggntgcgaagcgcagtagnnngacnnagatgntcagntnnnnnnnnnnnnnnnnnnnnnnnnnnnnnnnnnnnnnnnnnnnnnnnnnnnnnnnnnnnnnn

SEQ ID NO: 26272 - DNA, 345 bp, Homo sapiens
  misc_feature: GYAE6OF02GERTX.25.36.D03.1.454.CMB.1.raw
  modified_base (311)..(313): a, c, t, g, unknown or other
  misc_feature (311)..(313): n is a, c, g, or t
  modified_base (315)..(345): a, c, t, g, unknown or other
  misc_feature (315)..(345): n is a, c, g, or t
tcagactgtacagtcacgaccggtgctcgatttagctgcgtcacgtagtctctcttgggatagaagttattcagcaggtcacacaacagaggcagttccagaattcactctcaccatcagcagcctgcaggccttgatgattttgtcaacttattactgccaacaatataataattattcgaccacgttttggcctaggggacccaagggtcgggacgatacaaacgaactgtggctgcaccatctgtcttcatcttcccgcatctgaactgtacacgtctgagcgggactggacgaaggcgacagtaggnnntnnnnnnnnnnnnnnnnnnnnnnnnnnnnnnn

SEQ ID NO: 26273 - DNA, 525 bp, Homo sapiens
  misc_feature: GYAE6OF02GRJKC.25.36.D03.1.454.CMB.1.raw
  modified_base (306)..(306): a, c, t, g, unknown or other
  misc_feature (306)..(306): n is a, c, g, or t
  modified_base (430)..(430): a, c, t, g, unknown or other
  misc_feature (430)..(430): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggagcgtggtccagcctgggaggtccctgagactctcctgtgaagcctctggatttagtttcagtggttctggcatgcactgggtccnccaggctccgaggcaagggggccgagtggttggcagttatgcacatgatggaattcagaatattagtgcagactccgtgaagggccattcaccatctaccagagacaagttcccggaatattgngttacttggaaatggtcagcctgagagtcgaggactcgggcttcgtagttacttacgtggtagcgaggtggttcggggaggttggtaagttacgg

SEQ ID NO: 26274 - DNA, 746 bp, Homo sapiens
  misc_feature: GYAE6OF02HZ0M9.25.36.D03.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
tcagactgtacagtcacgaccggtgctcgatttagctgcgtcacgatctctcgttggggagagaagacaggattcaggacaatctccagcatggccggcctccctctcctcctcaccctcctcactcactgtgcagggtcctgggcccagtctgtgctgactcagcccaccctcagtgtctcggggacccccggnaggaggtctccatctcttgttctgggancagctccgacgtacggaaattagtttgtctactggtaccagacagcctaccgaacgaaaccggcccccaagtcctaccctacactctaagtaaggaatgactacacggccggtaccctgacgggtaacttaccgacgaaccgtattccgttacgtcgggtacctacggtaacggttccgtcgggcctttacccgtccggtccccttcccgtacggtacccctacgttccgtaggggtccgggtcccggttaccccgggtaccgggtaacggtagtacgggaacgggtacgttaggtaaacgtttacgtttaccgttggtacggttacgttagggtttgggacgtcggtacgtaggttaccgtaggtacggttcgggtaccggtacggggtttcgggttaccgggacggggtacgggaaccgtacggtccggtacgacccgggttaccgtacgggtaccgaaccggacccggtaacgggtcccgttacccggtacccccgttcgggtaccctaccgttacccgg

SEQ ID NO: 26275 - DNA, 536 bp, Homo sapiens
  misc_feature: GYAE6OF02ISPAE.25.36.D03.1.454.CMB.1.raw
  modified_base (216)..(216): a, c, t, g, unknown or other
  misc_feature (216)..(216): n is a, c, g, or t
  modified_base (361)..(361): a, c, t, g, unknown or other
  misc_feature (361)..(361): n is a, c, g, or t
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcgatcaccatttccngcactggactcagcactgatgttgcaggttattactttgtctcctggtaccaacacacccaggcaaacgccccaaacttatcatttatgacggccactaacgcggccctcaggtagtttctaatcgcttctctgctcaatctgcngcacggctcctgacatctcgtggctcgaggctagaggacgagcgtgtattatactgctactctatagtacggacactactacactaaccgtcccgttacgttaccggaccgtacgggaccgtacgggtaccaccggttccgtcgggtaccacggacccgacggaccctaaccccg

SEQ ID NO: 26276 - DNA, 505 bp, Homo sapiens
  misc_feature: GYAE6OF02HV57N.25.36.D03.1.454.CMB.1.raw
  modified_base (461)..(461): a, c, t, g, unknown or other
  misc_feature (461)..(461): n is a, c, g, or t
  modified_base (491)..(496): a, c, t, g, unknown or other
  misc_feature (491)..(496): n is a, c, g, or t
  modified_base (498)..(505): a, c, t, g, unknown or other
  misc_feature (498)..(505): n is a, c, g, or t
tcagactgtacagtcacgaccggtgctcgatttagctgcgtcacgatctctcttgggcagtccaggggagggcctgaagtgggtcggcctcatgagaccgagggcctctggagggacagtggagcatgacgcgtctctgatgggcaggttcagcctctcaagggacgactctaaagccatcgcctatctgcaaatgaccagcctgacagtcgaagactcagccatctattattgtgcgagactgcctgtctctgattcggggacttattggacgaactacttcactttatcccacatggtacgtttggggcaaggggaccacggtcatcgtctcctccacctccaccaggcccatccggtccttcccctggccacccctcctccaacgacgccacctcgtcggggcacgacgccggcccgtgggctcgccgtcggtcaaggctaccttccacgttcgtacngtctgacggcggcgtggcaggcgcagtagnnnnnngnnnnnnnn

SEQ ID NO: 26277 - DNA, 294 bp, Homo sapiens
  misc_feature: GYAE6OF02HJ6PF.25.36.D03.1.454.CMB.1.raw
  modified_base (286)..(294): a, c, t, g, unknown or other
  misc_feature (286)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacacttttggccagggaccaaggtgagatcaaacgaactgtggctgcaccatctgtcttcatcttccgccatctgaactgtacagtctgagcggctggcaaggcgcatagnnnnnnnnn

SEQ ID NO: 26278 - DNA, 299 bp, Homo sapiens
  misc_feature: GYAE6OF02F1LFH.25.36.D03.1.454.CMB.1.raw
  modified_base (292)..(299): a, c, t, g, unknown or other
  misc_feature (292)..(299): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatctgaactgtacagtctgagcgggctggctaaggcgcatagnnnnnnnn

SEQ ID NO: 26279 - DNA, 298 bp, Homo sapiens
  misc_feature: GYAE6OF02HO2J1.25.36.D03.1.454.CMB.1.raw
  modified_base (238)..(238): a, c, t, g, unknown or other
  misc_feature (238)..(238): n is a, c, g, or t
  modified_base (291)..(298): a, c, t, g, unknown or other
  misc_feature (291)..(298): n is a, c, g, or t
tcagactgtacagtcacgaccggtgctcgatttagctgcgtcacgatctcgtcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcacatctgtcttnatcttcccgccatctgaactgtacagtctgacgcgggctggcaaggcgcatgnnnnnnnn

SEQ ID NO: 26280 - DNA, 629 bp, Homo sapiens
  misc_feature: GYAE6OF02F3Y4N.25.36.D03.1.454.CMB.1.raw
  modified_base (348)..(348): a, c, t, g, unknown or other
  misc_feature (348)..(348): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagactctcctgtgaagcctctggtatttagttcagtggttctggcatgcacgtgggtccgccgaggcctccgaggcgaagggggccgagtggtgcagttanagcacagtgagtggaagtttcagtaattagttactgactacgtacgtcggtaggacgggtcctaattccgaacctactccgtaccgagacgactaaacgttccccggaaatacgtttggtacgttacgttagggaaacttcgggtacacgtcccgttaggaggtaacgggttccgggacggtccggtacggtccgttacggttacgtttaacgttaccggttggtaccggtacgggtaggttaccggggtggggtacgggttagggttaggtttaaccggg

SEQ ID NO: 26281 - DNA, 568 bp, Homo sapiens
  misc_feature: GYAE6OF02II897.25.36.D03.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (484)..(484): a, c, t, g, unknown or other
  misc_feature (484)..(484): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccggnagaggtctccatctcttgttctgggancagctccgacgtacggaaatagttgctactggtaccagcagctccagaaaccggccccaagctcctcatctataggatgatcgagcgccctgaggactacctgaccgtatctactggctacgagtctacgctccgtcggcctcccgtggaccatcgaggtcggccgtcccggtcgaggtctggacgtccgtagtaacttagttactggtcgtcgtaggtttggactcgcctaggtcgtgaggttcggtccgacgggttgtccgggngacggaccgagccgtacgcccggtaccgtagggtaccacgaccccgtaggcccttaccggcccccgtggtaccaccgttccccg

SEQ ID NO: 26282 - DNA, 327 bp, Homo sapiens
  misc_feature: GYAE6OF02GG52C.25.36.D03.1.454.CMB.1.raw
  modified_base (295)..(297): a, c, t, g, unknown or other
  misc_feature (295)..(297): n is a, c, g, or t
  modified_base (299)..(327): a, c, t, g, unknown or other
  misc_feature (299)..(327): n is a, c, g, or t
tcagactgtacagtcacgaccggtgctcgatttagctgcgtcacgagtctctcttgggatagaagttattcagcaggcacacaacagaggcagttccagtaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgccatcctgaactgtacagtctgagcgggctggcaaggcgcagtagnnnannnnnnnnnnnnnnnnnnnnnnnnnnnnn

SEQ ID NO: 26283 - DNA, 846 bp, Homo sapiens
  misc_feature: GYAE6OF02JW4CF.25.36.D03.1.454.CMB.1.raw
  modified_base (209)..(209): a, c, t, g, unknown or other
  misc_feature (209)..(209): n is a, c, g, or t
  modified_base (233)..(233): a, c, t, g, unknown or other
  misc_feature (233)..(233): n is a, c, g, or t
tcagactgtacagtcacgaccggtgctcgatttagctgcgtcacgatctctcttggggcagagtctctctcagtcaggacacagcatggacatgagggtccctgctcagctccgtgggacctcctgctgctctggctcccagataccagatgtgacgtccagatcgacccagtcctccatccctcctgtcctagccatcgtgttcgganacagatcagcatcacttgccgggnagtcgagggctagttacgactaatttattacgccgttaggtactaccaaacgtaaggtaaaacccgaggggtagtaacgttttaacccggaagtacccgttaccgtacggaactttcgttaagttacggtacttaccggtacccctttaccgtaaaccgtttaacctaccggtaccggtacccgggggttacccaaccgtttccggtttaaccgggtttcccgaaacggtccgggttactaaccggttacggtaaacgttccgggtaacggggtaaaccttacgggtaaaccgggtttacctaaccggtttaaccctaccggtaaacctttacggttaccgtaaggtcccctaaacggtccccgtaaagttcccgaaccggttacggttaacggaaacggttactttcggttaaaccggtccttaaaacccgttttaagtttaaacccggaggtttaaaccctaaaaggttaacctttaaccggtaacccttaccggtaccccccctttaaagtccccgttttaaaacggtttaccgggggacccgggttaaaccggggttaaaaccccgtaggggggtttaaaccccggtgttaaaaccggttaaaccccgg

SEQ ID NO: 26284 - DNA, 561 bp, Homo sapiens
  misc_feature: GYAE6OF02F558D.25.36.D03.1.454.CMB.1.raw
  modified_base (409)..(409): a, c, t, g, unknown or other
  misc_feature (409)..(409): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcatctgggcctgaggtgaagaggcctgggtcctcggtgagggtctccgtgtaaggtctccggaagcagtgtgttcgtcagacatacactcacctgggtccgcaggcctcgtggaactgggcctgagtgggtcggaacatcgaaccgccacgccggaacaacgagaggtcgcacatcagtttcagggcagtagtcaccgtttcgtggacctagtccgacgggtcncgacgtatacatacggaatctacaacgtgacctggacgtagtttggaccggtacgaccggaccgttattacttacgtgtagcgaagagtacgtaccgtgaccctacaaacgtcgacgtacgcgtaggcctaccggacccgtgggtaccccgg

SEQ ID NO: 26285 - DNA, 680 bp, Homo sapiens
  misc_feature: GYAE6OF02FYFO7.25.36.D03.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (263)..(263): a, c, t, g, unknown or other
  misc_feature (263)..(263): n is a, c, g, or t
  modified_base (428)..(428): a, c, t, g, unknown or other
  misc_feature (428)..(428): n is a, c, g, or t
tcagactgtacagtcacgaccggtgctcgatttagctgcgtcacgagtctctcttggggagagaagacaggattcaggacaatctccagcatggccggcctccctctcctcctcaccctcctcactcactgtgcagggtcctgggcccagtctgtgctgactcacgccaccctcagtgtcgtcgggaccccggnagagggtctccatctcttgttctgggncagcctccgacgtacggtaaattagttgtactactggtaccngcagctaccaagaaccgccccagcctcctcatctaataggatgactcgacggccgtccctgagggtactaccgtagaccgtattcctcgtgctacgaagtctcggtcctccgtaccggcctcccgtgacctatcgtggtcgggtccgtccgggtcgaggtctggnggactaggaattagttacgttggtcgtacttagggtttgggattcggaccgtagtacgttaggtacggttccgggtaccggttacgggttcggttccggggaccgggggtacgggtaacccgtaagggtcccggttacggggtaacccccggttaccggttaaccgggttaccgaacccgggtacccggtaagggtccccgttaccccgggtccccccggtttaccgggttaccgttaccccgtttcccggg

SEQ ID NO: 26286 - DNA, 671 bp, Homo sapiens
  misc_feature: GYAE6OF02IAETS.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtcctccatcctccctgtctgcatctgttggagacagaatcagcatcacgttcgccgggcgagtcgaggggcattagcaattattagcctggttatacaacgaagaaaccgagggagacgttacctaagctacctgatctatcgtctcgcccttaccacgtttaaccaccgttcgtaccggggtccctagttcccgttcgggtttaccaggccggtcgtaaggttacggtaacgtccggtacggggaacctaagggtacgtttaccgaaccttcctacctaacttactcgacgtcgacgtccgtcgacgacgtaccgtagaacggttagttcgttacggtaccttaacgttttaagttaccgttaacgttaacgttaaaacgttattaacgttaaccgtcccgttacccccttacgttacccgttaaccgttttacccggggacgggttaacccggggtaacccgtaaaggggttacggggtaacgtaacgttaaacccgg

SEQ ID NO: 26287 - DNA, 617 bp, Homo sapiens
  misc_feature: GYAE6OF02J0WVR.25.36.D03.1.454.CMB.1.raw
  modified_base (233)..(233): a, c, t, g, unknown or other
  misc_feature (233)..(233): n is a, c, g, or t
tcagactgtacagtcacgaccggtgctcgatttagctgcgtcacgatctctcttgggagctctgggagaggagcccagcactagaagtcggcggtgttccattcggtgatcagcactgaacacagaggactcaccatggagtttgggctgagcttgggttttcctcgttgtcttcgttttaagaggtgttcccatgttccaggttcgctaccgtggtcggagtcgtggggggngtcggtagggtccagtccggtaggggacggtcccgtgacgactcgttcctaggtgaacgtcctcgtggtactttagttcgaggttggttctgactgcgtcaggttcggccacggacgctccggagacggacggggccgtaggttggtaccgagtacgttagacgactagagtgaggtagtagttactagaatttacgtatgacgtaacgtcgtacgtaggacggctaactccgatacctctagagacgtacctacgtacccgagtagtcgttaagtacgtaagtcgtaaggtccagtcgtacgtaagccgtagcgtacgtcgcgtcgttaatcgttaaggtcgaggtcgaaggtccggttaaggcggttagggttaattaacgg

SEQ ID NO: 26288 - DNA, 293 bp, Homo sapiens; identical to SEQ ID NO: 25694
  misc_feature: GYAE6OF02GUAVX.25.36.D03.1.454.CMB.1.raw
  modified_base (290)..(293): a, c, t, g, unknown or other
  misc_feature (290)..(293): n is a, c, g, or t

SEQ ID NO: 26289 - DNA, 744 bp, Homo sapiens
  misc_feature: GYAE6OF02HR5HT.25.36.D03.1.454.CMB.1.raw
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttggactgagctggattttcctttggactattttaaaggtgtccagtgtagaagtgacaactggtggagtcgtgggggagcttggtacagcctggcacggcccctagacgtactcctccgtgtcgcacggtcctctggactttccaccgttttagattgtattatcggacctagtcgcctacgtcggggtcccgacaaacggtccgaccgggtaagggggaacggggtcccgtaggggtacggttcgggggttaccttacggtaagggtttattttaagggttaggtaaagttagggttaggttaacgcgtaaggttaacgggcctttaagtcgggtaccggtacgtttacggtagggtacgggaacggggtacccgttaacgtttccgaacccgtacttaccgtaacccgtaagaacgtaaaccgaaacccggaccaaaaccgtaacccttacccgttaaggttacctctaacggaacgtaaagtaacgaaacgtacgtccgtagacgtacggacggtaggaaccggtaccgtaccggttaccgtttgttaacgttacgtacggttaaccgaaattttaaaacgtttaagttaaaccgg

SEQ ID NO: 26290 - DNA, 307 bp, Homo sapiens
  misc_feature: GYAE6OF02IBISL.25.36.D03.1.454.CMB.1.raw
  modified_base (298)..(307): a, c, t, g, unknown or other
  misc_feature (298)..(307): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcacatctgtcttcatccttcccgcatctacgaactcgtacgagtctggacgcgggctggcgaaggcgacatagnnnnnnnnnn

SEQ ID NO: 26291 - DNA, 681 bp, Homo sapiens
  misc_feature: GYAE6OF02IHL21.25.36.D03.1.454.CMB.1.raw
  modified_base (277)..(277): a, c, t, g, unknown or other
  misc_feature (277)..(277): n is a, c, g, or t
  modified_base (327)..(327): a, c, t, g, unknown or other
  misc_feature (327)..(327): n is a, c, g, or t
  modified_base (369)..(369): a, c, t, g, unknown or other
  misc_feature (369)..(369): n is a, c, g, or t
  modified_base (569)..(569): a, c, t, g, unknown or other
  misc_feature (569)..(569): n is a, c, g, or t
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggtatttttccttttggcttattttaaaggtgtcagtgtgaagtgctaactggtgaggtcgtgggggaggtcttggtacagccgtggcacggcccctagagactctcctgtgcagccctntgtattcacctttgatgtattagcgcctagtgacctagtcgggtaccganaacgcttaccggaggggtaacggcctagggcgtcgggttacngtaggttattcggttaggaacttagtagggtcagagttacggactagtcggtaccgtacgttcgagggttggaacgggtccgtaacgttacccaccgaactttcccgaacgaggtaacgtaacgaaccggtacccaaacgttaacccgttcccttaaggtacctttacggacctaacggtaaacttacgaaacccggttnttaacggtagacgtaacgcgttaacgggaaaggacccgtaaccccggggtttcttaacgggtttacctttaggtccgttaaggttaaaacgttaaacgttaactttaacggg

SEQ ID NO: 26292 - DNA, 298 bp, Homo sapiens
  misc_feature: GYAE6OF02IYKZ8.25.36.D03.1.454.CMB.1.raw
  modified_base (292)..(298): a, c, t, g, unknown or other
  misc_feature (292)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatccttcccgcatctgaacttgtacagtctgagcgggctggcaaggcacatagnnnnnnn

SEQ ID NO: 26293 - DNA, 296 bp, Homo sapiens
  misc_feature: GYAE6OF02F6VJ1.25.36.D03.1.454.CMB.1.raw
  modified_base (289)..(296): a, c, t, g, unknown or other
  misc_feature (289)..(296): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttatactgccaacaatataataattattcgaccacttttgccaggggaccaaggtggagatacaaacgaactgtggctgcaccatctgtctcatccttcccgcatctagaactgtacagtctgagcggctggcaaggcgcatagnnnnnnnn

SEQ ID NO: 26294 - DNA, 646 bp, Homo sapiens
  misc_feature: GYAE6OF02F3UY0.25.36.D03.1.454.CMB.1.raw
  modified_base (419)..(419): a, c, t, g, unknown or other
  misc_feature (419)..(419): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagcccaccctcagtgtctcggggacccccgggcaggacgggtcctccatcttcttgttcgtgggagcagctccgacgtcggaaattaagtttgtctactggtaccagcagcctccgaagaaccgccccaagcctcctcactactagtaggaatgactcgacggcccggtcctcggacgggtactacccgtgaccgtattcctcgtcggcctacggaagttccgtcggccttccgtccggtccctcccgtcggacctntccgacggtcgggtcctcccggggtacgacggtagttcggacgggtccttaaggtaacttacgttacgtggtcgtacgttagggtttcggacgttcgaccgttgttacgtgtacggttcgggtccgtacggggttccgtcgggacgggacggaccgtacgtcgtaccggtacccggtctacgggccagtacccggacgcctcccggcccgtcgtccgcccgttcccg

SEQ ID NO: 26295 - DNA, 555 bp, Homo sapiens
  misc_feature: GYAE6OF02FJW7Q.25.36.D03.1.454.CMB.1.raw
  modified_base (282)..(282): a, c, t, g, unknown or other
  misc_feature (282)..(282): n is a, c, g, or t
  modified_base (343)..(343): a, c, t, g, unknown or other
  misc_feature (343)..(343): n is a, c, g, or t
  modified_base (440)..(440): a, c, t, g, unknown or other
  misc_feature (440)..(440): n is a, c, g, or t
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggattttcctttggctattttaaaaggtgtccagtgtgaagtgcggctggaggagtcgtgggggaggcgtggtacaggccgggggggtccttagactctcctgtaaagtctctggattcaatttnatgaatatactatgcactgggtccgtcaggctcgaggggacggtctagagtgggtctcgtnttataaattggatggttccagtatagacttagtgtaggctctgtgaagggccgctcgaccatctcagagacaacagacaaaactccctactatactnacaatacggacgacctgacgtaagtagaacgaacacgacgccaactacgtattattagtagtaaaaggagggtaagtttacggtaaactcgttacggaagaggtactagtttacg

SEQ ID NO: 26296 - DNA, 743 bp, Homo sapiens
  misc_feature: GYAE6OF02F9R2M.25.36.D03.1.454.CMB.1.raw
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggattttccttttggctattttaaaggtgtccagtgtgaagtgcaactggtggagtcgtgggggagcttggtacagcctggcaggcccctgagactctcctgtgcagcctctggattcacctttgatgattatcgccatcgcacgtcgggtccggcaacgccgtaccgagggggaacgggtccgtagggtacggttggggtccttacggtaggggtttaacgttttagggtttacggggtaaagttagggttacggggttaaggtaccgtaaaggttaggggtaccttaagttcggggacccgggttaaccgtttccgttagggtaacggggaaacgggggtcccgtaagtttacccgaccctaacgttccgttacccgaaggaacgtaaacccgaaaccggaccctaaaacgtaacccttacccgtagttaactccgtacggtaaccctaaagttaccggaaaccgtagttaccgtaggacgtacggtccgttaagggaaccgggtaaaccgtacccgggttccttttaaggtaactttaccgttaggtacctaaacgtttaaaaagtttaaccgtttaaaccgg

SEQ ID NO: 26297 - DNA, 567 bp, Homo sapiens
  misc_feature: GYAE6OF02GD2LV.25.36.D03.1.454.CMB.1.raw
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatccacctattcctgcactggactcagcactgatgttgctaggttattactttgtctcctggtaccaacaacacccaggcaacgccccaaattancattatgagccaactaagcgcctcaggtagtttctaatcgnttctctcggctcaagtctggcngcacgcctcctnacatctcnggctcgacgcgtgacggtacgagtctgtattactactcgtctactactatagtcggtaacactacgtacaacctaacgtcccgttacgttaccgggaccgttaccggggtaccgtaacggggttccctaaccgggttccggttacgggtaccgaccggtccccgtaaccggcccctaaacccccg

SEQ ID NO: 26298 - DNA, 696 bp, Homo sapiens
  misc_feature: GYAE6OF02I4WWM.25.36.D03.1.454.CMB.1.raw
  modified_base (205)..(205): a, c, t, g, unknown or other
  misc_feature (205)..(205): n is a, c, g, or t
tcagactgtacagtcacgaccggtgctcgatttagctgcgtcacgatcgtctccttgggggcagaagtctctctcagtcaggacacagcatggacatgagggtccctgctcagctcctgggactcctgctgctctggctcccagtataccagatgtgacgtccagatgacccagtcctccagtcctcctgtctgcatctgtgganacagaatcagcatcacgttcgccgggcgagtcgagggctattagctaattatttagcctggtaatacgaaactaagaaaccgaggggtaacgacggttaccgtaacgcttaccgtagtacttacttaagtcgtcgtcgtacccttacccgtaaccgttaaccaccgttaccggtacggggttcccctaacgttccgttcgggttaccgacggtccggtactagtacgtaacgttcgtacgggtaacgaacgtaacggttacctaaccgtctacctaacttacgtacgacgtcgaacgtccgtacgtaccgagacccgtaggaaacgtacgttacgttacgtaacttaaacgtttaactttacgttaacgttaacgtaaaacgttattaaccgttaccgttaaccggtacccccttacgttacccgttaacggtttaccgggaccggggtaacggtaacccggtaagggtacggtacgtaacgtaaacccgg

SEQ ID NO: 26299 - DNA, 589 bp, Homo sapiens
  misc_feature: GYAE6OF02G4HTT.25.36.D03.1.454.CMB.1.raw
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcacctatttcctgcactggaaccagcactgatgttggcttactttgaccttgtctcttggtaccaacaaccacccggacaacggctaccaaactcattaattttgagacagtaagcggcctcgtgggtttctagtcgtattcactcggctcaagtctgcaacgacgccctacctaacactctcgtcgggctccgaggctaggaacgacggtacggtcttagtttacttcgtgtcttgttgcttatggtgtctaagtaaacttagtttggtcgtcgtcgggcggaacggtacctagttacgtaccgtagttaagtaccgacgacccgtaaggccgttcccggtaccccgttcggtacctacgttccttcccgttcccctacccc

SEQ ID NO: 26300 - DNA, 362 bp, Homo sapiens
  misc_feature: GYAE6OF02IR0ND.25.36.D03.1.454.CMB.1.raw
  modified_base (312)..(314): a, c, t, g, unknown or other
  misc_feature (312)..(314): n is a, c, g, or t
  modified_base (318)..(362): a, c, t, g, unknown or other
  misc_feature (318)..(362): n is a, c, g, or t
tcagactgtacagtcacgaccggtgctcgatttagctgcgtcacgagtctctcttgggatagaagttattcgagcaggcacacaacagaggcagttccagaattcactctcaccatcagcagcctgcagcctgatgatttgcaacttatactgccaacaatataataattattcgacctacttttggccaggggacccaaggtggagatcaaacgaactgtggctgcacctatactgtcttcaatccttacccgccactcttcggaactgtaacagtactcgaagcgggctcggcaaagggcgaccatacgnnngcannnnnnnnnnnnnnnnnnnnnnnnnnnnnnnnnnnnnnnnnnnnn

SEQ ID NO: 26301 - DNA, 684 bp, Homo sapiens
  misc_feature: GYAE6OF02JZGXE.25.36.D03.1.454.CMB.1.raw
  modified_base (188)..(188): a, c, t, g, unknown or other
  misc_feature (188)..(188): n is a, c, g, or t
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
tcagactgtacagtcacgaccggtgctcgatttagctgcgtcacgatctctcttggggagctctgggagaggagcccagcactagaagtcggcggtgttccattcggtgatcagcactgaacacagaggactcaccatggagtttgggctgagtctgggttttcctgttgcttcgttttaagaggttntccactgtcaggtgcaccgttggtggagtcgtggggggacgcgtggtccagccgtgggacgtcctgagctctcctgngagcctntggatttagttcgaggttggttactggctagtgtcctacgtcgggtccgactagggtcctcgagggccgaagggggccggtaggttcgggtaggctaaggtttctagacctagagttggaattggggtaaacttctaggtaaattgtagtgacctagtacctaccggtaggtaaaccgggccgtattaccaacgtcgttaccgtacgaaggtaacgtaacctaaaccggtttacccggaaattacggtttacgttaacggttaagttacggtaaacggttcgtaacgacgttaccgtaggacggtaacgtcgaagggtacctgggtacttacgtagtttacgttaccggtaggttaccggagttaacgggtacgggtttacgggagggtttaacgggtacggtttaaacggg

SEQ ID NO: 26302 - DNA, 723 bp, Homo sapiens
  misc_feature: GYAE6OF02GMGXM.25.36.D03.1.454.CMB.1.raw
  modified_base (201)..(201): a, c, t, g, unknown or other
  misc_feature (201)..(201): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatgacccagtctccatcctccctgtctgcatctgtgganacagaatcagcatcacgttggccgggcgagtcgagggactagttagactaattatttacgcctaggtactacaacgaacgaaaccgagggaagtacgttacctaagtccgtacctaggtacttcttagtcgccgtcgtccctaccgtaaccgttaccaccgttaccggtacggggttaccctaagttccgttaccgggttaccgtaacgggtaccggtaccgtaaggttacggtaacgttacgggtacgggtaaccgtaacggttacgttacctaccgttcctaccgtaactaacgtacgtacgaccgtacggtcccgtacgtcctaccggtaccgttaaggtaaacggttacgttacgtttaccgaacgtttaaacctttaacgtttaaccgttaacgtaaacttaaaaggttaacttaacgttacccgtacccggtaccctttacgtacccgtttaccggtttacgggaaccggggtaccgggtaacggtaacggggtacggtacgtaacgtaaacccgg

SEQ ID NO: 26303 - DNA, 601 bp, Homo sapiens
  misc_feature: GYAE6OF02J2118.25.36.D03.1.454.CMB.1.raw
  modified_base (195)..(195): a, c, t, g, unknown or other
  misc_feature (195)..(195): n is a, c, g, or t
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
  modified_base (396)..(396): a, c, t, g, unknown or other
  misc_feature (396)..(396): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcacgccaccctcagtgtctcgggaccccccgggnaggacgggtcctccattcctcttcgttctgggagcagcctccgacgtcggaaatagtttgctacgtggtaccagcagctcccaagaaccggcccccaagcctcctcactctataggaatcgatcgacgcggccctnagggtactacctgaccgtattccncgtggtctacgacgtctcggcctccgtccggtccctcccgnggaccctagtccgacggtcggccgtcccggtccgaggtctggacgctagtaactagttacgtggtcgacgtaggttggatcgacgtagtcgtgtacgtcggtccgtcgggtcgttcggacggagaccgtagccgtacggcccgtcgtaacggtccgacggtacccgacggtccgtccgttacccccgcggttccaccgtttcccg

SEQ ID NO: 26304 - DNA, 647 bp, Homo sapiens
  misc_feature: GYAE6OF02GKU3T.25.36.D03.1.454.CMB.1.raw
  modified_base (212)..(212): a, c, t, g, unknown or other
  misc_feature (212)..(212): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcctcggggaccccccgggnaggagggtcctccattctcttgttcgtgggagcagcctccgacgtcggaaattagtttgtctacgtggtaccagcagcctacccgaagaaacccggcccccaagcctacctcatcctataggaatgatcagccggccctcgacggtactacccgtgacccgtatttccgtacgtcggcctacgtaagtccgtgggtcccttcccgtccggccccttcccgtggccctatccgagggtcgggcccgttacccggggtcgaggtcgtgacggtcttagtaacttagtttacgtgtacggacgttagggtttggattcggaccgttaggtcgtaggtggttccggttaccggtacggttcgggttcgggacgggacgggtaaccgaacggtccggttaccggtaccggttccgtagggtcctaccggacccgtaacgg

SEQ ID NO: 26305 - DNA, 474 bp, Homo sapiens
  misc_feature: GYAE6OF02JNB4I.25.36.D03.1.454.CMB.1.raw
  modified_base (117)..(117): a, c, t, g, unknown or other
  misc_feature (117)..(117): n is a, c, g, or t
  modified_base (136)..(136): a, c, t, g, unknown or other
  misc_feature (136)..(136): n is a, c, g, or t
  modified_base (440)..(440): a, c, t, g, unknown or other
  misc_feature (440)..(440): n is a, c, g, or t
  modified_base (448)..(449): a, c, t, g, unknown or other
  misc_feature (448)..(449): n is a, c, g, or t
  modified_base (453)..(474): a, c, t, g, unknown or other
  misc_feature (453)..(474): n is a, c, g, or t
tcagactgtacagtcacgaccggtgctcgatttagctgcgtcacgatctctcttgggatagaagttattcagcaggcacacaacagaggcagttccagaattcacctctcacatcancacgtcctgcacgccgtanagtgttatttcgaacctacttattactcgacctaacaattaattaattaatttacttaccgtaaccttacgttttacggaccggtaacgggtaaccgtaagggttaggaacgtaacgttaaccaaaacggtaaccgtggtacggtacgtcgaccacctacttccgtacgttccttactaacttccccgtttaccccgacctacgtttaccgtaacggtaacctcggttaacctaacggttcctacgggtaaccggggcgggttccgtacggaaccggaaacggtccccggagttaaccggtaancggctcgnngcgnnnnnnnnnnnnnnnnnnnnnn

SEQ ID NO: 26306 - DNA, 643 bp, Homo sapiens
  misc_feature: GYAE6OF02G869K.25.36.D03.1.454.CMB.1.raw
  modified_base (101)..(101): a, c, t, g, unknown or other
  misc_feature (101)..(101): n is a, c, g, or t
  modified_base (186)..(186): a, c, t, g, unknown or other
  misc_feature (186)..(186): n is a, c, g, or t
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
  modified_base (407)..(407): a, c, t, g, unknown or other
  misc_feature (407)..(407): n is a, c, g, or t
  modified_base (512)..(512): a, c, t, g, unknown or other
  misc_feature (512)..(512): n is a, c, g, or t
tcagactgtacagtcacgaccggtgctcgatttagctgcgtcacgatctctcttggggacataacaaccagattcttcctctaaaagaacgcccctgggancacagctcatcaccatggctggacctggaggttctctttgtggtgcagcagctacgaggtgtccactcccaggtccagctggtancaatcctgggcctgaggtgaaggcgccttgggtcctcggtagngggtctccgtaggtaacgtcgaccggaagctagtgtcgttcgacgagtacactacacctcacccgttgggccgganaccggtccttcgtaggaaccctgggtaccctgacggttggggaggaaaccaagtaccgaaccgtccgaacggtacccgaagaaaccttaggcggcaccaaanctcgtaaggttccagggaccaaggcgttacctacccgttttcgacggacaacggtccaacgggccgatacggtaacactaagtgacttacagtaactcgaaccgngtagtgttacgacgtaaccgtacgttacgtaattacgttctaggtacgagtaaagaacgttacggtcccgtaacgtacctaaccgtaaagtccgagcggtaccgtcgtcccggtccgaccggtcgggaccg

SEQ ID NO: 26307 - DNA, 175 bp, Homo sapiens
  misc_feature: GYAE6OF02HNNA4.25.36.D03.1.454.CMB.1.raw
  modified_base (172)..(175): a, c, t, g, unknown or other
  misc_feature (172)..(175): n is a, c, g, or t
tcagactgtacagtcacgaccggtgctcgatttagctgcgtcacgatctctcttgggtattcggcggagggaccaagctgaccgtcctaagtcagcccaaggctgccccctggtcactctgttcccaccctcctcactgtacagtctgagcgggctggcaaaggcgcatagnnnn

SEQ ID NO: 26308 - DNA, 906 bp, Homo sapiens
  misc_feature: GYAE6OF02F9X59.25.36.D03.1.454.CMB.1.raw
tcagactgtacagtcacgaccggtgctcgatttagctgcgtcacgatctctcttggggagctctgggagaggagcccagcactagaagtcggcggttgttccattcggtgatcagcactgaacacagaggactcaccagtggtaggtttggctgagtcgttgggttttcctcgttgcttacttttaaggaggtcgtaccacttgtacgaggtcgccaccgttgggtgggagtcggtggggggacggtcggttcggtaccgacggtccggtgggggaccggttcccgtaggaacgtaccttccgttccgttggtacggaacgtcccttacggtagggttaatttttacggtttccgtaagggtttcgggtttccgtgggacctagtcggaccgtaccggttcgggggtaccccgccggtaacgggtccttacccggaggggtaacccgggaacgggggggtccccggtaaggggtttcggggtttacgggaccgttaaaggttttaacgacggtaccgtaacgtaaggtaggtaacggtttaggggttaaacgttttcgtaaagggttaaatttaagtttaacgtcggtaaccgtaaggtaaccccgtttccggggttaaagggaaaccgggggtaccctttaacgttacccgaaacccgttacgtttaccccgtaacccgtaaaggtaacccgtaaaccgttaaacccggttaacccccggtaaattcgttttagggtacgtttaaacggtttaagggtaaacgtttcgggtaaccgtaccggttccgtaaggtacggtaacggtacggaacgggtaccgtcggtaccgttgttacgtttaagttccgttggtacggacggtaaggtacgggttacgggggtaggtttagggttaagtttaaccgg

SEQ ID NO: 26309 - DNA, 810 bp, Homo sapiens
  misc_feature: GYAE6OF02FJWMX.25.36.D03.1.454.CMB.1.raw
  modified_base (293)..(293): a, c, t, g, unknown or other
  misc_feature (293)..(293): n is a, c, g, or t
tcagactgtacagtcacgaccggtgctcgatttagctgcgtcacgatctctcttgggagctctgggagaggagcccagcactagaagtcggcggtgtttccattcggtgatcagcactgaacacagaggactcaccatggagtttgggctgagcttgggtttacctcgttgctactttaagaggtcgtccactgtcaggtcgccaccgtgggtggagtccggtgggggacgccgtcggtcccaggccgttggggacgtccctggacgtacctcgtcctgtcgaacgtccttcngggttaactttacgttcgaaggttcggttctgccgtaatcgcgacgttcgggttccgaccacggtcctccgagggtaccgaacgggggtcccgtaggttaggttacgggacctacggtttaacacgggacctaaccgtagtacggtaacgttacgggtaaacgtttacccgttaggtaaaacctttagttttaaccgcggtaaccgttaaaccggtacccggtacccgggttaacgggtaaacccggggttacccttaaccgtttacccaaaccccgttaacgttcccgtaaacccgtaaggtaaacccgtaaacccggtttaaacccgttaccccgggtaaacttacggtttacgttaacggtttaaccgtacggtaaaacgttcggtaccaacggttccgtaagaacggtacgtaccggaacggtcccgtcgggtccttacggtacgtaacttaccggtaggtacggtaccggaggttacggttcggggaaggtttacggtacggtttaaccggg

SEQ ID NO: 26310 - DNA, 293 bp, Homo sapiens
  misc_feature: GYAE6OF02HAWW3.25.36.D03.1.454.CMB.1.raw
  modified_base (289)..(293): a, c, t, g, unknown or other
  misc_feature (289)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccagggaccaaggtggagatcaaacgaactgtggctgcaccatctgtcttcatcttcccgccatctgaactgtacagtctgagcggctggcaaggcgcatagnnnnn

SEQ ID NO: 26311 - DNA, 295 bp, Homo sapiens
  misc_feature: GYAE6OF02H2A6A.25.36.D03.1.454.CMB.1.raw
  modified_base (283)..(283): a, c, t, g, unknown or other
  misc_feature (283)..(283): n is a, c, g, or t
  modified_base (288)..(295): a, c, t, g, unknown or other
  misc_feature (288)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgactactttggccaggggaccaaggtggagatacaaacgactgtggctgcacatctgtcttcatccttcccgccatctgaactgtacagtctgagcggctggcaaggcncatgnnnnnnnn

SEQ ID NO: 26312 - DNA, 595 bp, Homo sapiens
  misc_feature: GYAE6OF02GWLJU.25.36.D03.1.454.CMB.1.raw
  modified_base (208)..(208): a, c, t, g, unknown or other
  misc_feature (208)..(208): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttctgggagcagctccgacgtcggaaatagtttgtctactggtaccagcagctcccagaaccggcccccaagctcctcatctataggaatgatcagccgcctgaggatacctgaccgtattctctggctacgaagtcgtgcctccgtcgccctccctgccagtcaggtcggcctccgggtccgaggtgtggacgctagaacttattacgtgtcgacgttagggtttggagttcgaccgttacggttcgtaggtacggttcgggtaccggtacggggtttcgggttcggggaccggggaacgggtaaccgtaaggtccgtacgggtacccggttccggtaaccgggtcgacccggtacccgtaaccggg

SEQ ID NO: 26313 - DNA, 709 bp, Homo sapiens
  misc_feature: GYAE6OF02GU0VG.25.36.D03.1.454.CMB.1.raw
  modified_base (273)..(273): a, c, t, g, unknown or other
  misc_feature (273)..(273): n is a, c, g, or t
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggattttcctttggcttattttaaaaggtgtccagtgtgaagtgcaactggtggagtcgtggggggagcgttggtacagcctggcaggcccctgacgactctcctgtcgcagcctntggattcacctttgatgattatgccatgccacgtgggtcccggacaaggcctaccggagggggaacgggtccgtaggggtaggtcggggtcctacggtagggtttagtttaacggttaggaaagttagggtaggttaggacgtaagttacgggtacttagtcggacggtacttaccgttagggttacgggaaacggggtccgtaagttaccgacctacgttccgtacccgtaagaccggaaccaaacccggaccgaaaccgtaacccttcccgttacgttactaccgttacgaaactaaagttaacgaaacgtacgtaccgtaggtacgacggtcggttaagggaaccgggaaccgtaccgggttaaccgttttaggttaacttttaccgttagggtaacgttaaaaccgttaaaaacgtttaacggtttaaccgg

SEQ ID NO: 26314 - DNA, 606 bp, Homo sapiens
  misc_feature: GYAE6OF02JWUOS.25.36.D03.1.454.CMB.1.raw
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
tcagactgtacagtcacgaccggtgctcgatttagctgcgtcacgatctctcttggggcagaagtctctctcagtcaggacacagcatggacatggagggtccctgctcagctccgtgggactcctgctgctctcggcctcccagactaccagtatgtcgacgtccagactcgacccagttcctacctactcccttcccgtgtcctgctatcgttggttaggagaccaagaactcagcatccagttcggacggcgagtcgagggtctagtagactaattgttacgccgtagtactcaaacacgaaacgtggaatacgttaccgtaacgcctgtgactctagtcgctctccctcaacttcacgtcgtacggtcctactcgtcgtcnggcgngtgtacgancggtagtacgagtctcgtatacctntacctatcccgagcctacgtcctacgacgtacgtcgtacgagtacgtttgttaccggtaacttacctttaacgttaacgtaagttaaactaaagttactaacggttaccctccggttacccttacgttccgttaccggttacgggaccggtacgggtaccgtagggtcaacggtgtaaaccg

SEQ ID NO: 26315 - DNA, 615 bp, Homo sapiens
  misc_feature: GYAE6OF02G3JBS.25.36.D03.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (406)..(406): a, c, t, g, unknown or other
  misc_feature (406)..(406): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtcgtggggacccccgggnaggagggtctccatctcttgttctgggancagctccgacgtcggaaattagtttgctactggtaccagcagctccagaaccgccccaagctctcatctataggatgatcagccgcctgaggactaccngaccgtattcnctggcctacgaagtctggccttccgtcggtccctcccgtggccctagtcgaggtcggccttccgggccgaggntggacggtctagtaattattacgtgtcgcgttagggttgggatcggaccctaggttccgtggtacggttcgggtccggacgggtttcggttaccgggacggggtacgggaccctaggtccgtaccggtacccggttccgttagggtcccgaccggtaccccgtaagggtcccttacccggcccccggttcgggtaccctaccgttcccg

SEQ ID NO: 26316 - DNA, 701 bp, Homo sapiens
  misc_feature: GYAE6OF02FRYDL.25.36.D03.1.454.CMB.1.raw
  modified_base (192)..(192): a, c, t, g, unknown or other
  misc_feature (192)..(192): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtacggaaattaagtttgtctacgtcggtaccagcagcctacccgaacggaaaccggcccccaagcctcctcactctagtaggatgactcgacggccggccctagacgggtactaccgtagaccgtacttctacgtggctacgtaacgtcgtcggccttccgtccggtccctcccgtggccctacgtaaccgtagggtccgggtacccgtcccgggtaccggacgggtacgtcggacggtacgtaggtaaacttacgtttacgtggtacggtacgttagggtttacgggagttccgcgtagttcggtagtacggtggtaccgttacccgggtacgggttgggttaaccggggacgggtaaccgggaccgaacgggttccgtaaccgggtacccgttaccggtaacggtcccgaaccggacccggtacgggtaccctccccgggtacccccgttcgggtacccttaccccgg

SEQ ID NO: 26317 - DNA, 295 bp, Homo sapiens
  misc_feature: GYAE6OF02GDP7A.25.36.D03.1.454.CMB.1.raw
  modified_base (290)..(295): a, c, t, g, unknown or other
  misc_feature (290)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtggagatcaaacgaactgtggctgcaccatctgtcttcatcttcccgcatctgaactgtacagtctgagcggctggcaaggcgcatagnnnnnn

SEQ ID NO: 26318 - DNA, 689 bp, Homo sapiens
  misc_feature: GYAE6OF02GCABS.25.36.D03.1.454.CMB.1.raw
  modified_base (348)..(348): a, c, t, g, unknown or other
  misc_feature (348)..(348): n is a, c, g, or t
tcagactgtacagtcacgaccggtgctcgatttagctgcgtcacgatcgtctcttggggagctctgggagaggacgcccagcactagaagtcggcggtgtttccattcggtgatcagcactgaacacagaggactcaccagtggagtttgggctgagtcttgggttttcctcgttgcttcgttttaagaggtgtccagtgtcaggtgcacgtggtggagtcgtgggggagcgtggtccaggccgtgggacgtccctgacgccttctcctggtcgaacgtccttcgtaggttacttttagtttccaggttggttcctgggactagttcggctacggtccggggtacccnccggacggtccgtccgagggccgaaggggggtccgtaggtcggttggactaaggttatacgcaacagtacgagttaggtaagttcgtagtaagttattagtacgacacgtaccgtcggtaggaacgggtcctacgttccacctagtaccgtaccgaaggtaactaaccgttaaccgtacccggaaattactttacgggtaacggttaacgttagggtaaacgttcgggtacaacggtcgttaaggacggtacggtacgacggtaccgtcggtacttcggttattaacgttcggaggttcgacggtaggtacgggtacgggtaggttaggtagtttaaccgg

SEQ ID NO: 26319 - DNA, 298 bp, Homo sapiens
  misc_feature: GYAE6OF02JHHZV.25.36.D03.1.454.CMB.1.raw
  modified_base (269)..(269): a, c, t, g, unknown or other
  misc_feature (269)..(269): n is a, c, g, or t
  modified_base (286)..(287): a, c, t, g, unknown or other
  misc_feature (286)..(287): n is a, c, g, or t
  modified_base (289)..(298): a, c, t, g, unknown or other
  misc_feature (289)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttatactgcaacaatataataatattcgaccactttgccagggaccaaggtggagatcaaacgaactgtaggctgcaccatctgtcttcatcttcccgcatctgaactgtacagtctgagcgggntggcaaggcgacatagnntnnnnnnnnnn

SEQ ID NO: 26320 - DNA, 582 bp, Homo sapiens
  misc_feature: GYAE6OF02ITXC3.25.36.D03.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (410)..(410): a, c, t, g, unknown or other
  misc_feature (410)..(410): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctcggggacccccgggnaggagggtcctccatcttcttgttctgggancagctccgacgtcggaaattagtttgtcctatggtaccagcagcctaccaagaaaccggccccaagcctcctcatctanaggaatgatcacgcggcctagaggactaccngactnttcnctgctacgatctggcctccgtacgccctccgtacggctactcgtaggtcggcctccgggtcgaggntaggacgtctagaattcttacgtgtcgtacgtagggtttggatcgggactagtcgtagaggttcggtaccggtagggttcggtcgggacggaacgggacgacgtcgtaccgaccggttacgagggtacacgacccgtaagtcccgtccgtccccggtcggtccaccgttccg

SEQ ID NO: 26321 - DNA, 294 bp, Homo sapiens
  misc_feature: GYAE6OF02FSJT0.25.36.D03.1.454.CMB.1.raw
  modified_base (252)..(252): a, c, t, g, unknown or other
  misc_feature (252)..(252): n is a, c, g, or t
  modified_base (290)..(294): a, c, t, g, unknown or other
  misc_feature (290)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatcngaactgtacagtctgagcgggctggcaaggcgcatagnnnnn

SEQ ID NO: 26322 - DNA, 344 bp, Homo sapiens
  misc_feature: GYAE6OF02IPCEH.25.36.D03.1.454.CMB.1.raw
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (323)..(344): a, c, t, g, unknown or other
  misc_feature (323)..(344): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgcaacttattactgaccaacaatataataattatacgacctacttttcggaccaggggaccaaggtagganatacaaagaactgtggctcgcacctatcgtnttaccttntacttccgtcccgcctaatccgttagaacttgtacacgtctagacggcggagtcggcgaaggctcaagtacgnnnnnnnnnnnnnnnnnnnnnn

SEQ ID NO: 26323 - DNA, 306 bp, Homo sapiens
  misc_feature: GYAE6OF02F4M62.25.36.D03.1.454.CMB.1.raw
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (295)..(306): a, c, t, g, unknown or other
  misc_feature (295)..(306): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtgagatacaaacgaactgtaggctgcaccatctgtcttcactcttcccgcatcngtaactgtacagtcngaggcggctgggcaaggcgcatagnnnnnnnnnnnn

SEQ ID NO: 26324 - DNA, 383 bp, Homo sapiens
  misc_feature: GYAE6OF02GAWJO.25.36.D03.1.454.CMB.1.raw
  modified_base (349)..(383): a, c, t, g, unknown or other
  misc_feature (349)..(383): n is a, c, g, or t
tcagactgtacagtcacgaccggtgctcgatttagctgcgtcacgatcgtctcttgggatagaagttattcagcaggcacacaacagaggcagttccagaattcactcctcaccatcagcagcctgcagcctgatgattttgcaacttattactgaccaacaatactaataattacttcgacctacttttggacccgtaggggaaccaagggtggagactaccaaaacgtaacgtggtcggcctggaccaccactactcgtcttcaacttccttccccgccaattccttagaaacttgtaacacggttcctggacggccgggctggacgtaaacggcggactagtaggnnnnnnnnnnnnnnnnnnnnnnnnnnnnnnnnnnn

SEQ ID NO: 26325 - DNA, 533 bp, Homo sapiens
  misc_feature: GYAE6OF02JISD1.25.36.D03.1.454.CMB.1.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (431)..(431): a, c, t, g, unknown or other
  misc_feature (431)..(431): n is a, c, g, or t
  modified_base (449)..(449): a, c, t, g, unknown or other
  misc_feature (449)..(449): n is a, c, g, or t
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctggcctgactcaactgcctcgtgtctgggtctcctggacgtcaatcacatttccngcactggaaccngcactgatgtggctacttgacttgtctcttggtacaacacaccggacaaggctaccaactcattaattttgacgaccagtaacgcggcctcgttgggttctagtcgattcactggctcaagtctgacacacgccctacctaacactctcgtcgggcctccgaggctagaacgacgaggtcttgttattctgtctgttgactagtgngtctagaaactagttggngcgtcggcggacggacctaagttcgacgttgtagtcacgccaaggtcctacgccccgtcggtccactccgtcgttccccgtccc

SEQ ID NO: 26326 - DNA, 651 bp, Homo sapiens
  misc_feature: GYAE6OF02G1CMY.25.36.D03.1.454.CMB.1.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtctccatctcttgttctgggancagctccgacgtcggaaattagtttgtctactggtaccagcagctccagaaccggccccaagctcctcatctataggaatgatcgagccggccctcgagggactaccgtgaccgtatttcctcgtcggctacgtaagttccgtacggccttcccgtccggcccttcccgtggccctagtccgaggttcgggcctcccgggtccgaggtacgtgacggtctagtaacttacgttacgtggtacggtcgtagggttttcgggacttcggaccgtaggttcgttagggtacggttaccggggttcccggtaacggggtttcgggttacccggggacggggtaaccggggtacccgaacgggtccgtaccgggtaacccgttccggtacggggtaccctacgggaccccgtaacgggg

SEQ ID NO: 26327 - DNA, 845 bp, Homo sapiens
  misc_feature: GYAE6OF02JKQFK.25.36.D03.1.454.CMB.1.raw
  modified_base (179)..(179): a, c, t, g, unknown or other
  misc_feature (179)..(179): n is a, c, g, or t
  modified_base (340)..(340): a, c, t, g, unknown or other
  misc_feature (340)..(340): n is a, c, g, or t
tcagactgtacagtcacgaccggtgctcgatttagctgcgtcacgatctctcttggggagctctgggagaggagcccagcactagaagtcggcggtgttccattcggtgatcagcactgaacacagaggactcaccatggagtttgggctgagctgggttttcctgttgctctttaagnggtgtccactgtcaggtgcacctgggtggagtcgtgggggggacgcggtggtcccaggcccgtggggacggtccctggacgacttctccgtgtgaagtcctcgtggtattttaggttcaaggttcggttcgtggtccagttcgcctacggtcggggtcccnccgagggcctaccgagggccgaaacggggggcccggtaggttcgggttcgggaccttaggtttaacgaggccgtaactaggttacggagttacgggtaaacgtttcctaagggtaaatttagtttaacgcggtaaccgaacgggtaccctacccgggttaaggggaaaccggggtccccgtaaagtttacccaaccgttaaacgttcccggtaacccgtaaagggttaaaccggaaacccgttaaacggttcccccgggaaaatttaggtttaccgggttacggttaaaccggtttagggtaaaaccgttcggggtttaacccgaacggtttacccggttaagggaccggtaaacgggttacccgggaaacgggttccggttacccggtacggttttaccggtaacggttttaacccggttaacgtttacggggttacggaccgggttaagggtaccggttaaccggggggtaaggggtttaccggttagggttttaaacccggg

SEQ ID NO: 26328 - DNA, 634 bp, Homo sapiens
  misc_feature: GYAE6OF02ISCHS.25.36.D03.1.454.CMB.1.raw
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatcgacccagtcctccactccctcctgtctgcatctggtgagacagatcagcatcacgttggccggcgagtcgaggctattagactaagtttattacgccgttaggtactacaaacgaacgaaaccggagggacgtacgttacctaacgcctccgtagacttctatcgtctcgcctactacgttaccacgtcggacggtcctagttccgtcgtcgacggtcgcgtagtcgaagtcggtagggactagtacgttcctacgtcctacgtactagtaccgacgtcgaccgttcctcgaccgtaccgtacgttaggaagtcgttacgtcgttaacgttaaacctttagttaacgtaagttaaacgttaaattacgttaacttacccgtacccgtcccttacgttacccgtacgggtttacccgggaacggttaaccggggaccgttaacgggtacggtaccgtacgtaaacccggg

SEQ ID NO: 26329 - DNA, 640 bp, Homo sapiens
  misc_feature: GYAE6OF02GZZ12.25.36.D03.1.454.CMB.1.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (344)..(344): a, c, t, g, unknown or other
  misc_feature (344)..(344): n is a, c, g, or t
  modified_base (392)..(392): a, c, t, g, unknown or other
  misc_feature (392)..(392): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagcccaccctcagtgtctcggggacccccggnaggaggtctccatctcttgttcngggancagctccgacgtcggaaattagtttgctactcggtaccagcagctcccaacgaaccggcccccaagcctcctacatctataggatgactcgacgccggccctgaggtactaccgtgaccgtnttccgtacgtggcctacgaacgttcgtcggccttccgtcgtccctccncggccagtcgaggtcgggtcctccgggtcgaggctggacggtctagtaacttacttacgtcgtgcgttaggttgggtactcgccgtagttcgtaggtacgggttcggtaccgggtgggttccggttacgggacggggaaccgtaccgaggtccgtaccgggaccggtttaccggtacggtacccgaccgacccggtaacgggtcccgttcccggaccccccgttcgggttaccctccgtttaccccgg

SEQ ID NO: 26330 - DNA, 297 bp, Homo sapiens
  misc_feature: GYAE6OF02IDHIE.25.36.D03.1.454.CMB.1.raw
  modified_base (289)..(297): a, c, t, g, unknown or other
  misc_feature (289)..(297): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgccaacaatataataattatcgaccacttttggccaggggaccaaggtggagatacaacgaactgtggctgcaccatctgtctcatcttcccgccatctgaactgtacagtctgagcgggctggcaggcgcatagnnnnnnnnn

SEQ ID NO: 26331 - DNA, 340 bp, Homo sapiens
  misc_feature: GYAE6OF02F0CB5.25.36.D03.1.454.CMB.1.raw
  modified_base (302)..(302): a, c, t, g, unknown or other
  misc_feature (302)..(302): n is a, c, g, or t
  modified_base (306)..(340): a, c, t, g, unknown or other
  misc_feature (306)..(340): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtggagatcaaacgactgtggctgcaccatctgtcttcatccttccccgctatctgaactgtaccagtctggacggcggcgtggcaacggcgacagtaaggnacgnnnnnnnnnnnnnnnnnnnnnnnnnnnnnnnnnnn

SEQ ID NO: 26332 - DNA, 710 bp, Homo sapiens
  misc_feature: GYAE6OF02HG8IE.25.36.D03.1.454.CMB.1.raw
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcggggacccccgggaggagggtctccattcctcttgttcgtggggacgcacgcttccgacggttacggaaataagtttgtctactggtaccagtcagcctacccagaaacccggccccgaacgcctcctacacttcgtaacgtaggaatagactcgacggcccggaccctaggaacgggtactacccgaggaacccgtatttccgtacgtggaccttcgtaacgttcgtacggtccttccgtaccggcccctcccgtcggacccagtcgtacggtcggacgtccgggtaccggaggtatacggacgtcgtaagtaagttaagttacttacggtgttaccggttagggtttacgggacgtaccggtaccgtaagggttcgtaaggtaccgggtttccgggtaccggttacgggggttccggttaacgggggaccggggtaacgggtacccgtaacgggtccgtacggtaaccccggttaccggttacgggaccggtaccggtacccggtaccggg

SEQ ID NO: 26333 - DNA, 876 bp, Homo sapiens
  misc_feature: GYAE6OF02INLIC.25.36.D03.1.454.CMB.1.raw
  modified_base (167)..(167): a, c, t, g, unknown or other
  misc_feature (167)..(167): n is a, c, g, or t
  modified_base (183)..(183): a, c, t, g, unknown or other
  misc_feature (183)..(183): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccagtggagtttgggctgagctgggttttccngttgcttctttaaggnggtgtccactgtcgaggtgctaccgtggtggacgtcggtgggggaggtcgtggtccgaggccgtggggacgttcccgtggacggtaccgttccgtaccgtggttacggaacggtcccttcggttcgggttaagttttacggttttccgtaagggtttcgggtttcctgggtcctaggttcggtaccgtacggttccggggtcccgcccgtaggtcccttaccggaacggggaccggaaaccggggggtcccgggtaagggtttcggggttacgggaccgttaaggtttaacggtaacggacccgtaacggagtttacgggtaaagtttacggggttaaaacgttttccgtaaagggttaaatttaacgtttaagcggtacccgtaacggtacccgttacccgggtaggaaaccggggtacccttacgttaccgaaccgttaacgtcccgttaaccggaacgtaaaccggtaaccgttaaaccgttaccccggtaaattaacgggttcctttaaacgggttaaccgggttaaaggttaacggtaccggggtttaaccgacggtacccttaaggggacggttaaccgggtacgggtaaccggtaaccggtcgggtacgttaaccgttaggttaccgttagtacgggtcgtacggaacggttgggtaacggggtaggttacggttaagtttacggg

SEQ ID NO: 26334 - DNA, 611 bp, Homo sapiens
  misc_feature: GYAE6OF02JI092.25.36.D03.1.454.CMB.1.raw
  modified_base (134)..(134): a, c, t, g, unknown or other
  misc_feature (134)..(134): n is a, c, g, or t
  modified_base (594)..(594): a, c, t, g, unknown or other
  misc_feature (594)..(594): n is a, c, g, or t
  modified_base (598)..(598): a, c, t, g, unknown or other
  misc_feature (598)..(598): n is a, c, g, or t
  modified_base (601)..(603): a, c, t, g, unknown or other
  misc_feature (601)..(603): n is a, c, g, or t
  modified_base (605)..(611): a, c, t, g, unknown or other
  misc_feature (605)..(611): n is a, c, g, or t
tcagactgtacagtcacgaccggtgctcgatttagctgcgtcacgatctctcttgggcagtccaggggagggcctgaagtgggtcggcctcatgagaccgagggcctctgggagggacagtgggagcatgacgngtctctgatgggcaggttcagcctctcaagggacgactctaaagccatcgcctatctgacaaatgaccagcctgacagtcgaagactcagccattctaattattgtgcgagactgcctgtctctgagttcggggtacttagttggacgtaactacttcacttacttcccacatggtacgtttcggggcaacggggtactacggtcaagtcgtctccctcctacctaccaccgtaacgggccctaacgtcccggttaccttcccccgtacggtccgtaccccctccttaccgaacgaccgtcctaacccgtcgttcgggggaccaaccgcgggtacccggtcccggtacgggccttacgtcccggtagtaccgtaaacggccttacctacccgttactacggtactacgttacgtcgaacgggccgggtcgtaggtccggaacggtccgactacgtaggcngtcncgnnngnnnnnnn

SEQ ID NO: 26335 - DNA, 294 bp, Homo sapiens
  misc_feature: GYAE6OF02FO54B.25.36.D03.1.454.CMB.1.raw
  modified_base (287)..(294): a, c, t, g, unknown or other
  misc_feature (287)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacactttggccaggggaccaaggtggagatcaaacgactgtggctgcacatctgtcttcatcttcccgccatctgaactgtacagtctgagcgggctggcaaggcgcatagnnnnnnnn

SEQ ID NO: 26336 - DNA, 328 bp, Homo sapiens
  misc_feature: GYAE6OF02HST6L.25.36.D03.1.454.CMB.1.raw
  modified_base (320)..(328): a, c, t, g, unknown or other
  misc_feature (320)..(328): n is a, c, g, or t
tcagactgtacagtcacgaccggtgctcgatttagctgcgtcacgatctctcttgggatagaagttattcagcaggcacacaacagaggcagttccagaattcactctcaccatccccagcagcctgcagcctgatgtattttgctaacttattactgaccaacaatataataattattcgacctacttttggaccgaggggaccaaggtgagatacaaacgaacgtgtggctgaccaccatctcgttcttctattccttccccgcctatctagaacttgtacagttctggacgtcggggctgggcaacggcgccatagnnnnnnnnn

SEQ ID NO: 26337 - DNA, 298 bp, Homo sapiens
  misc_feature: GYAE6OF02F4AHG.25.36.D03.1.454.CMB.1.raw
  modified_base (285)..(285): a, c, t, g, unknown or other
  misc_feature (285)..(285): n is a, c, g, or t
  modified_base (291)..(298): a, c, t, g, unknown or other
  misc_feature (291)..(298): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccactttggcaggggaccaaggtgagatacaaacgaactgtgctgcaccatctgtctcatctcccgctatctgaactgtactagtctagacggcggtcgtggcaaggcncatagnnnnnnnn

SEQ ID NO: 26338 - DNA, 297 bp, Homo sapiens; identical to SEQ ID NO: 26196
  misc_feature: GYAE6OF02GH4WC.25.36.D03.1.454.CMB.1.raw
  modified_base (290)..(297): a, c, t, g, unknown or other
  misc_feature (290)..(297): n is a, c, g, or t

SEQ ID NO: 26339 - DNA, 650 bp, Homo sapiens
  misc_feature: GYAE6OF02GKB97.25.36.D03.1.454.CMB.1.raw
  modified_base (352)..(352): a, c, t, g, unknown or other
  misc_feature (352)..(352): n is a, c, g, or t
  modified_base (487)..(487): a, c, t, g, unknown or other
  misc_feature (487)..(487): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagcccaccctcagtgtcgtggggaccccccgggcaggagggtcctccatctcttgttctgggagcagctccgacgtcggaaataagtttgtctactggtaccagcagcctaccccagaaaccggcccccaagcctcctcatctagtaggatgatcgagccggccctgagggtactacctggacctattcncgtggctacggagtcgtcgcctccgtccggcctcccgtggccctagtcgtaggtcgggcccttccgggtcccgaggacgtggacgtcgtagtaacgttacttacgtggtcgcttaagggtttggactcggtaccnggttcttagggttacggtccgggttaccgggtcgggtttcggttaccggggacgggtaacgggaccctaggtccgtacgggtaaccccggttctaacggggtcccaccggtaccgaaccgggttcccgtcccggtccccggtacggttcctaccgtttccccg

SEQ ID NO: 26340 - DNA, 305 bp, Homo sapiens
  misc_feature: GYAE6OF02HESX4.25.36.D03.1.454.CMB.1.raw
  modified_base (294)..(305): a, c, t, g, unknown or other
  misc_feature (294)..(305): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtggagatcaaacgaactgtggctgcaccatctgtcttcatccttcccgcatctgaactgtacagtctggagcgggctggcaaggcgcagtagnnnnnnnnnnnn

SEQ ID NO: 26341 - DNA, 294 bp, Homo sapiens
  misc_feature: GYAE6OF02IEOL9.25.36.D03.1.454.CMB.1.raw
  modified_base (285)..(285): a, c, t, g, unknown or other
  misc_feature (285)..(285): n is a, c, g, or t
  modified_base (291)..(294): a, c, t, g, unknown or other
  misc_feature (291)..(294): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatccttccgccatctgaactgtacagtctgagcgggctggcaaggcncatagnnnn

SEQ ID NO: 26342 - DNA, 783 bp, Homo sapiens
  misc_feature: GYAE6OF02GCDMC.25.36.D03.1.454.CMB.1.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
tcagactgtacagtcacgaccggtgctcgatttagctgcgtcacgatctcgtcttggggagcttcagctgtggtagagaagacaggatttcaggacaatctccagcatggccggcctccctctctcctcaccctcctcactcactgtgcagggtccgtggccctagtctgtgctgactcagccacctcagtgtcgtcgggaccccggnaggtaggtctcatctcttgtctgggatcngctccgacgtacggaaattagttcgtactacgttcggtaccagtctacgtacctacccgtaacggaaaccccggccccccgtaaagcccttacccgtaccgtacgtaccgttaagtaaccggtaaagtcgtactaccggaccggtcccggtaccccttaccgggtaagggtaccttaacccgtacggaccgttaacttttccgtccgttacggtacgttaaccggaacgtttccggtcggtcccctaccggttcccggggtaccccttccccggtacggacccgtacgttacggggtaccgggttcggggtcccgttacccggggttaccgggtaacggtaggttacgggacggttcgttaaagtaacgtttatttaccggtggttacgtcggttagggtttcggtacgtaccggtaccgtagttcgtaagggttacgggtccggtaccgggttaagggtcccgggttacgggggacggtaacccgggagtaccgtccggttaccggcccggttaccgtaggtcccgtaccgccggttaacccggg

SEQ ID NO: 26343 - DNA, 798 bp, Homo sapiens
  misc_feature: GYAE6OF02IC57O.25.36.D03.1.454.CMB.1.raw
tcagactgtacagtcacgaccggtgctcgatttagctgcgtcacgatctctcttgggggagctctgggagaggagccccagccctgagattcccaggtgtttccattcagtgatcagcactgaacacaggaggactcaccagtggtagttgggactgagtcgtggttacttttttccgttttggtactttaaagtttttaaaaggtcgtacctaggttgtagtaagtgactaacgtgggtaggtagtcggtggggggagtcgttggtacagccgtggcgaccggtccctggacgtaccttctccgtgtcgcacgtcctcgtaggtacttcctaccgtttaggattagtatttacgtcggtacctagtcggtacctacggttccggggtacccggacaacggtcccgtaccgggaagggggaccggtccggtaggggtacggttcgggtctacggtaaggtttacgtttaagggttaggtaaacgtttgggtaggtaacgacgttaaggttaacggttaccgttaggtcgggacccgggttaactttcgggttaagggtaacccgggaaacggggttccccttaagtttaccccgaacgttacgtttcccgaaccgaaggtaaaccgaaacccgtaaccggaaccctaaaggttacccccttaccgtagttaccgtccgtaagaaacgtaaacgttcgaaacgttcgttacgagaacgtcggtacgaagggacccggtacgtccggtttacttaaggttacttacgtaggtaaactaaaactttaattaccgttaacgg

SEQ ID NO: 26344 - DNA, 657 bp, Homo sapiens
  misc_feature: GYAE6OF02HC14D.25.36.D03.1.454.CMB.1.raw
  modified_base (200)..(200): a, c, t, g, unknown or other
  misc_feature (200)..(200): n is a, c, g, or t
tcagactgtacagtcacgaccggtgctcgatttagctgcgtcacgatctctcttggggagctctgggagaggagcccagcactagaagtcggcggtgttccattcggtgatcagcactgaacacagaggactcaccatggagttgggctgagctgggttttcctcgttgctacttttaagaggttgtccactgtcaggtncacgtggtggagtcgtgggggagcgtgggtccaggccgtggggacgtccctaggagaccttcgtcctggttgaacggtcctcgtaggtatttaagttcgtacgttggtcttttgggctagttcgctacgtcgggtcccgccgacggtctccggaggaccgaacggggccgggaggttcgggtcggtacgtagttagtacgtacacgagtggacgtaggtacgttactaggtaattaagttatagcagtaacgtccggtagggaacggccgtaacgtcaacgtactcgtaccagaacgtaacaacgttaccggaatagttcgtagttacgttaggaacgttggtcaagtccgtagtagacgtacgaggtaccgtcggtacctggttcttaacgttacgttacggtaggtaccgtaggaaccggttacgggggtaagttacgggtaaggtttaaacggg

SEQ ID NO: 26345 - DNA, 293 bp, Homo sapiens
  misc_feature: GYAE6OF02I25KW.25.36.D03.1.454.CMB.1.raw
  modified_base (257)..(257): a, c, t, g, unknown or other
  misc_feature (257)..(257): n is a, c, g, or t
  modified_base (288)..(293): a, c, t, g, unknown or other
  misc_feature (288)..(293): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgatttgcaacttatactgccaacaatataataattattcgacctactttggccaggggaccaaggtgagatcaaacgactgtggctgcaccatctgtctcatcctcccgcatctgaactgtacngtctgacgcgggctggcaagggcgacatagnnnnnn

SEQ ID NO: 26346 - DNA, 693 bp, Homo sapiens
  misc_feature: GYAE6OF02I7426.25.36.D03.1.454.CMB.1.raw
  modified_base (616)..(616): a, c, t, g, unknown or other
  misc_feature (616)..(616): n is a, c, g, or t
tcagactgtacagtcacgaccggtgctcgatttagctgcgtcacgatctctcgttggggagctctgggagaggacgccccagccctgagattcccaggtgtttccattcagtgatcagcactgaacacagaggactcaccagtggagttgggactgagctggtatttttccgtttggcttaagttttaaaaggtcgtccagttgtagaagtgacaactgggtggagtcggtagggggagtcgttaggacagccgtggcgacggcccgtgacgcctccgtcgtgtcgcacgtcctcgtggtacttctacgttgacttgtattactcgcctattcggaccgtacggtcgggtacccgagaacgtccgtaccgggaaggggaaccgtccggtagggtacggtcgggtactacggtaggttagttaggttagaagttggtagtaacgcgtaagtacggtctaaggtggtaccgtacgttcggttacggtagggtaccgtaccgtattacccgactaacgttccgaaccgtagggacgaaaccgaccgtaccaaacggtaccctcgtacgttacctcgtaacgaactaaacggtacaacggttactacgtagaccggttanaccggtaggaaaccggtcgtacccggttcgttaagtacggttacgtagaacgttaaaacttaaacggtttgttaacg

SEQ ID NO: 26347 - DNA, 701 bp, Homo sapiens
  misc_feature: GYAE6OF02ISH74.25.36.D03.1.454.CMB.1.raw
  modified_base (586)..(586): a, c, t, g, unknown or other
  misc_feature (586)..(586): n is a, c, g, or t
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggtattttcctttggcttattttaaaggtgtccagtgtgaagtgcaacgtggtggagtcgtgggggagtcgttggtacaggccgtggcacggcccctgacgactctccgtgtcgcgacgccttcgtgggtacttcctaaccgtttggacttaggatttagcgtcccaagttcgactacggttcgggtaccggactaaacggtcctaccggaagggggaacgggtccttaggggaacggttcggggttactacggtaaggttagtttaggttaggaaagttacgggtggtacgacgtaagtagggtcttaagttcggacggttaactggtaggtacggaacgggtcctagttaccgacctagtaccctacgaagacgaacccgaacgaccgtaaacggtaacccttccggttacgttaaactccgggtanaaaccgtaagtacgtaaacgtacgttcgaaggacgtacggcgtaaggaacggacctacggttaccttttaggaacctttacggagtaacggtaaactaaaacggtttagttaccg

SEQ ID NO: 26348 - DNA, 725 bp, Homo sapiens
  misc_feature: GYAE6OF02FMQAI.25.36.D03.1.454.CMB.1.raw
  modified_base (208)..(208): a, c, t, g, unknown or other
  misc_feature (208)..(208): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctggaggtgaagnggcctgggtcctcggtgagggtctccgtgtaaggtctccggaagcagtgtgttcgtcgagacatacactcacctgggtccggcaggcctcgtggaactgggccctggacggtggggtcggaacgaagtaccgaaccggccgaacggaccgggaacaacgaggacggtcgcaacatcgtaagttaccgaggggtcaaggtacgtacctaacccgtttttccggtagggaacctaaaggttaccccgaacggggtccgtaccgtaacggttaaacgtaaccgtaacgttaggaaaacttccgtacgtaaaccgttcggtaacccttggtacccggttagttttacgggaccgggtaccgtaccgggtaccggttaattaacgttaaccgtggttacggaccgaaggtaaacggcgttacccgtaggtaccccttaaccgtaaaaccggttcgtaaaccgtacggttcccgtaagggtccccgtttaacccgggtaccccccggtgggggtaacccccgg

SEQ ID NO: 26349 - DNA, 717 bp, Homo sapiens
  misc_feature: GYAE6OF02HCM3F.25.36.D03.1.454.CMB.1.raw
  modified_base (234)..(234): a, c, t, g, unknown or other
  misc_feature (234)..(234): n is a, c, g, or t
  modified_base (527)..(527): a, c, t, g, unknown or other
  misc_feature (527)..(527): n is a, c, g, or t
tcagactgtacagtcacgaccggtgctcgatttagctgcgtcacgatctctcttgggggcagaagtctctctcagtcaggacacagcatggacatggagggtccctgctcagctcctgggactcctgctgctctggctcccagataccagatgtgacgtccagatcgacccagtcctccatccctcctgtctgcattctggttggatacagaatcagcatcacgttggccgggngagtcgagggactagttagactaagtttattgccgttaggtataccgaaacgaacggaaaccgtagggacgtaacgtttaccctaaagtcctaccgtaggtacttaccttagtcgtacctccggtacccttacccgtaaacggtttacacccggttaccgggtaaccgggttccctaagtttcccggttccggttaccaggggtccggataacggtacgtaacgttcgggtacgggtaaacaacggttacgttacctacgtcctaactacctacgtcgaagtaccacgtccgngtaccgacgtacctaagggtaacgttcgttacgtttaccgaactttaacgttttaactacggttaaacttaaactaaagttacttaacggtccctacccgtaccccgttattaccggttaacccgggtttacgggaaccggggttaaccggaaggtaacgggttaacggtaaccgtaaggttaaacccgg

SEQ ID NO: 26350 - DNA, 299 bp, Homo sapiens
  misc_feature: GYAE6OF02G190F.25.36.D03.1.454.CMB.1.raw
  modified_base (264)..(264): a, c, t, g, unknown or other
  misc_feature (264)..(264): n is a, c, g, or t
  modified_base (293)..(299): a, c, t, g, unknown or other
  misc_feature (293)..(299): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcagtccttcccgcatctgaactgtacngtctgagcgggctggccaaggcgcatagnnnnnnn

SEQ ID NO: 26351 - DNA, 295 bp, Homo sapiens
  misc_feature: GYAE6OF02FOQEF.25.36.D03.1.454.CMB.1.raw
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
  modified_base (290)..(295): a, c, t, g, unknown or other
  misc_feature (290)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtggagatcaaacgaactgtggctgcaccatctgtctcatcttcccgcatcngaactgtacagtctgagcgggntggcaaggcgcatagnnnnnn

SEQ ID NO: 26352 - DNA, 652 bp, Homo sapiens
  misc_feature: GYAE6OF02GK0TC.25.36.D03.1.454.CMB.1.raw
  modified_base (306)..(306): a, c, t, g, unknown or other
  misc_feature (306)..(306): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggacgtccctgagctctcctgtgaagcctctggatttagttcagtggttctggcatgcacgtgggtccnccaggcctccgaggccgaagggggccggaggtgggtggctagttatagcacatgatggaagttcagaatattatgacagactcgtgaacgggtcctattccactatcctaccaagtacgactaacgttcccggaatacgttagtacgttaaccgttagggtaaacgttcggttacgaacggttacccgtaggtaacggtaacgttacgggaacgggttaccggttccgggtacccttacggttacggtttaacgttttaacccggttagggttacggtaacggtaacggggttaacgggttaccggggggttaacgggtttagggggtttaaggttttaaccgggg

SEQ ID NO: 26353 - DNA, 818 bp, Homo sapiens
  misc_feature: GYAE6OF02GBS1Z.25.36.D03.1.454.CMB.1.raw
  modified_base (183)..(183): a, c, t, g, unknown or other
  misc_feature (183)..(183): n is a, c, g, or t
  modified_base (224)..(224): a, c, t, g, unknown or other
  misc_feature (224)..(224): n is a, c, g, or t
  modified_base (348)..(348): a, c, t, g, unknown or other
  misc_feature (348)..(348): n is a, c, g, or t
  modified_base (413)..(413): a, c, t, g, unknown or other
  misc_feature (413)..(413): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgcttcttttaagnggtgtccactgtcaggtgcaccgtggtggagtcgtgggggngcggtggtccagccgtgggacggtccctggagtaccttctcctgtcggaacgcccttcgtgggttattttagttttcgaggtttcgggtttacctgggtctagtcgctaccgttggggtccccnccggaggtcccgttccgagggtccggaaaggggggcccggtaggttcgggttggcgtagtttagnggacacgatgagtagggaagtttctagtaattagttaagtggactaggtacccgttacgggtacgggaacggggtacccgttaatttacccaacccgttacttacccggtacccgaaaggtaaccgtaaacccgtttaaaccgtttacccccgggaaaacttacggtttttaccggttaacggttttaaccggtttaacggggtaaaagtttccgggttaacccgtaacgggtttaccccggttaagaaacgggttaccgggttaacgggtacccgggtaacgttccgggtacccgtttacggtttccggttaaacgtttaccggtttcggtacgggtacccggttagggtaacgggtttaacccgggggtaggttttacgggggttaacgttttaaaccggggg

SEQ ID NO: 26354 - DNA, 630 bp, Homo sapiens
  misc_feature: GYAE6OF02FTX6T.25.36.D03.1.454.CMB.1.raw
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggaccccccgggcaggacgggtctccattctcttgttcgtgggagcgagcctccgtacgtacggaaattaaggtttgtctacttggtaccagcagctcccagaaccggccccaagcctcctcatctagtagaatgatcgacgcggcctcgagggactaccgtgaccgtattctcgtcgcgtacgtagtcgtcgtcctccgtccggtcccttcccgtcgtccatcgtcggtcgggccgttcccggcggtagacgtcggacggtctagtaattacgttactgtcgtcgttgggtttagggagttcgccgtagtcgttagggtacgttcgggttaccggtcgggttcgggttccggggacgggaccgggtaacccgacgggttacgtaccggtacccggtttccggtacggtaccgtaccgacccggtaacccggg

SEQ ID NO: 26355 - DNA, 369 bp, Homo sapiens
  misc_feature: GYAE6OF02H50C1.25.36.D03.1.454.CMB.1.raw
  modified_base (206)..(206): a, c, t, g, unknown or other
  misc_feature (206)..(206): n is a, c, g, or t
  modified_base (322)..(369): a, c, t, g, unknown or other
  misc_feature (322)..(369): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataaataattattcgaccacttttggccaggggaccaaggtgganaagtcaaaacgaactgtgtctcgaccaccaagtctgtcttcatccttccccgactactctaggaaacctggtaccagtctagtagcgggcctaggacgaaagggcgcgaatagagnnnnnnnnnnnnnnnnnnnnnnnnnnnnnnnnnnnnnnnnnnnnnnnn

SEQ ID NO: 26356 - DNA, 666 bp, Homo sapiens
  misc_feature: GYAE6OF02IGOQJ.25.36.D03.1.454.CMB.1.raw
  modified_base (199)..(199): a, c, t, g, unknown or other
  misc_feature (199)..(199): n is a, c, g, or t
  modified_base (344)..(344): a, c, t, g, unknown or other
  misc_feature (344)..(344): n is a, c, g, or t
tcagactgtacagtcacgaccggtgctcgatttagctgcgtcacgatctctcttggggagagaagacaggattcaggacaatctccagcatggcccggcctccctctccctcctccaccctcctcactcactgtgcagggtcctgggcccagtctgtgctgactcagcccaccctcagtgtccgtcggggacccccggnaggacgggtctccagttctctttgttcgtggggacgcacgcctacccgaacgtacgggtaaaattacggtttgtacctaacgtcgggtaaccagtcacgcctacccgaacggaaaccccgcccccaaagtcctcctcaatctaanaggaatgatcgacgccggacctggacggactaccgtgacctattcctcgtcgactcgaacgttctcggtcctccgtccggtccctccgtcggcctagtcgaggtcggcccgtccggcgaggtacgtggacgtctagtaattagttacgtgtcgacgttagggtttggagtcgaccgtagttcgtaggtcggtcgggtaccgtcgggttcggtacgggcgggaacggtaaccgacgtcggtaccggtacccggttacgtcgggacctaaccggacccggtacggtcccgtcccggttcccccggtacggtcctacccgttccg

SEQ ID NO: 26357 - DNA, 331 bp, Homo sapiens
  misc_feature: GYAE6OF02F2JT0.25.36.D03.1.454.CMB.1.raw
  modified_base (266)..(266): a, c, t, g, unknown or other
  misc_feature (266)..(266): n is a, c, g, or t
  modified_base (296)..(296): a, c, t, g, unknown or other
  misc_feature (296)..(296): n is a, c, g, or t
  modified_base (300)..(331): a, c, t, g, unknown or other
  misc_feature (300)..(331): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgctaacttattactgaccaacaatataaataattatcgacctactttggccaggggaccaaggtggagatacaaacgaactgtggctgcacatctgtcttcatcttcccgcatctagaactgtacngtctgagcgggctgggcaaggcgacatagnacgnnnnnnnnnnnnnnnnnnnnnnnnnnnnnnnn

SEQ ID NO: 26358 - DNA, 301 bp, Homo sapiens
  misc_feature: GYAE6OF02GSZ73.25.36.D03.1.454.CMB.1.raw
  modified_base (294)..(301): a, c, t, g, unknown or other
  misc_feature (294)..(301): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatacaaacgaactgtggctgcaccatctgtcttcatcttcccgccatctagaactgtacagtctgagcgggctgggacaggcgcatagnnnnnnnn

SEQ ID NO: 26359 - DNA, 664 bp, Homo sapiens
  misc_feature: GYAE6OF02IECN6.25.36.D03.1.454.CMB.1.raw
  modified_base (596)..(596): a, c, t, g, unknown or other
  misc_feature (596)..(596): n is a, c, g, or t
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
  modified_base (651)..(652): a, c, t, g, unknown or other
  misc_feature (651)..(652): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
  modified_base (662)..(663): a, c, t, g, unknown or other
  misc_feature (662)..(663): n is a, c, g, or t
tcagactgtacagtcacgaccggtgctcgatttagctgcgtcacgatctctcttgggcagtccgaggggaggcctgaagtgggtcggcctcatgagaccgaggcctctggaggacagtggagcatgacgcgtctctgatgggcaggttcagccctctcaagggacgactactaaaagcccaatccggcctatctgacaaatcgaccagcctgacagtcgaagctcacgccatctaattatgtgacgagactcgccttgtcgttctgtagttcggggtacttagttcggaaccgtaactacgttctaacctttacttccccgaactagtcggtaccggttttaggggaccgtaaacgggggaccaaccggtcaacgttccgtccttccctacccgacccttcccgaaaccgaaccgggcccttacgtacccggttccccgtttacccccgagggtacccctaccccgttcccttaccgaaacgccgtacccaacccgtccgggtacgggaccgacgaacggcccggtcccgtggtaccgtcgtccgttacggtaaccgtaaacggccttaacctccgtacgtcgtaaccgcttacgngtaacgggtcggtaccgcggtacgaacgggtcgacgtaacgtgaccgtncngtgnngcgngncncnnc

SEQ ID NO: 26360 - DNA, 630 bp, Homo sapiens
  misc_feature: GYAE6OF02ILMG7.25.36.D03.1.454.CMB.1.raw
  modified_base (208)..(208): a, c, t, g, unknown or other
  misc_feature (208)..(208): n is a, c, g, or t
tcagactgtacagtcacgaccggtgctcgatttagctgcgtcacgatctctcttggggacataacaaccagattcttcctctaaagaagcccctggggagcacagctcatcaccatggactggacctggaggttcctctttgtggtggcagcagctacaggtgtccactcccaggtccagctggtgcaatctgggcctgaggtgaagnggcctgggtcctcggtgaggtctccgtgtaggtctcggagcagtgtgttcgtcagacatacactcacctgggtccggcacggcctcgtcgggaactcggggtcccttggacggtggggtacggaacgaacgtacgaaccgccaaccggaccggaacaacgacggacggtcgacacgatcgagtttcgagggcacgagtctaccgtttcgagactaacgcgacggcactagtactacagtagacttactacaacgtgaaccttggacttagttcggaccgggtacgaccggtccgttaagtactttaacgtggttacggacgaaggtaacgacgttccgtcggtacccttaacggtaaacggtccgaacgtacggccgttacggacccgttaccccgggtaccccggtacggggtaaccccgg

SEQ ID NO: 26361 - DNA, 822 bp, Homo sapiens
  misc_feature: GYAE6OF02IM7JZ.25.36.D03.1.454.CMB.1.raw
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcgatcacctatttcctgcacgtggactcagcactgatgttgacgtaggtttacttactttgtccttccgtacggtaccaacaaccacccgtaaggaccaaaccgtaccccctaaacttactacttaattttacgtacgacggaccctaacgtaacggcccgtacccctcggtaacggttacgtttactaacgttccgttacttccgttacgttcggtacctaccgtaaagttccgtacggtaccacggtcccgaaccggtccccttacccgtacgaaccgtaaccgttcctaccgggttaccgggtccgttaccgacggggtaccgtacgggaacgggtacgtacgggtacgttaacgttaactttaaaccgtttaaccgtcgttaacccgttaacgttacctaacgttaacggttacggaaaccttaaccgtaaacttaacccgaaaccgttaaacccgtttcccccggtttaaccggtttaaccccggggtaccggtttaacccggggaacccggtttaaccggggtaccccgtttaaacccgggtttccccgggttacggggtaaccctaacccccggggtaacccggtaaaccccggtaccccgtaaaccccccggg

SEQ ID NO: 26362 - DNA, 726 bp, Homo sapiens
  misc_feature: GYAE6OF02JLBIV.25.36.D03.1.454.CMB.1.raw
  modified_base (167)..(167): a, c, t, g, unknown or other
  misc_feature (167)..(167): n is a, c, g, or t
  modified_base (215)..(215): a, c, t, g, unknown or other
  misc_feature (215)..(215): n is a, c, g, or t
tcagactgtacagtcacgaccggtgctcgatttagctgcgtcacgatctctcttggggcagaagtctctctcagtcaggacacagcatggacatgagggtccctgctcagctcctgggactctgctgctctcggctcccagactaccagactgtgaccgttccaagntacgaccctagtcctaccatcccgtcctagtctgactatcctagtganacagtaactcgagctatcacgttgccggtcacgtcgaggctatagacgtaattagttacgaccgttggtactaacgaaactacgaaaaccgtaggtaacgtacgtacctaaggtcctacgtagtactctaagtcgtactcgtccctaccgtaaccttaccgaccgtacgtaccgggtacccctagttccgtaccgttacgacgggtccgtacctaagggtaccgtaacgttacggtaacgggtacgtaacggtaccgttaccgtaaccgttccgtaaacctaccgtacttaacgaccgtccgtacgtcccgttggaccctaaggtcccaagggttacacgtttgtaacccgtctttaaacgttactttaaacgtacgttaacttaaacgttaccgtaacgttacggttaaccgtaccggttaagggttacccgttacggttacccgggtaaccccggttaacgggaacccggttaaacgggttaccgtaacccgttacgttaaaaccgggg

SEQ ID NO: 26363 - DNA, 669 bp, Homo sapiens
  misc_feature: GYAE6OF02JN2M9.25.36.D03.1.454.CMB.1.raw
  modified_base (345)..(345): a, c, t, g, unknown or other
  misc_feature (345)..(345): n is a, c, g, or t
  modified_base (411)..(411): a, c, t, g, unknown or other
  misc_feature (411)..(411): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagttgggctgagcttgggttttcctcgttgcttctttaagaggtgtccactgtcaggtgctaccgtggtggagtcgtgggggaggtcgtgtatccgaggccgtggggacggttccctggactactctcctggtgaacgtcctgtggttattttacggtttcaggtttcggttcttgggctagtcgtccgtacggtcgggtcccnccgaggtcctccgagggcggaacgggggtccggaggttgggttacgacgtagttagacggcaacgngtggtaagtacgggtaatttctaggtaacttagtttagcgactagacgttcgtagggaggaccgtgtacactactctcaagacgtaacaacgttaccggtaatagttacgttaggttaacgttaggtaaagtcggtacaccgtcgtaggtaacggtcgttacggacggtaaccgtcggtacgttcggttaacgttacgtttagttccggtagggtaccggtaggtaacgggttcggggtagggtttagggttaacggg

SEQ ID NO: 26364 - DNA, 607 bp, Homo sapiens
  misc_feature: GYAE6OF02G5HAR.25.36.D03.1.454.CMB.1.raw
tcagactgtacagtcacgaccggtgctcgatttagctgcgtcacgagtctctcttggggagctctgggagaggagccccagccctgagattcccaggtgtttccattcagtgatcagcactgaacacagaggactcaccatggagttgggactgagctggattttcctttggctattttaaaggtgtccagtgtgaagtgcaactggtggagtcgtgggggagcttggtacagcctggcaggcccctgagactctcctgtgcagcctctggacttcacctttgactgtattagcgccatcggcacgtcgggtccgacaacgtcctaccggaagggggaacgggtcctaggggaggttcggggtacctacgaagggttagtttacggttaggaaagttaggtaggtagactagtacgggcttaagtcggacggtacttcgtaggtaggaacgggtcctaagttccaccgtatcctacgagtacgaccaacgtccaaagaccgtcccgtagtactcgtagacctaaagtcgaaactagtcgtagacgacgtccgtggacggactacggtccttagtacttacgtgtacgtaacttaaattagttaacgg

SEQ ID NO: 26365 - DNA, 321 bp, Homo sapiens
  misc_feature: GYAE6OF02IQ9V0.25.36.D03.1.454.CMB.1.raw
  modified_base (219)..(219): a, c, t, g, unknown or other
  misc_feature (219)..(219): n is a, c, g, or t
  modified_base (303)..(321): a, c, t, g, unknown or other
  misc_feature (303)..(321): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgatttgcaacttattactgccaacaatataataattattcgactacttttggccagggaccaaggtgagatcaaacgaatgtaggntcgcaccatctgtctttacattccttcccgccatcttgaactcgtacagtcctgacggcggcgtcggacaaggccgacatagtnnnnnnnnnnnnnnnnnnn

SEQ ID NO: 26366 - DNA, 313 bp, Homo sapiens
  misc_feature: GYAE6OF02GK9M3.25.36.D03.1.454.CMB.1.raw
  modified_base (255)..(255): a, c, t, g, unknown or other
  misc_feature (255)..(255): n is a, c, g, or t
  modified_base (297)..(313): a, c, t, g, unknown or other
  misc_feature (297)..(313): n is a, c, g, or t
tcagactgtacagtcacgaccggtgctcgatttagctgcgtcacgatctctcttgggatagaagttattcagcaggcacacaacagaggcagttccagaattcactctcacatcagcagcctgcagcctgatgatttgctaacttattactgccaacaatataataaattatacgaccacttttggccaggggaaccaaggtgagataccaaacgaactgtggctgacaccatctgtctcatcttcccgcatctnaactgtacagtctgaagccgggctaggcaaggcgcaatacgnnnnnnnnnnnnnnnnn

SEQ ID NO: 26367 - DNA, 692 bp, Homo sapiens
  misc_feature: GYAE6OF02FIGSY.25.36.D03.1.454.CMB.1.raw
  modified_base (515)..(515): a, c, t, g, unknown or other
  misc_feature (515)..(515): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatcgacccagtctccatcctcctgtctgcattctgttggagacagaatcagcatcacgttcggccgggcgacgtcgagggcattaggctaatttattacgccttggtactacaacgtaacgaaaccgtagggacgtacgttacctaaacggccttaccgtagtacttactaagtcgtccgtcgtacccttaccgttaaccgttacctaccgtaccggtaccggggttaccctagttccgtaccggtttaccgacggtaccggacgtaacggtacgtaacgttcggtacgggaacctaaggttacggttacccacgttaccgtcctaacctacgtacgacgacgtacgtacccncgtaccacgtacgtacggaagttacgttacgttacgtaacctttaaacgtttacttaacgttacgttaaacctaaaggtttataacgttaccgtacccgtcccgttaccttaccgttaccggttaccgggacgggtaacgggtaaccggtaagggtacggtacgtaacgtaaaccgg

SEQ ID NO: 26368 - DNA, 610 bp, Homo sapiens
  misc_feature: GYAE6OF02GUD5F.25.36.D03.1.454.CMB.1.raw
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggagcagtgtgttcgtcagacatacactcaccgtgggtccggcaggcctcgtggaacgtgggcctggaggtgggtagggaacaagtcaaccgccacggaccggaacaacgaggacggtcgcacatctagtttcgagggcaggacgtccgtaccttttccggaggtaccaagtccgacgggcgctagtactacgattgaacttctactaactcgtacctgtcgtagtttggaccggtaccgacggtaccgtatagtttacgtgtagtacgaagaagtacgtccgtcgtacccttaacgaaaacggttccgaacgtaacggtccgtacggaccgtacccgggtaccccggtacggggtaaccccggg

SEQ ID NO: 26369 - DNA, 750 bp, Homo sapiens
  misc_feature: GYAE6OF02JIPQZ.25.36.D03.1.454.CMB.1.raw
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (301)..(301): a, c, t, g, unknown or other
  misc_feature (301)..(301): n is a, c, g, or t
tcagactgtacagtcacgaccggtgctcgatttagctgcgtcacgatctctcttgggggcagaagtctctctcagtcaggacacagcatggacatgagggtccctgctcagctcctagggacctcctgctgctctggcctcccagactaccgagagtgtcgacgtccagtatcgacccagtcctccactccctcctgtctgcatcgttgttgagacagactcanctactctacggtcggaccgggngtacgtcgacgggactacgttacgaacttaagtttacttacgaccgttaggttanacctaaacaaacggaaacccgaagggtaacggtacctttaaccgtaacggtccttccgtagtacttacgttaacgtcgaccgttacctcccgttacccgtaacgtttaacccaccggttacgggtaacccggggtacccctaggtttaccggtaccggtttaccgaacgggcggttaactacgggttaacgtacggttaccggacgggtaacgtaggttaaccgttctaaccgttaccttaccgtacttacgtcgtacgacaccgtcgcgtaccgacggtacaggtaacgttgttacgtaactacgtttaactttagtttaaccgagttaaacttaaacggtattaaacccgttcggtaccccttcccttccgtttaaccggttacccggtttcccgggaaacgggtccgggtaacctaaggggtaacggtacctaaggtaaaccccgg

SEQ ID NO: 26370 - DNA, 300 bp, Homo sapiens
  misc_feature: GYAE6OF02IP7Q3.25.36.D03.1.454.CMB.1.raw
  modified_base (266)..(266): a, c, t, g, unknown or other
  misc_feature (266)..(266): n is a, c, g, or t
  modified_base (289)..(300): a, c, t, g, unknown or other
  misc_feature (289)..(300): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattaatcgaccattttgccaggggaccaaggtgagatacaaacgactgtggctgcaccatctgtcttcatcttcccgcatctgaactgtacagtctgancgggctggaccaaggcgcatagnnnnnnnnnnnn

SEQ ID NO: 26371 - DNA, 921 bp, Homo sapiens
  misc_feature: GYAE6OF02IQNH1.25.36.D03.1.454.CMB.1.raw
  modified_base (174)..(174): a, c, t, g, unknown or other
  misc_feature (174)..(174): n is a, c, g, or t
tcagactgtacagtcacgaccggtgctcgatttagctgcgtcacgagtctctcttggggagctctgggagaggagcccagcactagaagtcggcgtgttccattcggtgatcagcactgaacacagaggactcaccatgggagtttgggctggagcttgggtttttcctcgttncttcttttaaagaggttgtccatggtcaggtgcaccgtggtaggagtcgtggggtaggcgtagggtcccaggccgttgggacggtccctaggacgtacctctcctggtagaacggcccttacgtgggttaactttttacggtttacagggttggtttacctgggacctaaggttcggcctaccggttcgggggtcccgaccgaagggtcctccgagggccggaaacggggggtccggtaggttggggttacgcgttaaaggtttacgacggtcctaacgtaagtggtaagttaacggggtaaacgttttcccgtagggaaaaacttttaaggttttaacgacgggaccctaaaggggttaccccgtttacccgggggtttaaacggggtaaaacgggggtacccccggggtttaaacttttacccggaaacccgtttaaccgttaaccccggtttaaccccggaaagggttaaaacccggtaaaccgttaaacccccgggtttttaaccccgggaaaacctttaacggttttttcgggttaaaaacgggtttaacggttttaacggggtaaaacggtttcggttaaacccggaggttaccccgtttaagggaacgggttaacgtaccgggaaggtacccgttccgggtaccgtttacggttagttaacggttttacccgaggtttacccgggacggttaacggttagggttacccgggggtaaggtttcggtaagggtttaaccggg

SEQ ID NO: 26372 - DNA, 353 bp, Homo sapiens
  misc_feature: GYAE6OF02GB9LW.25.36.D03.1.454.CMB.1.raw
  modified_base (264)..(264): a, c, t, g, unknown or other
  misc_feature (264)..(264): n is a, c, g, or t
  modified_base (293)..(298): a, c, t, g, unknown or other
  misc_feature (293)..(298): n is a, c, g, or t
  modified_base (306)..(307): a, c, t, g, unknown or other
  misc_feature (306)..(307): n is a, c, g, or t
  modified_base (310)..(353): a, c, t, g, unknown or other
  misc_feature (310)..(353): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccagggaccaaggtggagatcaaacgaactgtggctgcaccatctgtcttcagtccttcccgccatctgaactgtacngtctgagcggctggcaaggtcgcatagcnnnnnncatgctanntcnnnnnnnnnnnnnnnnnnnnnnnnnnnnnnnnnnnnnnnnnnnn

SEQ ID NO: 26373 - DNA, 566 bp, Homo sapiens
  misc_feature: GYAE6OF02HZ1EY.25.36.D03.1.454.CMB.1.raw
  modified_base (553)..(566): a, c, t, g, unknown or other
  misc_feature (553)..(566): n is a, c, g, or t
tcagactgtacagtcacgaccggtgctcgatttagctgcgtcacgatctctcttgggcagtccaggggagggcctgaagtgggtcggcctcatgagaccgagggcctctggagggacagtggagcatgacgcgtctctgatgggcaggttcagcctctcaagggacgactctaaagccatcgcctatctgcaaatgaccagcctgacagtcgaagactcagccatctattattgtgcgagactgcctgtctctgagttcggggactttagttggacgtaacttactttctactttacttacccactagtcggtacggttttggggacgaacggggaccacgggtcagtcgtctcctccacctccaaccgaacgggcccagtccgtccttccccctcggcctaccctcctcccaagacgccaccgtcggtcggggacacgacggccggcccgtcgggctcggtccctgggtaccaacggtaccttacccttccacgttagtaaccgagttccgtaggacggccgggtcgtcggaccgaagggccgactagtagnnnnnnnnnnnnnn

SEQ ID NO: 26374 - DNA, 885 bp, Homo sapiens
  misc_feature: GYAE6OF02G089X.25.36.D03.1.454.CMB.1.raw
  modified_base (200)..(200): a, c, t, g, unknown or other
  misc_feature (200)..(200): n is a, c, g, or t
  modified_base (234)..(234): a, c, t, g, unknown or other
  misc_feature (234)..(234): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagcccaccctcagtcgtccgtacggggaccccccgggnaggacgggtcctccatcttcttgttcgtggggancacgccgtccgacggtacggtaaaattagtttcgtactacgtcggtaccagcacgtcctaccccgaaacggaaaccccggaccccccaaggtcccttccctactaacttaccgtaaagtaacgggaacttcggaacttccggaaccggtcccgggtacccccgttaagggaacggggttaaccttaaccccgtacgggtaacccttacgttttcccgtaccggtaccgggtcccgttaaccggttaaacggtttcccgttccgggggttcccctttccccggttccccggggtcccccttttccccggtacgggacccctacgtttaccgggtaccggggttccgggtacccgttccccggggtaccgggaagggtacgcgggtaacggtccgttaaaggtaaactttacgttacggttggtaccggttcgtttaacgggttgggacctcggtacccgttgggttccgtaaggggttaccggttccggggttaccgggtaacgggtttcggggtacccgggaacggggtacgggtaacccggtacgtcgggttacccgggtaaccggtttacctaaagggaccccgaccggacccgtacgggtacccgtttcccccgaccccggtttcggtaccctaccggtttcccccgg

SEQ ID NO: 26375 - DNA, 667 bp, Homo sapiens
  misc_feature: GYAE6OF02GCJMN.25.36.D03.1.454.CMB.1.raw
  modified_base (448)..(448): a, c, t, g, unknown or other
  misc_feature (448)..(448): n is a, c, g, or t
tcagactgtacagtcacgaccggtgctcgatttagctgcgtcacgagttctctcttggggtctggcgccagggtcccttccaatatcagctaccatggcctggactcctctctttctgttcctcctcacttgctgcccagggtccaatctcagtactgtggtgacttcgaggacgccctcactgaccgtcgtccccaggaggacgagtcacgtctcacctgtcgcttccagcgacgtcggtcagtccaccgtagtgacgaaccactacctaaacgtcggttaccacgactaacgtaaacctggaaccaaccctaccgacggcctacgtgtacttagtaggcgaacgaaaacgtaaaactacgttcgtacgtcccgtcgaccgttactacacgtccgtaccgtacgtacgggaactaacgcgtcgcctgactacgtcgtacagtctcgngacctagccgtaggacggacgacgtacgtacgtacctacgtacgtcgaccttcgaccttctccgtacggtggtacggttcggtcggttcgggtcgggtacggaccggtaacggacgtaacgtccggtacggttcgtacgggttccacggacccgtaaggtcccgttacccggtccccgttacggttaccctcggtttcccgttccctcccccggtcccg

SEQ ID NO: 26376 - DNA, 678 bp, Homo sapiens
  misc_feature: GYAE6OF02HX4R1.25.36.D03.1.454.CMB.1.raw
  modified_base (603)..(603): a, c, t, g, unknown or other
  misc_feature (603)..(603): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcgaggacgccctcactgactgtcgtcccgaggacgggacagtcactctccacgtgtcgtccttcacgcgcgtggtcacgtcacctagtagacgaaccactaccaacgtcggtaccagacaacgtaaccgtacggaaccaacccgacccgagggacacgtagtacttagtcgtacaacgtaaaactaaaactactacgtacggtaccccgtcgtccgtcctacgtaccgtcctacccgtcggttacgggactaacgtccgtcgtccgtacgaccgtcgtcgtacgacgtagtcgtcacgtagccgtagggacggtacgcggtctaccggaactaccctaggtcctaccggtctactcccgttcgtcggttcgggtcgtgttccggttggggttccggttcgggaccgggaaccgtaccgtagttcccggtaccgttcggnggtaaccgcgtaacccgggtcgtcccgtacccgggtccccttcggtaacccgtccgtccgtttcccgtcccccgg

SEQ ID NO: 26377 - DNA, 301 bp, Homo sapiens
  misc_feature: GYAE6OF02GKAG2.25.36.D03.1.454.CMB.1.raw
  modified_base (293)..(301): a, c, t, g, unknown or other
  misc_feature (293)..(301): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgccaacaatataataattattcgacctactttggccaggggaccaaggtggagatacaaacgaactgtggctgcacatctgtcttcatcttcccgccatctagaactgtacagtctgagcggctggcaaggcgcatcggnnnnnnnnn

SEQ ID NO: 26378 - DNA, 469 bp, Homo sapiens
  misc_feature: GYAE6OF02GG1KJ.25.36.D03.1.454.CMB.1.raw
  modified_base (295)..(295): a, c, t, g, unknown or other
  misc_feature (295)..(295): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (421)..(469): a, c, t, g, unknown or other
  misc_feature (421)..(469): n is a, c, g, or t
tcagactgtacagtcacgaccggtgctcgatttagctgcgtcacgatctctcttgggatagaagttattcagcaggcacacaacagaggcagttccagaattcacctctccacatcagcacgctgcacgcctgatgttattttcgaccttaactttacttactacgaaccaaactaataattaaattaaatttacgtaccgtacctttacggttttcggaccggaacggggaaccgtaagggtaggaagtactaaccgaaaacgtaacgtggtcggactcgaccacctatcgttnttccttcacttcccgttaccccgctacttcacgtaacttcggtaaactcgtttcgtaggacggggtcccgggtacgttacggggaaccgaacggggtccgtaaccgtaaagtttggacncnagncnnnnnnnnnnnnnnnnnnnnnnnnnnnnnnnnnnnnnnnnnnnnnnnnn

SEQ ID NO: 26379 - DNA, 302 bp, Homo sapiens
  misc_feature: GYAE6OF02GINUH.25.36.D03.1.454.CMB.1.raw
  modified_base (289)..(302): a, c, t, g, unknown or other
  misc_feature (289)..(302): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacacttttggccagggaccaaggtgagatcaaagaactgtggctgcaccatctgtcttcatcttcccgcatctagaactgtacagtctcgagcgggactggcaaggcgcatagnnnnnnnnnnnnnn

SEQ ID NO: 26380 - DNA, 598 bp, Homo sapiens
  misc_feature: GYAE6OF02HC77T.25.36.D03.1.454.CMB.1.raw
  modified_base (573)..(573): a, c, t, g, unknown or other
  misc_feature (573)..(573): n is a, c, g, or t
  modified_base (583)..(583): a, c, t, g, unknown or other
  misc_feature (583)..(583): n is a, c, g, or t
  modified_base (595)..(595): a, c, t, g, unknown or other
  misc_feature (595)..(595): n is a, c, g, or t
tcagactgtacagtcacgaccggtgctcgatttagctgcgtcacgatctctcttgggcagtccaggggagggcctgaagtgggtcggcctcatgagaccgagggcctctggagggacagtggagcatgacgcgtctctgatgggcaggttcaggcctctcaagggcactctaaagccatcgcctatctgcaaatgaccagcctgacagtcgaagactcagccatctattatgtgcgagactgcctgtctctgatcgggattattggacactattcacttattcccactatggtacgttttggggacgaacggggaccacggtcacttcgtcctccgtacctaccctcacccgaacgggcccctaagtccggtccttcccccgtcggcctaccccgtcctaccgaacgcgccaccttcggtacggggcctacgacggtccggccctacggggccttacggcccgttcgggtacgtaacgggtccttaccgttccgtaaccgttcgtacctaggttccgtaggtacgccgggtcgtacgggccgtaacgggccgaccgtagtacggatcgcgtanactgacgacncgacgtcacgtnacg

SEQ ID NO: 26381 - DNA, 732 bp, Homo sapiens
  misc_feature: GYAE6OF02HD260.25.36.D03.1.454.CMB.1.raw
  modified_base (173)..(173): a, c, t, g, unknown or other
  misc_feature (173)..(173): n is a, c, g, or t
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
  modified_base (296)..(296): a, c, t, g, unknown or other
  misc_feature (296)..(296): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccaggtctgtgctgactcagccaccctnagtgtcgtgggacccccggnagagggtcctccatctcttgttctggggacncagcctccgacgtacggaaattagtttgtctactggtaccagcagcctaccagaaccggccccaagcctccncatctaataggaatgactcgacgccggcctacgacgggactaccgtggaaccgtattcctacgtgggacctacggaagttccgtacgggccttccgtccgggtaccctcccgtacggacctacgtcgaggtccgggtccgtaccgggtcgaacggtacgtggacgggtctagtaaacttagttacgttcggtacgtacgttacgggtttacgggaactcggtacccgtacggtttaccggttggtaaccggggttcggttaaccgggtaccggggtttcgggttacccgggggaacggggtaacggggacccgaagggtccgttacccgggtaacccggttccggttaacgggtacccggtaaccggtaccccggtaacggtccccggtacccggtaccccccggttaccggggttaccctacccggtttccccgg

SEQ ID NO: 26382 - DNA, 302 bp, Homo sapiens
  misc_feature: GYAE6OF02GKD8Z.25.36.D03.1.454.CMB.1.raw
  modified_base (275)..(275): a, c, t, g, unknown or other
  misc_feature (275)..(275): n is a, c, g, or t
  modified_base (293)..(302): a, c, t, g, unknown or other
  misc_feature (293)..(302): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgacctacttttggccaggggaccaaggtggagatacaaacgaactgtgctgcaccatctgtcttcatctcccgcatctagaactgtacagtctgagcgggntggacgaggcgcagtagnnnnnnnnnn

SEQ ID NO: 26383 - DNA, 379 bp, Homo sapiens
  misc_feature: GYAE6OF02GJUPW.25.36.D03.1.454.CMB.1.raw
  modified_base (310)..(311): a, c, t, g, unknown or other
  misc_feature (310)..(311): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (319)..(379): a, c, t, g, unknown or other
  misc_feature (319)..(379): n is a, c, g, or t
tcagactgtacagtcacgaccggtgctcgatttagctgcgtcacgagtcgtctcttgggatagaagttattcagcaggcacacaacagaggcagttccagaattcactctcaccatcagcagcctgcagcctgattgattttgctaactttaattactgccaacaatataaataattattcgacctacttttggccaggggaccgaaggtggagatacgaaacggactgtaggctgcaccatctgtcttcatccttcccgcatctagactgtacagtctgacgcggctggcgaaggccggcaagtaggtnnangntagnnnnnnnnnnnnnnnnnnnnnnnnnnnnnnnnnnnnnnnnnnnnnnnnnnnnnnnnnnnnn

SEQ ID NO: 26384 - DNA, 681 bp, Homo sapiens
  misc_feature: GYAE6OF02I7YRY.25.36.D03.1.454.CMB.1.raw
  modified_base (148)..(148): a, c, t, g, unknown or other
  misc_feature (148)..(148): n is a, c, g, or t
  modified_base (169)..(169): a, c, t, g, unknown or other
  misc_feature (169)..(169): n is a, c, g, or t
  modified_base (207)..(207): a, c, t, g, unknown or other
  misc_feature (207)..(207): n is a, c, g, or t
  modified_base (326)..(326): a, c, t, g, unknown or other
  misc_feature (326)..(326): n is a, c, g, or t
  modified_base (352)..(352): a, c, t, g, unknown or other
  misc_feature (352)..(352): n is a, c, g, or t
  modified_base (667)..(667): a, c, t, g, unknown or other
  misc_feature (667)..(667): n is a, c, g, or t
tcagactgtacagtcacgaccggtgctcgatttagctgcgtcacgatctctcttggggagcttcagctgtggtagagaagacagagggttcaggacaatctccagcatggccggcctccctctcctcctcaccctctcactcactgtncaggtcctggcccagtctgtnctgctcagcccaccttcagtctcgtcgggacccccggnaaggtcggtcctccactctcgttcgttacgtggggctcgacgccgtccgacgtacggtaaattagtttgtaccgtaatcggtaccaggcaacgtcctaccaacggaaccggccccaacncctcctcaacgtctaagtacgtaaancgtacacgcggaccgccttagaacggtactaccgtacgccgtaattcgtctacggcgtaacgtacgtccgtcgggtaccttccgtccggtacctcccgtacggtcctacgtcgtacgggttcgggtacccgttccgggtaaacccgcggttaacgcgggttaggcttaacggtacgtttaaactcgtcgttcggtacttagggttttccggaacgttcgccgtacgtcggttgacggttccggtcggtaacggttcgggtacgggacggttaggaacccgtacggtcctacgggcccgttacgttacggacccgnggtaacccctccgg

SEQ ID NO: 26385 - DNA, 730 bp, Homo sapiens
  misc_feature: GYAE6OF02G6692.25.36.D03.1.454.CMB.1.raw
  modified_base (403)..(403): a, c, t, g, unknown or other
  misc_feature (403)..(403): n is a, c, g, or t
tcagactgtacagtcacgaccggtgctcgatttagctgcgtcacgatctctcttgggggcagaagtctctctcagtcaggacacagcatggacatggagggtccctgctcagctcctgggactcctgctgctctggctcccagactaccagatgtacgacgtccagactcgaccctagtcctccactccctccgtgtctgctattcgtaggttggaactacaagtaactcgagtcactcacgttcggccggtgagtacggaggtctaagtacgtacttaaagttacttacgccgttaggtaactaccgaaacgtaacggaaaacgtgggtaacgtaacgtttaccaacggtcttacgtacgattacgtagtccgattaccgtacccttacgtaacccggttanaaccggttacggacccgggttaccctacgttacggtcggttaacgacggtcggtaagttaacggtacgtaacgtacggtacggtaactacgtaccgtactaacctacgtacctacgtttaacgaccgtacgtaccgacgtcccgtagtccacgggttacctagggtaactacggttcgtaacgtaactttaaccgttacgttaacgtaacgttaaactaaacgttacttaacttacccggtaccctaaccttaccgttaacgtaaccggttacggggaaaccgtttacggggaaccgttacggggaactaacggtaggtaaaacccg

SEQ ID NO: 26386 - DNA, 548 bp, Homo sapiens
  misc_feature: GYAE6OF02JCJ6M.25.36.D03.1.454.CMB.1.raw
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
  modified_base (369)..(369): a, c, t, g, unknown or other
  misc_feature (369)..(369): n is a, c, g, or t
tcagactgtacagtcacgaccggtgctcgatttagctgcgtcacgagtctctcttggggagctctgggagagggagccccagcccctgagattcccaggtgtttccattcagtgatcagcactgaacacagaggactcaccatggagttgggactgagctggattttcctttggctattttaaaaggtgtccagtgtgaagtgcaacgtggtggagtctgggggagcttggtacagcctggcaggcccctgagactctctgtgcagcctntgattcactttgatgattangccatgcagtcgggtccgacaagcctccgagggacgggtcctggagtgggtctcgaggtattagtaggaatggtggtancgtagtaggctatgcgtactcgtgtagggacggcgtactcacgactcgtaccagtacgaacacgaccaacgtacctaccctgtatcgtagactaatacgaactagtctacgagagcgtaggacgacggacgtaccgtttagttattaccgttagtactaaactaaagtttagttaacgg

SEQ ID NO: 26387 - DNA, 788 bp, Homo sapiens
  misc_feature: GYAE6OF02JU1R3.25.36.D03.1.454.CMB.1.raw
tcagactgtacagtcacgaccggtgctcgatttagctgcgtcacgatctctcttggggagctctgggagaggagccccagccctgagattcccaggtgtttccattcagtgatcagcactgaacacagaggactcaccatggagtgggactgagctggtattttcctttggacttatttaaaggtgtaccagtgtagaagtgactaacgtgggtaggagtcggtgggggagtcgttggtacagtccgtggccgacgggcccctaggacgtaccttccgttccgtggtcgcctaacggtcccttcgtacggtactttccgtaccgtttagagttacggtattaacgtccggtacgtaacgtcgtaaccgtaccggttccggggttacccgacgtaaccggccggtaccgggtaacgggggtaaccgggtccggtaaggggttacggttcgggtacgtaacgggttaggtttaacgtttagggttacggtaaggttacgggttagtacgtacgtaggtaggtacgttaggtacggtacggtaccgttacgggtaggtaagggaaccgggttaccgtaacgttccgaaccttaccgtaccgacgtaacggtaaccgaaccgtaaacccgtaacccgtaacgtaccccgttaccgttacgtaccttacgtataaaccgttaagtaacgtaacgtaactacgtaagacgggtacgtaggaccggtacggtaaccggtaccgttacgttacgttaacttacggtagtaacgtaacgttaaaacgttgttaacgg

SEQ ID NO: 26388 - DNA, 755 bp, Homo sapiens
  misc_feature: GYAE6OF02HNRB6.25.36.D03.1.454.CMB.1.raw
  modified_base (257)..(257): a, c, t, g, unknown or other
  misc_feature (257)..(257): n is a, c, g, or t
  modified_base (660)..(660): a, c, t, g, unknown or other
  misc_feature (660)..(660): n is a, c, g, or t
tcagactgtacagtcacgaccggtgctcgatttagctgcgtcacgatctctcttggggacataacaaccagattcttcctctaaaagaagcccctgggagcacagctcatcaccatggactggacctggaggttcctctttgtggtggcagcagctacgaggtgtccactcccaggtccagctggtgcaatcgtgggcctgaggtgaagacggccgtgggtcctcggtgaggtcctccgtggtaacggtctcggaancagtgtgtcgtcagacagtacactcgtaccgtcgggtccggacgacggcctcgtacggaacgtccgggccttggacgggttcggggtacgggtaccgaaacgtccgaaccccggacccgtacggaccccggtaaaccgaaaccgacgggtaccggtacggacccacgtaacgtacgtaacccggttttaggaacgggaccgtaggtacggttacctacccggttttttaccgggcggttaaaccgaacgttccccgggaaccggggtcgaccgtaaaggtacgttaacgtaagtaacgtaacgttacttaccgaactacgtaccctaggccgttaacgttgtaccggtacccgtaacggtccgttaagtttacgttactacggacgtacgtaaaggtaaccgnggttaacccgtccggtaaccgttaactaaacggtcccggtaacacggtaccggttaacgcccggttccccggtaccccgttggggaacccccggg

SEQ ID NO: 26389 - DNA, 603 bp, Homo sapiens
  misc_feature: GYAE6OF02FS219.25.36.D03.1.454.CMB.1.raw
  modified_base (192)..(192): a, c, t, g, unknown or other
  misc_feature (192)..(192): n is a, c, g, or t
  modified_base (293)..(293): a, c, t, g, unknown or other
  misc_feature (293)..(293): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaatagtttgctacgtggtaccagcagctcccaagaaaccggcccccaagcctcctanatctataggaatgatcgagcgccctcgagggtactaccgtggaccgtattcctctggctcgaagtcgtggcctccgtccggccttcccgtggcccatccgaggtcgggtccgtcccgggtcgaggtacgtggaggtctagaacttagttacttggtcgcgtaggtttgggatgccgtagtcgtgtaggtccggtccggtagggttcgttcgggcgggtacgggaaccaggtccgtcggtacccggtacgttacggtaccgacgtacccgaacggtccgttacccggcccccgttcggtcccacgttcccg

SEQ ID NO: 26390 - DNA, 799 bp, Homo sapiens
  misc_feature: GYAE6OF02JXLAF.25.36.D03.1.454.CMB.1.raw
tcagactgtacagtcacgaccggtgctcgatttagctgcgtcacgagtctctcttgggagctctgggagaggagcccagcactagaagtcggcggtgttccattcggtgatcagcactgaacacagagactcaccatggagtttggctgagcgtgggtttcctcgttgctctttaagaggtgtccactgtcaggtgcacgtggtggagtcggtgggggagcgtgtccagcctgggacgtccctgacgacctcgtcctgtacgaacgcctgtcggtatttagtttccaggttggttctggctagtgtcgtacggtcggtccgaccgtaggtccgtaccgagggacggaacgggggtccggtagggttgggtacggtacgtaaggttagtaaccggactaacgtaggttacggaaggttacggttaacgttcgttaaaggtaaactttacgttagtcgaaccgtaggtaaccggtacccgggttaaggggaaacccgggttcccgtaacttaacccgtaccgtaaccgtttacccaacgggaaagtaaccggtaaaccgttaaacccggttaccccgggtaaatttacggtttacgggttaacggtttaaacggtaacgggtaaacgtttccggttaaccggaaccgttccgttaagggaaacggtcgggttaacggaaccgggttcgtaccggttacccggttaacggttagttaaacccgtttcggtacgggtaagttacccgggtaaggtaacccgggtttgggggtaaccgggttttaggtaaggttttaacccggg

SEQ ID NO: 26391 - DNA, 805 bp, Homo sapiens
  misc_feature: GYAE6OF02I2CIP.25.36.D03.1.454.CMB.1.raw
  modified_base (342)..(342): a, c, t, g, unknown or other
  misc_feature (342)..(342): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccaggtccaatctcagactgtggtgactcgaggacgccctcactgtacgttgtcgtcccgagggacggacacgtccactcctcgaccttgtgtccttccgagcgcgtggttacacgtccacgagtcgaacgaacacgtaccaactcggtaccagacaacgaaccgtcgaaccaaccgacccgaggaccacgtagtaattagtcggtanaaccaaaactaaaaacctcgtacgttacggaccccgtacggtccgttacacggtaccgtcccgtttacccgtacgggtttacgggaacctaacggtccgtaccggtcccgtacgaacccgttacggttccgtaacgtacggtacggttaagggtaccgtaccggtacccgtacccgggtaacgggtaaaccggggaaacggggtaccgggtaccggttaacccgaaacccgttacccgtaccgttccccggaccgtttccgtaccggtttccgtcccgtttagggtcgggtttcgggtcgggtttcgggttcggggtttaccgtcggggtaccggtaaacggaaccgggttaaccgtccgggtacccggttaccgggtcgggtaacccgtaccggtaaccggtaccggtccgtaccccggttcccggtccgttaccggtcccgttaccgtccccgtacccccg

SEQ ID NO: 26392 - DNA, 783 bp, Homo sapiens
  misc_feature: GYAE6OF02GVG08.25.36.D03.1.454.CMB.1.raw
  modified_base (737)..(737): a, c, t, g, unknown or other
  misc_feature (737)..(737): n is a, c, g, or t
  modified_base (772)..(772): a, c, t, g, unknown or other
  misc_feature (772)..(772): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggtaggttcctcgtttgtgggtggcagcagctacgaggtcgtccactcccgaggtccagtctggtcgcaatccgtgggcctggaggtagaaggacggtccgtgggtcctcgggtggtacgggtccttccgtaggtacggttccgtaccgggagcgtaggttgttgttccgcagacatacacgtcaccgtcggggtccgcgacggcctcgtacggaacgtcgggtcctaggagggtcgggtacggtaaacgaacgtaccgaaccccggtccgaccggtaccggaaacaaaccggtaggtaaccggtccgtaccgaaccttacgtacgtttaacggtttaccggaaggggtccaaagggtcccggttacctttaaccccgggtttttccgggacggtaaaccgttaacccgggttaccggtaaacggggtccgtaaccgtaaggttaaaccttacggaacgttacggtaacttaccgtaacttaaccgtcggtaacccgtgtaccgttaaggtttccggaaccggtacgtaccgggttacgtacttttaacgtacgttcggaagtacgtaagtaacgcgttccggtacgtaacccgtaaacgaagttccgaanaccggttacgaccgcccggtacccggtacccgggngggtaacccgg

SEQ ID NO: 26393 - DNA, 695 bp, Homo sapiens
  misc_feature: GYAE6OF02J1GZT.25.36.D03.1.454.CMB.1.raw
  modified_base (521)..(521): a, c, t, g, unknown or other
  misc_feature (521)..(521): n is a, c, g, or t
  modified_base (552)..(552): a, c, t, g, unknown or other
  misc_feature (552)..(552): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggctcccagataccagatgtgacgtccagatcgacccagtcctccattccctccctgtctgcattcgtgtggacacacgatcgacgctactcacgttcggggaccgggtacggacggtcggaacgggtacctagttaacgtacttaaagttttactttacggtccttagggttaactaaccgaaacggaaaccgggtaaaaccggaacggggaacttaacggtttacctaacggtaccttccgtagtactcttaacgtgctccgaccgttaccgtaccgttaaccacggtccggtaacggtcctacgttcggtacgtccgacgtccggagtcggttagacgtcggtacggacgtagtcttactactccgttacagtacacgacgtacnccgtacgtcgaccgtagtaccgtagaacgtnttagtacgtaacctttagttaacttaacgtacgttaaagttaagtacttaacgttacgcccttaccgttacctaccggttaccggttacgggtaacgggtaacgggtaccggtaacggtaagggtacctaagttaaacccggg

SEQ ID NO: 26394 - DNA, 558 bp, Homo sapiens
  misc_feature: GYAE6OF02I3FQ5.25.36.D03.1.454.CMB.1.raw
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggagcagtgtgttcgtcagacatacnctcacctgggtccgnagcctcgtgactggcctgaggtggnggacagtcgacgcacgacggaacacagagtcgcacancagttcaggcagtancctacctttcggngacagtccgacgggcncagtanaacactagactctcgaattcgacctagccgtagtttcgaccggtaccacgtccggttatacgttagacgtgaccggtaagaacgtacgtacccgtgacccgtaacggtaacgtagacccgaagtcgttaccgggccttaccggacccggtcgggacccgg

SEQ ID NO: 26395 - DNA, 734 bp, Homo sapiens
  misc_feature: GYAE6OF02GBB9L.25.36.D03.1.454.CMB.1.raw
  modified_base (521)..(521): a, c, t, g, unknown or other
  misc_feature (521)..(521): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggcctcccagataccagatgtgacgtccagatcgaccctagtcctccatccctcctgtctgctattctggttggactacagaactcgagcatcctacgttcggaccgggtcgtaacgtcgaacggggctaagtttaacggaccttaaaattttacgtttaacggccctttaggggtaactaaccgaaacgtaaacggaaaaccgtaaggggggaacgttaacggtttaaccctaaacggtcccttacccgtaggtaactttacgttaacgtgtccgttcggtcccctaaccgttaaccgtaactaccgtccgggtaaccgggtcctaacgtccgttacgggtcacgggccgtcgtacgtagtactcggtaggacctaggtacgttacnccgttactacgtactactcgactcgtacgcctacgactagtaccttaggaacgttacgtcgttacgaacctttaaagtttctaccggtaaattaacgtaacgttaataaccgttaccgtacccggtacccttacgttaacccgttaccggtttaccggggacgggttaacgggaaccgttaaggggtacggaaacttaccgttaaaacccggg

SEQ ID NO: 26396 - DNA, 644 bp, Homo sapiens
  misc_feature: GYAE6OF02FX3C2.25.36.D03.1.454.CMB.1.raw
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacgagggtcctgggcccagtctgccgtgactcagcctgcctcgtgtcgtggtctcctggacngtcgatccacctatttccngcactggactcagcactgntgtgctaggttattactttntccttccgtacggtaaccaacaaccacccgaggaaccaaaccgaccccctaaattactactactttagtcgacgacctaacgtaacggccgaccctgacggttacgtttactaacgtccgtctttccgtcgtcggtcctaccgtaagtccgtgccagtccgaccgtccctccgtagaactattccgtcggtacggctacccggaggtccgtacgggaacggccggtagtcgtattacgtttacgtacgtacgtacctacttacgtagttagtcgtaaccacgtacacctaaccgtacgtcccgttacgtaccgggtaccgtacgggaccctacggtcccgtaccggttcggcgtaaccgtacccgaccgtacccggccctaacccg

SEQ ID NO: 26397 - DNA, 687 bp, Homo sapiens
  misc_feature: GYAE6OF02I1BGG.25.36.D03.1.454.CMB.1.raw
  modified_base (658)..(658): a, c, t, g, unknown or other
  misc_feature (658)..(658): n is a, c, g, or t
  modified_base (665)..(665): a, c, t, g, unknown or other
  misc_feature (665)..(665): n is a, c, g, or t
tcagactgtacagtcacgaccggtgctcgatttagctgcgtcacgagtctctcttggggagctctgggagaggagccccagccctgagattcccaggtgtttcccattcagtgatcgagcactgaacacagaggactcaccataggagttgggactgagctgattttcctttggcttattttaaaggtgtccagtgttgaagtgcaactggtaggagtcgtgggggtagcttggtacagtccgtggccaggcccctagagactctccgtgttgcgagtccgtctggtattacctacgtttacgagttcgtattaatcggtacctaatgccgtaacgtggggttacccggactaacggcccgttacggaacgggggtaacgggtaccccggtgggtaaggttccggggtacgtaccggttaaggttagtttaaggtagggtaaccgtaggtttggtaacggactaagttacggtacccgttagtccgggtaacgaccgtttcggtagggtacgggtaacgggtaccctagtttacccgacgtaacttaccgttacgaacgacgtaaccgtaaccgacgtaaacgacctaccgttacgtactacgtagtaccgaagttcggactacgtacgtagacacgtgaagtcctacgacctacgtnttacgtnttggtgtacggtaggtcgtagg

SEQ ID NO: 26398 - DNA, 326 bp, Homo sapiens
  misc_feature: GYAE6OF02G12BP.25.36.D03.1.454.CMB.1.raw
  modified_base (307)..(308): a, c, t, g, unknown or other
  misc_feature (307)..(308): n is a, c, g, or t
  modified_base (310)..(326): a, c, t, g, unknown or other
  misc_feature (310)..(326): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgcaactttattactgaccaacaatactaataattattcgacctacttttggccaggggaccaaggtggagatacaaacgaactgtggctgcaccatctgtcttcacttccttcccgcctatctagaactgtacagtcgtgacgcgggctggacgaaggcgacatagnncnnnnnnnnnnnnnnnnn

SEQ ID NO: 26399 - DNA, 714 bp, Homo sapiens
  misc_feature: GYAE6OF02GRHBU.25.36.D03.1.454.CMB.1.raw
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagtcgttgggtttttcctcgttgtcttacttttaaggaggttgtccactgtcaggtcgcaccgtgggtggagtcggtggggggagtcggtcggtccaggtccgtggggacggttccctaggacgtacctccgttccgtggtacgaacgtccttcggttgggttaccaggtcgtttacgccacgacgtccttagttgacttccggtcgggtcccgcgacggtccgtaccggaaggggaacgggcgtgggtacgtcgtcgtctacgtagtttatttagacgtacgtaattaacgtaccctaccgttaacacgacaacggtaccgtcggtacggaaccgggtccttacgtttccttaactcccgtaccgaaggtaactaactaaccgttaccgaacggtaaccctcccttattaacttactaacaaagtccgaaccgtcccgtaggacgacgaccggacgtaccgtacgggcttagtacttcgcggtacggcgggtacggtaacgtacgttacgttaggttcgttacgtttaccgtaactttacccgttaccgtttccgtacggg

SEQ ID NO: 26400 - DNA, 693 bp, Homo sapiens
  misc_feature: GYAE6OF02GPXHT.25.36.D03.1.454.CMB.1.raw
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtgtccccaggagggacagtcactctcacctgtgtcttccagcgctgggtcagtcaccgagtgacgaaccagtaccgaaaactcggttccagtaccaacggaaaccctcgggaaccctaaacccgacccgaacggggccaacgtaggtaacttttagtgggtacgacctaaaaacttaaaaaaccgtcttaccgttaccggaacccccttcggtaccccggtttcctaccgtaacgggtcccttaccccgttccggttacgggggtaccaaaacggtccgtacggtacccctacggtaacctaccgttcggtaacgtagtacgttcgtcgacgacggtaccgtaggacggacggacggtcctacgtaacctaccgacctcgccgtcgtcctacctccgttcgtgggttcggtgtcggtttgggtcgttcgggacggtacggacctaacgtcgtaccgtcggtggtacgacgccgaggtcctccggtccctcggcctacgtctaccgtcccc

SEQ ID NO: 26401 - DNA, 815 bp, Homo sapiens
  misc_feature: GYAE6OF02HT71B.25.36.D03.1.454.CMB.1.raw
  modified_base (166)..(166): a, c, t, g, unknown or other
  misc_feature (166)..(166): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccagtggagtttgggctgagctggttttccncgttgctctttaagaggtgtccactgtcaggtgcaccgtggtggagtcgtgggggagcgtggtccgagcctgggacggtccctgagactctcctgtcgaacgcctcgtggtactttagttcaggttggttaccgtggcagttcgctacgtggggtacccgcctagggcctccgagggacgaaacgggggtccggtaggtcgggttggactacggtttaatacggtacgaacagttacggaaagttgggtaaacgtttacgtagtaaagttacttttaagtcgacgtaaacggtacccgtttaccgggacgggtaaaacggggtccccggtaaatttacccggaaaccccgtaagtttaccccgttaacccggaaaggttaaaccgtaaacccgtaaacccgggttttaaaccccccgggaaaagtttacccggttttaaaggttacggggtttaaaacccgtttaagggggtaaaaacttttcccgggggtaactaaccggtacccgggtttaaggaacgaacccggggttacggtaacgggtaccccgttagggtcccttacggttaacggttaaaccgtttgtaccggtaggtaccggtaagggtaaccgttaccgggggtaaggttacccggtaaggtttaaccgg

SEQ ID NO: 26402 - DNA, 729 bp, Homo sapiens
  misc_feature: GYAE6OF02HKOEA.25.36.D03.1.454.CMB.1.raw
  modified_base (318)..(318): a, c, t, g, unknown or other
  misc_feature (318)..(318): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcaccgtggtggagtcgtggggggagcggtggtccaggcctgggacgtccctgagactctcctgtgaacgcctcgtggtatttagttcaggttggttctggacatgcacgtgggtcccnccgaggcctccgaggcgaaggggccggtagttgggtgctagttatacgcacgtatggagtagggtaagtttctaggtaaattattagtcgactacggtaccgttccggtagggaaacggggtccctaagtttccgaaccctacgtacccgtacccgaaggaacgtaaccgtaaacgttaccccgggaaatacgtttaggtacgttaaccgtttaggggtaaacttcgggggttacctaccgggtaccgttacggggtaaacgagggttacccggaaggggtacccgtttacccggggtcctttaaccggttacggtttaacgtttaccggttagggtacggtaccgggttaaacggtaccgggttaacccgggggggtaagggtttacggggtttaacggtttaaccgggg

SEQ ID NO: 26403 - DNA, 838 bp, Homo sapiens
  misc_feature: GYAE6OF02IERWE.25.36.D03.1.454.CMB.1.raw
  modified_base (196)..(196): a, c, t, g, unknown or other
  misc_feature (196)..(196): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcgagggtcctgggcccagtctgtgctgactcacgccaccctcagtcgtcgtcggggaccccggnaggtacgggtcctccgattccttcgtttgttccgtggggacgtcgacggccgtaccggaacggtacggtaaaacttaaggttttcgtaccttaacgttcggtaaccagtacacgtcctaccgaaacggaaacccggccccaaagcctacctctatacctaaagtaaggtaacttgaacttcgaacggccggtccctacggacgggacttaaccgtcggaaccgttacttccgtacgtcggtactaacggtaacgttccggtcggtacctcccggtccggtccccttacccggtcgggtaccctacgttaccggtacggggtccgggtacccgttacccggggtaccgaaggggtactaccggggtaaggtaccgtaaacggtaaacgtttcgttaaccggttgggttacgtacggtttaacgggtttacggggacttaaccgggccgttaagggttaccggtacgggttacggggttacccgggttaccggggttaaccgggttcgggttaccggggaaccggggtaacgtaccggtaacggttccgtaacgggtaacccgttacggtaaccgggtccgtaaccggacccggtaacggtcccgtacccggtaccccggtacggttacctacccggttccccg

SEQ ID NO: 26404 - DNA, 664 bp, Homo sapiens
  misc_feature: GYAE6OF02H8WI0.25.36.D03.1.454.CMB.1.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
tcagactgtacagtcacgaccggtgctcgatttagctgcgtcacgatctctcttgggagagaagacaggattcaggacaatctccagcatggccggcctcctctcctcctcaccctcctcactcactgtgcagggtcctggcccagtctgtgctgactcagccaccctcagtgtctcgggacccccgggcagagggtctcccatcttcttgttccgtgggancagtcnccgacgtcggaaatagttgtctacgtgtaccngcagctccagaaccgccccaagctccncatctactaggtaactgactcgagccgccctagacgggataccgtgaccgtagttcctcgtcggtactcggaacgttcgtacggtcctcccgtccgggtcccttccccgtcggaccctaacgtccgtaggtccgggtccggttcccgggtacccggtaggtacgtcggtaggtcgtagtaaacgttacttacgtgtacggtcgtaggtttcggacgtcgcgtagtcgtaggtacggttcggtaccggtcggttcgggtccgggtagggaaccgggacctagggtaccgtcggtaacccggtaccgttacgggtaccgttaccgacccgtaacggtccgtcccggtcccccgtacggttccccgtaaccgtttcccgg

SEQ ID NO: 26405 - DNA, 612 bp, Homo sapiens
  misc_feature: GYAE6OF02G8B7Y.25.36.D03.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (489)..(489): a, c, t, g, unknown or other
  misc_feature (489)..(489): n is a, c, g, or t
tcagactgtacagtcacgaccggtgctcgatttagctgcgtcacgatctctcgttgggggggggtcacaagaggcagcgctctcgggacgtctccaccatggcctgggctctgctgctcctcactctcctcactcaggacacgtagggtcctgggcccagtctggccgtgactcagcctcgcctccgtgtcgtggtctcgtggacngtcgatcacctnttcngctacgtgactcagcatgatgttagcgttaggttattcttgtcctcgtaggtaccaacaaccaccgagaccaaccgtccccgaaattcactaatttacgcggtacgtacctaacgtacggcgtcccctagtacggtcttaactacgtccgtccttctaccggtcgtacccttacaacggttcgtacgcacgccgacccgtccctaccgacgactatccgtcggtcggcctcgagtcgacggaggcgtgacgttacgtattattaccncttacgactactagtctacgacctaatcctaacgtaactaccttccgtacgttacggaccggtacggaccggttacggacctaccgggtcctagggccaccggtacccgaccgaccctacccg

SEQ ID NO: 26406 - DNA, 303 bp, Homo sapiens
  misc_feature: GYAE6OF02IOYLP.25.36.D03.1.454.CMB.1.raw
  modified_base (298)..(303): a, c, t, g, unknown or other
  misc_feature (298)..(303): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaataataataattattcgacctacttttggccaggggaccaagggtggagatacaaacgaactgtggctgcaccatctgtcttcattcttcccgccatctgaactgtacagtctgaggcggctggcaagggcgcagtagnnnnnn

SEQ ID NO: 26407 - DNA, 732 bp, Homo sapiens
  misc_feature: GYAE6OF02I5DEK.25.36.D03.1.454.CMB.1.raw
  modified_base (178)..(178): a, c, t, g, unknown or other
  misc_feature (178)..(178): n is a, c, g, or t
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagagaagacaggattcaggacaatctccagcatggccggctccctctcctcctcaccctcctcactcactgtgcagggtcctcgggccctaggtctgtgctacgactcagccctaacctnagtcgtcgtcgggaccccggnaggacggtctccatccgttacttggtttcnggggacncgacgttcgaccggtacggtacggtaaaatttaggttcgtctacgtcggaaccgagacgacgttaccaccgaacgaaaccccgggaccccaagccttacccagtaacgtataacggtaaggaacgttacggaactaccgaaggtccccgtaccgtacgtaacggggtacctaccgtacggaacgttacttcctcgtacgcttaacgacgtcgttggccttaccggtcccgcccgttactacggaccctagtacggtacggttcgggaccgttcccgggacgggtaacggactacggggtataccgtagttaacgttaaagtttccgtaggtaccgtaggttcggtaggggtactacggtcgtaacgtcgtaaggtccgggttacgttcggaacggttggtaccgggaagggaccgttacggatcggttacgccgtttacggacgtccaccgaccggtacggtcgttaccgtcccgacgttaccgtcccttacccgg

SEQ ID NO: 26408 - DNA, 747 bp, Homo sapiens
  misc_feature: GYAE6OF02GSZI5.25.36.D03.1.454.CMB.1.raw
  modified_base (273)..(273): a, c, t, g, unknown or other
  misc_feature (273)..(273): n is a, c, g, or t
  modified_base (614)..(614): a, c, t, g, unknown or other
  misc_feature (614)..(614): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacaggaggactcaaccatgggagtttgggctgagcgttgggtttttcctcgttgcctttacgtttttaaaggaggttctacctactgtcagggtgccaccgttgggtggagttcggtgggggggacgtcggttggtacccaggtcccggnggggtaccgtccctaggacgaccttctccgtgtacgaacgtccttcgttggtaattttgtttccgaggtttcggttactgggtactagtacgccgtcgttccggggtcccgaccgtagggcccctaacggaacgggccggaaggggggttccggtaggttcgggtaggtactaggtttacacggccgaattgtaggtagtaaccgggtaagttttcggataaactttagtatccggactaaggtctaccgggtagaacggccttaatccaaacgttcccgtacgagaaccgtacgttaacccgtccgaattgtaccgttgttacggttaacgatccggttnacgtcttagacgtagggcgtaaacggttcccgtcggtacctttgttacggttttaaactcggtaacgggtcgaaccggttgggttaccgggttaggggtaaggggtttaccccggtttaggtttaacccgggg

SEQ ID NO: 26409 - DNA, 782 bp, Homo sapiens
  misc_feature: GYAE6OF02I48GI.25.36.D03.1.454.CMB.1.raw
  modified_base (96)..(96): a, c, t, g, unknown or other
  misc_feature (96)..(96): n is a, c, g, or t
  modified_base (193)..(193): a, c, t, g, unknown or other
  misc_feature (193)..(193): n is a, c, g, or t
  modified_base (452)..(452): a, c, t, g, unknown or other
  misc_feature (452)..(452): n is a, c, g, or t
tcagactgtacagtcacgaccggtgctcgatttagctgcgtcacgatctctcttgggagctctgggagaggagcccagcactagaagtcggcggtntttccattcggtgatcagcactgacacgagagactcaccagtggtgtttggctagagtcgttcgggttttccctcggttgcctttacgttttaaggnggttcgtcccagttgtccgtaggtgccgtaccgtgggttacggacgttcgggtggggggaacgtcggtcggtaccacggccgtaggggccgtcccgtaggaagtccttcttccgtgtacgactccgttcgttaggttattttacggttcgaggtttcggttcgttaaggcgtagttcgctccggtcggtcccgacaccggtccgtccgagggtcgggaacgggtccgggtgttgggtaagcgtaagttacgcgcaacgnggtatggtaacggttaagttgaaacgttattaagttcgaacgttcgtaacgtcgtacggtacggacgggtaccgtaccttacaccgtagtacctacgacggtaacgtaaccgtacggttaaccgtaacgttacgttaccgtaaggtttaccgttaacggtacgttacggtacgtacgttccggttaacggtacggtaaccggtacggtaccggtaccgttcggtttcccgttaggttaaccgtttccggtaacgttccgggtaaaggtcccgggttaaggaccccgggtttaggggttagggtttaacccggttaggttttaacccgggg

SEQ ID NO: 26410 - DNA, 339 bp, Homo sapiens
  misc_feature: GYAE6OF02GQ96L.25.36.D03.1.454.CMB.1.raw
  modified_base (320)..(339): a, c, t, g, unknown or other
  misc_feature (320)..(339): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgactaacttattactgaccaaacaatataattaattatcgacctactttggaccaggggaccaagggtggagactacaaacgtactggtggctcgcacctatctgttcctcatccttcccgctatctgaactgtacagttctggacgccggggtctcggacgaacgggcgcctatacggnnnnnnnnnnnnnnnnnnnn

SEQ ID NO: 26411 - DNA, 306 bp, Homo sapiens
  misc_feature: GYAE6OF02I3FGK.25.36.D03.1.454.CMB.1.raw
  modified_base (259)..(259): a, c, t, g, unknown or other
  misc_feature (259)..(259): n is a, c, g, or t
  modified_base (293)..(293): a, c, t, g, unknown or other
  misc_feature (293)..(293): n is a, c, g, or t
  modified_base (298)..(301): a, c, t, g, unknown or other
  misc_feature (298)..(301): n is a, c, g, or t
  modified_base (303)..(306): a, c, t, g, unknown or other
  misc_feature (303)..(306): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtattttgctaacttattactgaccaacaataataataattattcgacctacttttggcgaggggacaaggtggagatacaaacgactgtggctgacaccatctgtcttcattcttcccgcatctnaactgtacagtctgagcgggtctggcaaggcganatagnnnnannnn

SEQ ID NO: 26412 - DNA, 721 bp, Homo sapiens
  misc_feature: GYAE6OF02GI3ZB.25.36.D03.1.454.CMB.1.raw
  modified_base (581)..(581): a, c, t, g, unknown or other
  misc_feature (581)..(581): n is a, c, g, or t
tcagactgtacagtcacgaccggtgctcgatttagctgcgtcacgatctctcttgggggcagaagtctctctcagtcaggacacagcatggacatgagggtccctgctcagctccgtgggactcctgctgctctggcctcccagactaccagatgtgacgtccagatcgacccagtctccatccctcctgtctgctatcgtgttggacgacagaatcgagactactctaccgttcggccgggcgacgtcgagggactaattacgacttaaatttagtttacgtccgttaggtaactaccgaaacgaacggaaaaccgtaggggtaacgtacgtttaaccgtaacgccttaccgttagtacttacgtatcgtacctacgtacccttaccgtaaccgtttactaccgttaccggtacccggggttaccctacgttaccggttcggtacgacgggtccgtacggtacgtacggaacgttcgggtaggtaccgtacggtacggttaacctaccttacctaccaacgttacgtaccgacgtaccgtaccgccgttacaccggtacgtacgtaggtaatacggtttntaccgttaatttaaccgttaattaccggttaataacgtaaacgttactaccttaccgtccccttaccttaaccgtaccgttaccgggtttcgggaacggtaacggggtaaccggtagggtaacggtacaacggtaaaccg

SEQ ID NO: 26413 - DNA, 710 bp, Homo sapiens
  misc_feature: GYAE6OF02JKP6Y.25.36.D03.1.454.CMB.1.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctacgggacccccggnagagggtcctccgattctcttgtctgggagcagctccggcgtacggaaatagttgtactacgtggtaccagcagctcccgaagaacccgccccaagcctccacactctagtacgaattcggatacgtaggcccgtacctccgagggtactaccgtcgtaccgtaacttcctcgtacggtcctacgtaacgttcgacggtcctaccgtccggcccttacccgtcgaccctaacgtcgtacggtcgggccgttaccggtaccgggtagtcgttacgggacgtacgttacgaaactttacgttacggtaggtaccgttacggtagggttttacggggacttacgggtccctaaaggggttctaagggtacggttaccgggtacccgggtttagggtaccggggtttccgggtaaccgggtaacggggtacccgtaaccgggtacgtacccgggtacccggtttacccggtcgggtaaccggtaccggtaaccccgggtaacccgg

SEQ ID NO: 26414 - DNA, 875 bp, Homo sapiens
  misc_feature: GYAE6OF02HFK4A.25.36.D03.1.454.CMB.1.raw
tcagactgtacagtcacgaccggtgctcgatttagctgcgtcacgatctctcttggggagctctgggagaggagcccagcactagaagtcggcggtgttccattcggtgatcagcactgaacacagaggactcaccatggagtttgggctgagcgttgggttttcctcgttgcttcgttttaagaggtgtccatgtcaggtgcacgtggtggagtcggtggggggaggtcgtcggtccaggtccgtgggacggtccctgagtactctccgtggtagaacgtcctcgtaggtatttagttcgtaggttggttccgtggcctagtcgccgtacggttcggggtcccgccgagggtcctccggaagggtaccgggaacggggggtcccggtaagggtttcggggttcgggactaaggtttactaggacctaaggtagtgaaggttgggtaaacgtttcgtaaaggtaacttaagtttacgtcggaccgtaaacgggttacccgttacgggtaacggggtaaaaccgggggtcccttaaacgttaccgaaacccgttacttacccgtaaccgtaaagggtaaacccggtaaaccgtttaaacccgggttaacccccgggtaaaattacggttttacggttaacggtttaaaccggtttaacggggaaaacgttttcgggtaaccgttacccgggttaccgtttaacggggaaacgggttaccggtaacccggggtaacgggtacccgtttaccggggttacctttaaccggtttacggttttaaaccgtttacccgggttagggttaccggacggggttaacggttaccgggggtttaggggggtaacggggttttagggttaacgggtttaaaccggg

SEQ ID NO: 26415 - DNA, 635 bp, Homo sapiens
  misc_feature: GYAE6OF02H0M3Y.25.36.D03.1.454.CMB.1.raw
tcagactgtacagtcacgaccggtgctcgatttagctgcgtcacgatctctcttgggggagctctgggagaggagccccagccctgagattcccaggtgtttccattcagtgatcagcactgaacacagaggactcaccatggagttgggactgagctggtattttccttttggcttatttaaaaggtgtccagtgtagaagtgacaacgtggtggagtcgtgggggaggtcgttggacagccctggcacggcccctaggacgactctccgtgtcgccacgcctgtggacttctacctttgatgtatttactcggccagtcgactacgtcgggtccgcaacgccgtacggaggggaacgggccgtggaggtggtacctacgtaggttacgttaggttaggtaagttaggtcggtaagctaaggtagggtcttagtggaccggtacttacgtgggtacgggaaacgggtcccgtaagttccaaccgtcgttacccgttaccaaggaacgaaccgaaacggcccaaacgtaacctccgtagtactaccgtgaacctaatcgaaacagttacaggtacagtcggtacggaacacgtaacggtcttagttctacgtgtaagtaactaaattagtaacgg

SEQ ID NO: 26416 - DNA, 300 bp, Homo sapiens
  misc_feature: GYAE6OF02FUN47.25.36.D03.1.454.CMB.1.raw
  modified_base (283)..(283): a, c, t, g, unknown or other
  misc_feature (283)..(283): n is a, c, g, or t
  modified_base (289)..(300): a, c, t, g, unknown or other
  misc_feature (289)..(300): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgccaacaatataataattattcgaccacttttggccaggggaccaaggtggagatcaaacgactgtggctgcaccatctgtcttcatcttcccgcatctgaactgtacagtctgagcgggctggcaaggcncatagnnnnnnnnnnnn

SEQ ID NO: 26417 - DNA, 342 bp, Homo sapiens
  misc_feature: GYAE6OF02GTDG5.25.36.D03.1.454.CMB.1.raw
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(342): a, c, t, g, unknown or other
  misc_feature (310)..(342): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgaccaacaatataataattattcgacctacttttggccaggggaccaaggtggagatacaaacgaactgtggctgcaccatctgtcttcatcctcccgccatctgtaactgtacagtcgtagacgtcgggacgtggacgaaggccgacagtagntnannnnnnnnnnnnnnnnnnnnnnnnnnnnnnnnn

SEQ ID NO: 26418 - DNA, 748 bp, Homo sapiens
  misc_feature: GYAE6OF02GGACM.25.36.D03.1.454.CMB.1.raw
  modified_base (191)..(191): a, c, t, g, unknown or other
  misc_feature (191)..(191): n is a, c, g, or t
  modified_base (211)..(211): a, c, t, g, unknown or other
  misc_feature (211)..(211): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtccgtcgggcccagtctgtgctgactcacgcccaccctnagtgtcgtcgggaccccggnaggacgggtctccatctcttgttcgngggancgagcctccgacggtacggtaaaattagtttcgtacttacgttacggtaccgagcacgtccctacccgaacggtaaaccccggccccctaaggtcccttaccctactacttaccgtaagtaacggtaagtcgacgttcgacggccccggtacctaccggaaggtacctaccgtcggacctacgtttctacgtcggtaccgtacgtacgggttcgttccgtccgttcccgtaccgggtcccctcccggtcggacccgtactaccgggtacggtccggggtaccgttcccggggaccggtagggtacgtacgggacgttacgtagtaactttacgtcggtaggttcgtacggttagggtttcggacgttccggtaccgtggttccgttaggtcggggttcgggtaccggggttcggtttcgggggtaccgggtaccggggtacggaaccgtacggtccgttaccggtccggttaccggtacggtaccgtaccggtccggtaacccggg

SEQ ID NO: 26419 - DNA, 675 bp, Homo sapiens
  misc_feature: GYAE6OF02G9PNN.25.36.D03.1.454.CMB.1.raw
  modified_base (159)..(159): a, c, t, g, unknown or other
  misc_feature (159)..(159): n is a, c, g, or t
  modified_base (656)..(656): a, c, t, g, unknown or other
  misc_feature (656)..(656): n is a, c, g, or t
  modified_base (660)..(660): a, c, t, g, unknown or other
  misc_feature (660)..(660): n is a, c, g, or t
  modified_base (665)..(666): a, c, t, g, unknown or other
  misc_feature (665)..(666): n is a, c, g, or t
  modified_base (670)..(675): a, c, t, g, unknown or other
  misc_feature (670)..(675): n is a, c, g, or t
tcagactgtacagtcacgaccggtgctcgatttagctgcgtcacgatctctcttgggcagtccaggggagggcctgaagtgggtcggcctcatgagaccgagggcctctggagggacagtggagcatgacgcgtctctgagtgggcagggttcagcctntcgaagggacgactcctaaagccatccgctatctgacaaatgaccagcctagactagtcgaagacctcagccatctattattgtgcgagctgcctgtctcgtgtagttcggggtacttagttggaacgaactttacttccgtaacctttaccttaccccgaactacgttcgggtacgggttttcggggggaccgtaaaccgggggacccgacgggttcgtaacttcgttcccttcccgtacccaccccgttaccaacccggtaaccgggcccctaacgttccccggtttaccccttccccccgtcggtcccctaccccgttccctacccgaacggaccgtacccgtaccgtccgggtaccggggacaccgaccggccgggtcccgtccgggcgtcggtccgtcggtaccgaacggtacctttaccgtccttacctacgtaccgtagtcgtacggacggtcgggtcgtacgggtaccgacggccggacctaggtacgnacgntacgnncgcnnnnnn

SEQ ID NO: 26420 - DNA, 781 bp, Homo sapiens
  misc_feature: GYAE6OF02JUBSJ.25.36.D03.1.454.CMB.1.raw
tcagactgtacagtcacgaccggtgctcgatttagctgcgtcacgatctctcttgggggcagaagtctctctcagtcaggacacagcatggacatggaggtccctgctcagctcctgggactcctgcgtgctctggcctcccagactacccagtatgtcggaccgtaccagagtcgaccctagtcctacccacttccctcccgttgtcctcgccgtacttccgtggttacggacggaaccaaggtaactacggacgtaccgaagttcccgacggtttcgggacccgggtacgtaccggtacggaacgggtactaacgttaacgtaccgttaaagtttacgttaacgtcccggttaggttaaccttaccgaacgtaaaacggaaccggtaagggtaacggtacgtttaaccgtaaaccggtcgttccggtaacgttaacgtcgttacgtacgtccgttaccgtcccgtaacccgtaccgttaaccgtaccgtttaccgggaccgggttacccctagttacccggttcgttacggaccggcggtacgtacgtagtacgtcgtaggtacggaggtaccgttacgtcttacactaccttagtaccgcgtaactccggtaccgtacgcctacggacgttaacgaacgttacggtcgttaacgtaccgtactttaacgttaacgtatttaaacgtaattacgttacgtacctcgttacccgtacgttaccttaccgttagggtaaccggtacggtaccggtaaggtacggtaccgtacgttaaacgg

SEQ ID NO: 26421 - DNA, 848 bp, Homo sapiens
  misc_feature: GYAE6OF02HJO2P.25.36.D03.1.454.CMB.1.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
tcagactgtacagtcacgaccggtgctcgatttagctgcgtcacgatctctcttggggggggtcacaagaggcagcgctctcgggacgtctccaccatggcctgggctctgctgctcctcactctcctcactcaggacacgagggtcctgggcccagtctcggcctgactcaacctgcctccgtgtcgtggtctccgtggacgtcaatcacctatttccngcactggaaccngcactgattgttggcttactttcgtaccttgttccttcgttacggtaacccaaccgaaccgaaccccggtaacaaacggtacctaacccgaaaaccttcctaattttaaacgtttttacgaacgtaaccgtaaggtaaccggtcccggtccccgttacggttacggggttttacctacggttaccgttaacgttccgtaaccgttcgggtacccttaccgtaaacgttccgtacgggaaccctaaaccggtacccggtacccccttaaccccgtaaaacttaaccttcccgtttcggtacgggtacccttacccgaacgggttacccgtaacgggaaacggtaccggtacggttacgtttacgggtttttactttcgttcggttccgtttaggtttaccgtcgttagttggttcgggtaacttaaacggttaaaacgttaggttttacgggtccggttacggttccggggaccgggtaaccggtaacccgttagtttacccggtaccggtttaacgttaacggtcgtaaccgggtacccgtaacccgggtaccttcccggtccccccgtttacggtaccgttacccgttccggtttaccccgttaccccctacccg

SEQ ID NO: 26422 - DNA, 666 bp, Homo sapiens
  misc_feature: GYAE6OF02ILY8R.25.36.D03.1.454.CMB.1.raw
  modified_base (219)..(219): a, c, t, g, unknown or other
  misc_feature (219)..(219): n is a, c, g, or t
tcagactgtacagtcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctcgccgtgactcagcctgcctcgtgtctgggtctccgtgacagtcgatcacctatttccngcactcggactcagcactagagttcgttgcgtaaggtttactttactttcgtccttccgtacggtaacctaaaccaaccgacccgaacggaaccaaaccgtaccccctaaaacttaacctacgttaatttagacggacggaccctaagtacgaccggtacccagtaacgtacgtttactaacgtcttcttcctcgtacgtcctacgtaacgttcgtcggacacgaccgaccggtcctccgtacgaactacttcgtcggtacggtcctacggtacggcgtaggacggacggtacgtcgtagtactttatacgtcgtaccgtatcgtaagtcgtagacctacgaactaccaactaaccgttccgtaccgtccggtacccggtacggtaccgtaccgggtacctaccggtccgtacggtaccgacgtaccccgaccggtacccctaaccg

SEQ ID NO: 26423 - DNA, 323 bp, Homo sapiens
  misc_feature: GYAE6OF02FXBYJ.25.36.D03.1.454.CMB.1.raw
  modified_base (235)..(235): a, c, t, g, unknown or other
  misc_feature (235)..(235): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (301)..(323): a, c, t, g, unknown or other
  misc_feature (301)..(323): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgccaacaatataaacttaattaattagacctacttttggcctaggggaccaaggtggagataccaaagactgtggctgcacntctgtcttcatctcccgcacgtctagactgtaccngttcnggagcggctggacaaggcgacatagnnnnnnnnnnnnnnnnnnnnnnn

SEQ ID NO: 26424 - DNA, 731 bp, Homo sapiens
  misc_feature: GYAE6OF02HXO5W.25.36.D03.1.454.CMB.1.raw
  modified_base (128)..(128): a, c, t, g, unknown or other
  misc_feature (128)..(128): n is a, c, g, or t
  modified_base (300)..(300): a, c, t, g, unknown or other
  misc_feature (300)..(300): n is a, c, g, or t
tcagactgtacagtcacgaccggtgctcgatttagctgcgtcacgatctctcgttggggagctctgggagaggacgccccagccctgagattcccgaggttgtttccattcagtgatcagcactgaanacagagactcaccagtggagttgggactaggacgtcgtggttacttttttccgtttggtacttaagttttaaaaggtgtaccgtagtgtgaagttgacgaacgtggtggaggtcggtgggggaggtcgtttggacgacgccgtggcgacggtcccgtgacgcttccgtccgngtgcgacgtcctcgtagtacttacctcgtttagacgttagtaattacgttccgaccgagttgtaccgtacggttccggggacccgtacgtaaccgacccgtaaccgggaaggggaaccgggtcggttagggtacggttcgggttacgtaccgggttaaggtttaacgttttaggttacggtaaaggtcgggttagtaacgtacgtaaggtaagtctaaggtcggtacgtacgttcgtaggtacggtaacggtacgtacgtaccgtactaccgtcgttaacgacgtaagaccgtaacgacctaaacgtaccgttaccctagtaccgtcgtaacgacttaaacgcgtaacgtaagtccgtagacgtacgcgtacggacggacgtaccgtacgtacttagtacgtacgaaacgtttaactaagttaattaacgg

SEQ ID NO: 26425 - DNA, 709 bp, Homo sapiens
  misc_feature: GYAE6OF02GFWHD.25.36.D03.1.454.CMB.1.raw
  modified_base (205)..(205): a, c, t, g, unknown or other
  misc_feature (205)..(205): n is a, c, g, or t
  modified_base (537)..(537): a, c, t, g, unknown or other
  misc_feature (537)..(537): n is a, c, g, or t
tcagactgtacagtcacgaccggtgctcgatttagctgcgtcacgatctctcttgggggcagcagtctctctcagtcaggacacagcatggacatgagggtccctgctcagctcctggactcctgctgctctggctcccaggtaccagctgtgacatccagatgacccagtcctccttccttcctgtctgcattcgtggtggganacgagacgtccaccatccacgttcggccggcgtagtcaggactaattaacctaatttaatttcgccgttaggtactacaaccaaccaaaccggaagggaactaccccgtaagtcctaccgttgaacttcttacttacgtcgtacctacttacccctaccgttgccgtaaccgttaccggaccggggtttacccctaacgttccgtaccgtccgttcgtaaccgggcccggtagtacgggttacgggtacgtccggttacgggtaacgtaggttactttacggtacgttccgtaccttacccgacttaccccgtacccgggtccttcggaccncgtaccgtcggtaaccgtacttccgttacgaccgttaacttttaacttacttaccgtaaacctaaaacttacgtaacctacgtacggttccgtaaccccgttagttggtttacccgaccgggtaacggacctaaccggttcggaccgtaccgtaacgtaacggcgttaccgg

SEQ ID NO: 26426 - DNA, 758 bp, Homo sapiens
  misc_feature: GYAE6OF02JJLD6.25.36.D03.1.454.CMB.1.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcgttggggggggtcacaagaggcagcgctctcgggacgtctccaccatggcctggactctgctgctcctcactctcctcactcaggacacagggtcctgggcccaggtctggcctgactcaacctgacctcgtgtctgggtctcctggacggtcaatccactatttccngcctaactggaaccngcacgtgacttgttggcttacttgaccttgtctcttggaccaacaccaccggacaaacggctacaaactctaattattttacgacgaccagtaacgcgtcctcgttgggtttcaggtacgactttcaactcggcctacgaaccgttcgtacggactaaccgacgggtcccttaaccccgtaaataaacgttccgtaccgtaggggtccttacccgaggtacgtaagtaaacggacggtaaggtcgttacgtttaacgtttccgaggttcgttggtttacgacgttaagtccggtcgggaacccttaaggtaaaaccttaagttttcgggacgttacccggtacggggtaaccgggtaaccgggtaacccgtaagtttaacccggtaccggttttaaccttaaacggtcccgggtaaaaccttacccccgggaaaaggttcccgttaaccccgtacccccgggttttacccggtaaccgttaaaccccggttccgttaacccccgtttcccccgggtacccccg

SEQ ID NO: 26427 - DNA, 169 bp, Homo sapiens
  misc_feature: GYAE6OF02HNK7V.25.36.D03.1.454.CMB.1.raw
  modified_base (140)..(169): a, c, t, g, unknown or other
  misc_feature (140)..(169): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcacgggtnnnnnnnnnnnnnnnnnnnnnnnnnnnnnn

SEQ ID NO: 26428 - DNA, 702 bp, Homo sapiens
  misc_feature: GYAE6OF02JH0Z2.25.36.D03.1.454.CMB.1.raw
tcagactgtacagtcacgaccggtgctcgatttagctgcgtcacgatctctcttggggacataacaaccagattcttcctctaaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtcctccgtgttaaggtctaccgggaagcgagtgtgttcgtcagacgactacgactcaccgtgggtccggctaggcccttcgtaggaaccgtggggtcctggaggttcggggtagggaacctaacgtacaacccggtccaccggaccggaaaccaacgaggacggtacgcacgatcgtacgtttcgaggggcaagagtcctaccgttttcggaggtaccgtaacgtaccacgggcgcgagtacgtacagtagaacttctacaacgtcgaccttgacggttacgtttggacccggtaacgtaccgggtaccgttaagttaacgtttacgttacggtttacggacggtaacgtaaacgggtacggttacccgttcggaacccttaacggtaaaaaccggttccggaaaccgtacgggtccgtaaccggggttaccgtaccccgggttaaccccgggtccggggtaaacccccggggg

SEQ ID NO: 26429 - DNA, 778 bp, Homo sapiens
  misc_feature: GYAE6OF02FEWWO.25.36.D03.1.454.CMB.1.raw
  modified_base (239)..(239): a, c, t, g, unknown or other
  misc_feature (239)..(239): n is a, c, g, or t
tcagactgtacagtcacgaccggtgctcgatttagctgcgtcacgatctctctggggcagaagtctctctcagtcaggacacagcatggacatgaggtccctgctcagctcctgggactcctgctgctctggctcccagataccagatgtgacgtccagatcgacccagtctccatcctcctgtctgctatcgttagtggacgacagaactcagactacgtctacgttcggacccgggngaacggtcgacgggctattaacgactaatttacttacgccgttaggttactaaccgaacgaaaggtaaaccggaaggggtaacgtacgtttaccgtaacgtccgtaccgtagtacttacgttaactcggtccgttaccgtacccgttaaccgtaccggtttacctaccggttaccggtacggggttacccctagtttccgtaccgggtttacacgggccgggtactacggttacgtaacgtcggtaggggaactacggtaacgttacctaccgttacctactaaccgttactaccgacggtacctaccggtacccgttacgtaccgtaccgtaccgttaaggtaacgttaacgtttacggttaaccgttaaccgttaaaccgttttaacttaacccgttaaagttaaaccgttaaaacgttaacttaacctacccgttccccggttacccctaccgtttaaccgtaccggttttaccggggaccgggtaaccggggtaaccggttaacggggtaacggtacgtaaccgttaaacccggg

SEQ ID NO: 26430 - DNA, 360 bp, Homo sapiens
  misc_feature: GYAE6OF02JC3AO.25.36.D03.1.454.CMB.1.raw
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (308)..(309): a, c, t, g, unknown or other
  misc_feature (308)..(309): n is a, c, g, or t
  modified_base (320)..(360): a, c, t, g, unknown or other
  misc_feature (320)..(360): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgacttttgctaacttattactgccaacatataataattattacgaccacttttggcctaggggaccaaggtgagatcaaacgactgtagctgcaccatctgtcttcattcctttcccgctatctagaactgtacngtcctgacggtcggctggcaagggtcacactaggntancnncatgcatgatnnnnnnnnnnnnnnnnnnnnnnnnnnnnnnnnnnnnnnnnn

SEQ ID NO: 26431 - DNA, 239 bp, Homo sapiens
  misc_feature: GYAE6OF02GADZT.25.36.D03.1.454.CMB.1.raw
  modified_base (215)..(215): a, c, t, g, unknown or other
  misc_feature (215)..(215): n is a, c, g, or t
  modified_base (220)..(239): a, c, t, g, unknown or other
  misc_feature (220)..(239): n is a, c, g, or t
tcagactgtacagtcacgaccggtgctcgatttagctgcgtcacgatctctcttggggccagggttccctggtcaccgtctcctcagcctccacaagggcccatcggtcttcccctggcgccctgctccaggacgcacctccgagagccacagccggcctgggctgcctggtcaaggactacttccactgtacagtctgagcgggctggcaggcnatagnnnnnnnnnnnnnnnnnnnn

SEQ ID NO: 26432 - DNA, 857 bp, Homo sapiens
  misc_feature: GYAE6OF02HA2Z0.25.36.D03.1.454.CMB.1.raw
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcacgcccaccctcagtcgtcgtcggggacccccggcaggacgggtctcccattccttcgttcggttcgtggggagcgacgtccctccggaacgttacggtaaaatttaggttttcgtaccgttaacgttcggtaacccaggacaacggtccctacccgaacggaaaccccggccccctaaagtcccttaccctacacttcctaaaggtaacggtaactcggaatccggaacggtccccgggacccttacggtaacggggtaaccttacccgtacggaacccttacttccgttaccggtacggtcctaacggtacggtccgttcggtccgtcccggtccggtccccttcccgtcgggacccctattccgggaccgggtccgggtacccggttaccccggggtacgggaacggtacgtacgggaacggtaccgttaacgtaaactttaccgttacggttaggtacgttacgggttaagggtttcggacgttaccgaccgttacgggttacgtacggggttacgggttaccgggtaccgggttaccgggtttcgggttaccggggacgggtaaccgggtaccgaccggttcggtaccgggttacccggtaccggtaacgggttaacccgaaccgggttaacccgaccgggttaccccgtcccggtacccccgggtttcgtcccgtttacccgttcccgg

SEQ ID NO: 26433 - DNA, 669 bp, Homo sapiens
  misc_feature: GYAE6OF02ILT1E.25.36.D03.1.454.CMB.1.raw
  modified_base (141)..(141): a, c, t, g, unknown or other
  misc_feature (141)..(141): n is a, c, g, or t
  modified_base (385)..(385): a, c, t, g, unknown or other
  misc_feature (385)..(385): n is a, c, g, or t
  modified_base (521)..(521): a, c, t, g, unknown or other
  misc_feature (521)..(521): n is a, c, g, or t
tcagactgtacagtcacgaccggtgctcgatttagctgcgtcacgatctctcttggggacataacaaccagattcttcctctaaagaagcccctgggagcacagctcatcaccatggactggacctggagttcctctttgnggtggcagcagctacgaggtgtccactccaggtccagctgtgcatctggctgagtgagaggccgtggtcctggtgacgggtctccgtgtaacggtctccggaagctaggtgtgttcgcgagtacagtacacctcgtaccggttcgggtaccggccacgggtccctacgtacggaaccgttcgggtccctggtaggtcgggtacgggaaccaagtacgaaccgaccgacggaaccgaagaaccgnggaacgtccgcaacgtgtacctaggttccgaaggtcaggtacgtactccgtttacgtacggtacgtaacgttaccgaccggacgtacgagtactacgagtacgaagttccgttaacagttacgcccgaggttcgtntttacgggacgtaccgaggtacccgtaagttaagttaccgtgttaccgacggaacgtaacgtaccggtacgtaaccgtccgtaacgtaaaccggacgtaacgaccgtcgtccggtaccgtacccggtacccggtccgggtaacccggg

SEQ ID NO: 26434 - DNA, 311 bp, Homo sapiens
  misc_feature: GYAE6OF02GPH3E.25.36.D03.1.454.CMB.1.raw
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (303)..(311): a, c, t, g, unknown or other
  misc_feature (303)..(311): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgtatttttgacctaacttattactgaccaacaatataattaattattcgacctacttttggcctaggggaccaaggtggagatacaaacgaactgtgctgcaccatctgtacttcactcctcccgcctatctgactgtacngtctgagcggtcgtggcgaaggcncangnnnnnnnnn

SEQ ID NO: 26435 - DNA, 774 bp, Homo sapiens
  misc_feature: GYAE6OF02HHPB8.25.36.D03.1.454.CMB.1.raw
  modified_base (153)..(153): a, c, t, g, unknown or other
  misc_feature (153)..(153): n is a, c, g, or t
  modified_base (433)..(433): a, c, t, g, unknown or other
  misc_feature (433)..(433): n is a, c, g, or t
  modified_base (751)..(751): a, c, t, g, unknown or other
  misc_feature (751)..(751): n is a, c, g, or t
tcagactgtacagtcacgaccggtgctcgatttagctgcgtcacgatctctcttggggtctggcgccaggggtcccttccaatatcagcaccatggcctggactcctctcttttctgttcctcctcacttgctgcccagggtccaaatctcanactgtggtgactcgaggacgcccctcgactgactgtcgtccccgagggagggacagtcactctacaccgttgtctccttcacggcgtcgtgggtcacgtccaccaggtagaacgaaccactaaccaaacgttcggtaccacgacgaacgtaaccggtacggaaccaaacccgacccgaacggggcctacgttagttaatttaggtcggtacaaacctaaaaaccttaaaaaaccgtctttcccgttaacccggtaccccgttaccggtccccggtttacncccggtaaccggtccttacccccgttccggggttacgggggaaccaacgtcccgtcgtacccgtcgaacctacgtcgtaacgtacgtaggtgtaccgcggtaacggtcggtagggacggtacgaccggtaacgaccgtaaccgtaaccacggttccgccttcggtccttaccgttcccgtgggtttcggtcggttcggtttacggtaggggttcgggttacggggaccgggtaacggtaaccgtccggtacggttaccgtccgggtcgggaccgtccggtaacccgacggtcccgtcccggacccggttcccgttacncccgtttcctccccgttaccccc

SEQ ID NO: 26436 - DNA, 680 bp, Homo sapiens
  misc_feature: GYAE6OF02HIM0W.25.36.D03.1.454.CMB.1.raw
  modified_base (292)..(292): a, c, t, g, unknown or other
  misc_feature (292)..(292): n is a, c, g, or t
  modified_base (324)..(324): a, c, t, g, unknown or other
  misc_feature (324)..(324): n is a, c, g, or t
  modified_base (603)..(603): a, c, t, g, unknown or other
  misc_feature (603)..(603): n is a, c, g, or t
tcagactgtacagtcacgaccggtgctcgatttagctgcgtcacgatctctcttgggggagctctggggagaggagccccagccctgagattcccaggtgtttccattcagtgatcagcactgaacacagaggactcaccatggagttgggactgagctggtatttttcctttggcttaattttaaaggtgtccagtgtgaagtgcaactgggtggagtcgtaggggggaggtcgttggtacagcctgggacacgggcccctaggacgtacctcctcctgtgccacgtcctntggtacttcctacctttggattcggtatttancgacctatcgctacggtcgggtccgacaacggtcctaccgggaagggggacgggtccgtaggggtacggtggggttacctacggtaagggttagtttaggttagggtaattagggtaggtacgacgtaggtacgggtcgttagtcgggtacgtaacgttcgttagggacgggtaacgggtccgttaacgttccaaccgtacgttcctacgaagaccgtaaccgaaacgaccaaacgtaccttccgtacttacgtactacggacctaaagtccgaaacgngttacgtgacgaggtcgtaggaacggtacgtacgtccttagttactacgtagtaactaattaaagtttacgtaacgg

SEQ ID NO: 26437 - DNA, 719 bp, Homo sapiens
  misc_feature: GYAE6OF02FU0L4.25.36.D03.1.454.CMB.1.raw
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
tcagactgtacagtcacgaccggtgctcgatttagctgcgtcacgatctctcttggggagctctgggagaggagccccagccctgagattcccaggtgtttccattcagtgatcagcactgaacacagaggactcaccatggagttgggactgagctggattttccttttggctattttaaaggtgtccagtgtgaagtgcaacgtggtggagtcgtgggggaggcgttggtacagcctggcaggcccctgagactctcctgtgcagcctntggattcaccttttgatgtatttancgcctagtcgtcaccgttggggtcccggcaacggtcctaccggaaggggggaacggggtcccgttggggaggtttcggggtcctacggtaagggtttacgttttaggttagggtaaagttaagggttggggttaacgacgtaaggttacgggacttaggtacgggacggtaccgttcgttggtaggggtaaccggggaccgtacttacccgaaccgtacgttccgttccgaaggtaacggaaccgaaacccggaccaaacggtaacccttcccgtacgttaacttacgtacggtactaaaagtcgaaacgttagtacgaggtaacggacgcgtaagggaaccggtaccgtaaccgggttaccgtttaagttaacgttacggttaggttaacgtaaactttaaaacgttttaacgtttaaccgg

SEQ ID NO: 26438 - DNA, 777 bp, Homo sapiens
  misc_feature: GYAE6OF02I5M4M.25.36.D03.1.454.CMB.1.raw
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgctcttttaagagtgtccactgtcaggtncacctggtgagtctgggggaggcgtggtccagcctgggaggtcccnggacgactcctccgtgtgaacgtcctacgttggtaattttgtttaccaggtttggtttacttcgggtacctaagtttcggacctacgttccggggttcccggacccggacggtccgtacccgagggccggtaaacggggggtcccgggaggtttacggggtttgggaccgttaagtttaagtacggtacaaccgagtttaggagttacgggtaaacgtttacgtagtaaattagtttaacgacgtacgaaggtaacccgttccgtaggaaccggggtaccctattccgacctaattcccgtaccgtaagaacgtacaaccgtttacccgaaagttctttgggtaacgtttagttacgggtaaacgttcgggtaacaacgggtcccgttaaggtaccggtaaggttaccggggaacttacggttccgggtaaccccgtttgtttaacggttacggtttttaccgcggttaggccggtaagggttacggtttccgggggtaagggttacggggttacgttttaaacccggggg

SEQ ID NO: 26439 - DNA, 666 bp, Homo sapiens
  misc_feature: GYAE6OF02G8UH0.25.36.D03.1.454.CMB.1.raw
  modified_base (115)..(115): a, c, t, g, unknown or other
  misc_feature (115)..(115): n is a, c, g, or t
  modified_base (131)..(131): a, c, t, g, unknown or other
  misc_feature (131)..(131): n is a, c, g, or t
  modified_base (231)..(231): a, c, t, g, unknown or other
  misc_feature (231)..(231): n is a, c, g, or t
  modified_base (394)..(394): a, c, t, g, unknown or other
  misc_feature (394)..(394): n is a, c, g, or t
tcagactgtacagtcacgaccggtgctcgatttagctgcgtcacgatctctcttggggcagaagtctctctcagtcaggacacagcatggacatgagggtccctgctcagctccngggactctgctgctcncggctcccagactaccgagactgtacgaccgtccagatcgaccagtcctaccactccctcctgtactgccatcgtgttaggatacaagaactcgagctanctacggtcgccgggtcgacgtaccgagggctaagttacgacgaatttaccgttagtacccgtaggttaactaactaacggtaaacgaaaccgtaaggggtactacgttaaccgtaagtccgtacctgtaatccgtaatcggtctcggtccctacaccgtttanaccttcgggaacggtccctacgtttgtaccggtttacgacggttacggagtacggtacgtaaacgttcggacggtaacaagtcggtactactccgacctatacgtacgtacggcaacggttcccgaagtctaccggacgtagtaaacgtcgttacgtataaccgttaactagtttaataccggtaataagtacttactacgtcgtacccttcgtaacgttccggttaacggaccggaacggtacggtaaccgggataccggtaagtaaccgg

SEQ ID NO: 26440 - DNA, 728 bp, Homo sapiens
  misc_feature: GYAE6OF02GO4I1.25.36.D03.1.454.CMB.1.raw
  modified_base (506)..(506): a, c, t, g, unknown or other
  misc_feature (506)..(506): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctctggcctcccagactaccagatgtgacgtccagatcgacccagtcctccgactccccttcccgtgtacctgctattcgtgttagggacacagaactcgagacctatcctacgttcggggacccggggacgtaacggtaccggaggggtactaacgttttaacggacctttaaaagtttttaaccttaacggtccccggttaaggttaaccttaaccgaaaacgaacgggaaaacccggtagggggtaacgttaaccggtttaaccgtaaacgtcccgttaaccgtgtaacttccgttaagccgtcctcgtacccccgtaacgtaaccttaaccggtactaccgggtaccgggtaccctaggttccttcggtaccngggtccggactaggtacgtacgttccggaaggtacgtagtaccgttcgacttctacatacgtgaccgtagtaccgcgtagccagtacgtacgaagtcgtgttacacgtttaactttaccgaatttagaaaccgttaattactaactcccggtcctacccttgttaccgttaccggtaccggacgggtaaccgtacggtaacgggtactagtaccgtaaacgg

SEQ ID NO: 26441 - DNA, 713 bp, Homo sapiens
  misc_feature: GYAE6OF02G8QJ9.25.36.D03.1.454.CMB.1.raw
  modified_base (196)..(196): a, c, t, g, unknown or other
  misc_feature (196)..(196): n is a, c, g, or t
  modified_base (487)..(487): a, c, t, g, unknown or other
  misc_feature (487)..(487): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagcccaccctcagtgtcgtcggggacccccgggnaggagggtcctccatcgtcttgttctggggagcagctccggacggtacggaaattagtttgtctacgtggtaccagctacgcctaccgaacggaaaccccggccccaaagcctccctacactcgtagtacggaatcgactcgacggccgcccgttacgagggtactaccgttcggaaccgtgttcctacgtcggccgttacgaacgttccgtcggtaccttccggtccgggtcccctcccgtcggccctacgtcgacgggttcgggcccgtacccgggtcgggaagtacgnggacggtcgtataaacgttcgttaacgtggaggttcgttaggggttacgagtccgaccgtggtttacgtcggggacgtttccgggcgggttaccgggttccggggttcgggaccgggttaacgggaaccgcgttcggaccggtacccggttacggtacgggtacccggacgtacccggacggttacccgccccgttaccccgggtacgaccccgttcttaccccgg

SEQ ID NO: 26442 - DNA, 320 bp, Homo sapiens
  misc_feature: GYAE6OF02GLN8Z.25.36.D03.1.454.CMB.1.raw
  modified_base (238)..(238): a, c, t, g, unknown or other
  misc_feature (238)..(238): n is a, c, g, or t
  modified_base (305)..(320): a, c, t, g, unknown or other
  misc_feature (305)..(320): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgccaacaatataataattattcgacctactttggccaggggaccaaggtggagatacaaacgactgtggctgcacatctgtcttnactcctcccgctatctcgtaactgtaccagtctggacggcggcgtaggcaagggcgtacaagttagnnnnnnnnnnnnnnnn

SEQ ID NO: 26443 - DNA, 184 bp, Homo sapiens
  misc_feature: GYAE6OF02IN3NU.25.36.D03.1.454.CMB.1.raw
  modified_base (173)..(184): a, c, t, g, unknown or other
  misc_feature (173)..(184): n is a, c, g, or t
tcagactgtacagtcacgaccggtgctcgatttagctgcgtcacgatctctcttgggtattcggcggagggaccaagctgaccgtcctaagtcagcccaaggctgccccctcggtcactctgttcccaccctcctcactgtacagtctgagcgggctggacaaggcgcatagnnnnnnnnnnnn

SEQ ID NO: 26444 - DNA, 348 bp, Homo sapiens
  misc_feature: GYAE6OF02GP6EI.25.36.D03.1.454.CMB.1.raw
  modified_base (211)..(211): a, c, t, g, unknown or other
  misc_feature (211)..(211): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (300)..(302): a, c, t, g, unknown or other
  misc_feature (300)..(302): n is a, c, g, or t
  modified_base (304)..(348): a, c, t, g, unknown or other
  misc_feature (304)..(348): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaactttattactgaccaaactaatataattaattattcgacctactttggccaggggaccaaggtgganagtacaaacgaactggtgctgcaccatctgtctnacttcctcccgctntctagactgtacatctgacgtcggctggcaggcgcagtagnnngnnnnnnnnnnnnnnnnnnnnnnnnnnnnnnnnnnnnnnnnnnnnn

SEQ ID NO: 26445 - DNA, 745 bp, Homo sapiens
  misc_feature: GYAE6OF02INE4N.25.36.D03.1.454.CMB.1.raw
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagtcgttgggttttcctcgttgcttactttaagaggttgtcctacgtgtcaggtgcaccgtggtggagtcggtgggggagtcggtcggtaccgaggtccgtgggacgtcccgtggacgtacctcgtccgtggtagacgtcctcgttaggtatttacggtttcgtaggttcggttcgtggtctagttcgacgtcggttcgggtacccgcgtacggccgtaccgagggtacggaacgggggtccgtaaggttcggtacggacgtaaggtttacgacggcaagtcgtaggtagtaacggtaaagtttacgtagtaaagtttacgttagtcggtaccgtaacgggtaccgttaccgggtaagggaaaccgggtccgtaaccgttacccgaaccgttacgtacgtaacccgaaggtaaccgtaaacctaacccggtttaaccggtaaacttagtttacggtaacgtttaacgttaaggtaaacgtcggttaacctacgacgttacggaggtaacggtagacggtacgtccggtctacgttagtacttcgtggtcgtacggtacggtacggttaggtacgggttagttacggttaacgg

SEQ ID NO: 26446 - DNA, 905 bp, Homo sapiens
  misc_feature: GYAE6OF02I302N.25.36.D03.1.454.CMB.1.raw
  modified_base (146)..(146): a, c, t, g, unknown or other
  misc_feature (146)..(146): n is a, c, g, or t
tcagactgtacagtcacgaccggtgctcgatttagctgcgtcacgatctctcttgggtctggcgccagggtcccttccaatatcagcaccatggcctggactcctctctttctgttcctcctcacttgctgccaggtccaaatctnagactgtggtgactcgtaggagccctcactgactgtcgtcccgaggacggacacgttcactcgtcacctgtcgtccttccacgtcgcgttcggtctacgtaccaccgtagtacgaacgaaccctacgtaaccctaaacgtccggttaccaggtccaaacgtaaccgtacggaaccaaccccgacccggtaacggtccgacgttacgtaatttacgttggtacgtaaacctaaaaaccttaaaaaccgacttaccgtacccggtaaccccgttccggtaccccggttccgtaccgtaccgtcccgttacccccggttccggttaccgggggaaccgtaaaccggtcccgtacccgggtacccgttaccgacccgttaccgttacggtaccgtaacggttaccgttacgggttccggaacccggtaccgggtaccctaacgggtaaccgggggttaacccggaccgggttacccgtaaccgggtaaacccttaccccgttacggtacccgtacccggttacccgtccccttccggttaacccgttcgggttaccgggttcgggtttcggttccggggtttacgggttccgggttaaccggggtccggtaaaccgggtaacccggaacggttcccgttacccgggtacccgggtaacggttccgggaacccccggtaccgacccgggttaccccgtcccccggttaccccggttccggtacccctttacccgggttccccggtttacccccgttaccccccg

SEQ ID NO: 26447 - DNA, 781 bp, Homo sapiens
  misc_feature: GYAE6OF02J0XM7.25.36.D03.1.454.CMB.1.raw
  modified_base (641)..(641): a, c, t, g, unknown or other
  misc_feature (641)..(641): n is a, c, g, or t
tcagactgtacagtcacgaccggtgctcgatttagctgcgtcacgatcgtctcttggggagcttcagctgtggtagagaagacaggattcagacaatctccagcatggccggcctccctctcctcctcaccctcctcactcactgtgcgacggtccgtcgggcccaggtctgtcgtctgacctcacgtcccaccctgtacgtcggtcgtccgggggacccccgggcaagggtcgggtcctcctacgttccttacgtttcgttacggtggggacgcgtactccggtaccgtaccggtaacggtaaagtttaggtttacgtacgttacgttcggtaaccagccacgtcctacccgaaccggtaacccggccccgaacgtccctacctactacgtactaagtaacggtagtcacgtacgaccggtaccggaccgtaacggcggtactaccggtcggtaacctctttcgtacggtcgtaccgttaacgtacggttccgacgttccggtacccgtccggtcccctacggtcccgaccgtctacggtacggtccgggtaccggtccgggtacgtcgggtaggtacggtaacggttccggtataacggttcttacggtcggttacggtacggttagggtacggttacngggttacgtaacgtccggtgggttaaccggggttaccggcgggtttacggtcggggtaacggggcccgggttacggaaaccgttcggtacccgttacgggccggtacggtaaccggttcggtaacccggtaccgggtacc

SEQ ID NO: 26448 - DNA, 629 bp, Homo sapiens
  misc_feature: GYAE6OF02I7UNL.25.36.D03.1.454.CMB.1.raw
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (281)..(281): a, c, t, g, unknown or other
  misc_feature (281)..(281): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
tcagactgtacagtcacgaccggtgctcgatttagctgcgtcacgatctctcttggggtctggcgcagggtcccttcaatatcagcaccatggcctggactcctctctttctgttcctcctcacttgctgcccagggtccaaatctcagactgtggtgactcaggagccctcacgtgaccgtgtcccagggaggacagtcactcctacncctggtcncttccagcgcgtgggtcagtcacagtgacgacctataccaacgtggttccacacacgaacccgnggaaccaacccacccgaggactactcgtattagtggtancaaacctaaaancgtactcgacccctgtacccggttcacacggcctcccgtcgttacggggacagtctgcccttgacnctcggtnacgngtcgtacncgaacgccgngaacgggacgacggtccgtagacccgtaccgtactcctacgtcgaccttccgtccgtaggtcgtaggttcgtaggtttcgggttcgttcggggccggtacgggtaccgtaacgtcggtacccgtcggtcggtacgtaccggtccgtaacgccgtacccgtaccgtaccgtaccgtaccgtccgtacccgttcccgtaccccc

SEQ ID NO: 26449 - DNA, 811 bp, Homo sapiens
  misc_feature: GYAE6OF02IUBGB.25.36.D03.1.454.CMB.1.raw
  modified_base (382)..(382): a, c, t, g, unknown or other
  misc_feature (382)..(382): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcgttgggtttttcctcgtttgcttactttttaaaggaggttgtcctattggtcagggttcgcctaccgtgggtggaggtcggtggggggaggcgttcggtcccgaggtccgtgggggacggtccctggacgaccttcctccgttggtagtaaccgccttcgtaggttaattttacgtttccaggtttggttacgtgggtcctaagttcgccgtacggtcggggtcccncggacgggtcccctcggaacgggcgggtaacgggggtccggtagggttggggttcggacgttaaggtttaacgacgtaccgaacgtagtacggtaagttagggttaaacgtttcgtaggttaaaacttcgttagtacggaaccgtaacgggtacccgtaccgggtaagggaacccgggtacttaccttacccgaacttacgttacccgtacgaacggtaacgtaacccttaaaccggttacccggtaaactttgtttacggttacgttaacggtttaaggtaaacgttcgttagaacggccgtttaaaggacggttaaacgtaccgggaacggtccgtcggttaccgttcggtaacgtttacgttaacggtcggtcggtaacggtagggtacgggttaccggggtaggtttacgggttaagtttacggg

SEQ ID NO: 26450 - DNA, 611 bp, Homo sapiens
  misc_feature: GYAE6OF02JYA16.25.36.D03.1.454.CMB.1.raw
  modified_base (177)..(177): a, c, t, g, unknown or other
  misc_feature (177)..(177): n is a, c, g, or t
  modified_base (184)..(184): a, c, t, g, unknown or other
  misc_feature (184)..(184): n is a, c, g, or t
  modified_base (246)..(246): a, c, t, g, unknown or other
  misc_feature (246)..(246): n is a, c, g, or t
  modified_base (344)..(344): a, c, t, g, unknown or other
  misc_feature (344)..(344): n is a, c, g, or t
  modified_base (435)..(435): a, c, t, g, unknown or other
  misc_feature (435)..(435): n is a, c, g, or t
tcagactgtacagtcacgaccggtgctcgatttagctgcgtcacgatctctcttgggggcagaagtctctctcagtcaggacacagcatggacagtggacgggtccctgctcagtctccgtgggctccgtgcctgtctcgtggcctcccagactaccagtatgtcgacgtccaagtntcgaccngtctccagtccctcctgtctgcatcgtggtgagacagtaactcagcatctacgtggccgganacggtcgaggtacagttacgacttaagtttgttacgccgttaggtaacacccgaaagaacgaaaccggtagggtacgtacgtttacgactctaccgtntacgtactagtgtcctacgcccgtactaccgtagaccgttcgggaccggccttatcgtacggtcgacggtcgacggtatacgtacgtacgnggtacagttctcgtacctcgtatacgttcacgactcgtcgacgtcgacggactacgtaggtactgtttacgtagtaccttaacttagttactaaacgtaattaaacgttactactccgttcctccgttactaccgttcggtaacggcggttacgaggttacgagtacgataaccgg

SEQ ID NO: 26451 - DNA, 295 bp, Homo sapiens
  misc_feature: GYAE6OF02HBX80.25.36.D03.1.454.CMB.1.raw
  modified_base (289)..(295): a, c, t, g, unknown or other
  misc_feature (289)..(295): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgctaacttattactgccaacaatataataattattcgaccacttttggccaggggaccaaggtggagatacaaacgaactgtgctgcaccatctgtcttcatctcccgcatctgaactgtacagtctgagcggctggcaaggcgcatagnnnnnnn

SEQ ID NO: 26452 - DNA, 796 bp, Homo sapiens
  misc_feature: GYAE6OF02IZTCE.25.36.D03.1.454.CMB.1.raw
  modified_base (172)..(172): a, c, t, g, unknown or other
  misc_feature (172)..(172): n is a, c, g, or t
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
  modified_base (367)..(367): a, c, t, g, unknown or other
  misc_feature (367)..(367): n is a, c, g, or t
tcagactgtacagtcacgaccggtgctcgatttagctgcgtcacgatctctcttggggagagaagacaggattcaggacaatctccagcatggccggcctccctctcctcctcaccctcctcactcactgtgcagggtcctgggcccagtctgtgctgactcagccaccctnagtgtcgtcgggacccccggnagagggtctccatctcttgttcgtgggancagcgtccgacgtacgaaatagtttgcttactggtaccagcacgctacccgaaggaaacccggcccccaagtccttcccactaacttcgtaagaacggtaatgactcgacggcccggccctacgaggtactaccgtacgaccgtnttaccgtcgtaggcctacggacgttcgtacggccttcccgtaccggtcccttcccgacggtaccctagtcgacgggttccgggtcccgttaccgggtaccggaagggtactagggtaaccggtacgttaaggtaaactttacgttaaccggtcggttacggtacggtttacggggtttacgggaacgttccggtaaccgttacggttacggttacgggtacgggtttcccgggtacccgggttaccgggggttttaccgggttacccgggggaaccggggttaaccggggtaacccgtacggttacccggtttaaccgggaccccggtttaccggtaacggtacccggtaaccggtaaccccggtacggggttaccccttccccgggacccccccggtttacgggttacccttaaccggtttcccccgg

SEQ ID NO: 26453 - DNA, 718 bp, Homo sapiens
  misc_feature: GYAE6OF02G4KVT.25.36.D03.1.454.CMB.1.raw
tcagactgtacagtcacgaccggtgctcgatttagctgcgtcacgatctctcttgggggcagaagtctctctcagtcaggacacagcatggacatgaggtccctgctcagctcctgggactcctgctgctcgtggcctcccagtaactaccagtatgtcgacgtccagtacgtacgaccctagtcctccgtactccctccctgtacctgctattcgttggtagacgtacagaactcagtacactacgtacgttcgggccgggacgtacggtacggacgggtactaagttacgtacttaaagtttacgttacgtcgttacggtaactaccgaaacgtaacggaaccgtagggtaacgtaacgtttaccaacgtccttactcgtacttcgtatcgtcctcgacccttaccgtaacttacctacgttacccggtacggtaccctacttccgggttacgaccgtacggtccgacttaggtaccgtacgttacggtacggaagtacgtacgtaccctacgttctaacgtactacgtacgagtaccgtcgtcctgtacggtaacctacggtaagtacgtttagtcgtttacgaaccttttaactttacgttaaccgttaaataaacgttacgttacgtcggttaccgaaacggtttccgtaacggtcgttacccgggccctaaccgggtaagtcggtaaaccggtctaacgtacgtaaacccgg

SEQ ID NO: 26454 - DNA, 494 bp, Homo sapiens
  misc_feature: GYAE6OF02IRO34.25.36.D03.1.454.CMB.1.raw
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (342)..(345): a, c, t, g, unknown or other
  misc_feature (342)..(345): n is a, c, g, or t
  modified_base (350)..(350): a, c, t, g, unknown or other
  misc_feature (350)..(350): n is a, c, g, or t
  modified_base (352)..(353): a, c, t, g, unknown or other
  misc_feature (352)..(353): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
tcagactgtacagtcacgaccggtgctcgatttagctgcgtcacgatctctcttgggatagaagttattcagcaggcacacaacagaggcagttccagaattcactctcaccatcagcagcctgcagcctgatgattttgcaacttattactgtccaacaatataataattattcgactactttgccagggaccaaggtgagatcaaacgactgtggctgcacatctagtctcatctccgcctatctgaactggtaactagtcctgtacgtccgggctgggactaaggtccgcgaattaacggaagcgatcgctgnagtngttagcatcagntacaggtccnnnncgacngnngntgcgnacgtanattacngcgntacgtagtatacgcgtnacgtntgtnaagtntagacagtacncgcgacgtctagtacgtacggtacgtacaccgtcgtacgagtacgtacgtacgtacgtacgtacgtacgtagtacg

SEQ ID NO: 26455 - DNA, 369 bp, Homo sapiens
  misc_feature: GYAE6OF02IXUM2.25.36.D03.1.454.CMB.1.raw
  modified_base (161)..(161): a, c, t, g, unknown or other
  misc_feature (161)..(161): n is a, c, g, or t
  modified_base (228)..(228): a, c, t, g, unknown or other
  misc_feature (228)..(228): n is a, c, g, or t
  modified_base (319)..(319): a, c, t, g, unknown or other
  misc_feature (319)..(319): n is a, c, g, or t
  modified_base (330)..(331): a, c, t, g, unknown or other
  misc_feature (330)..(331): n is a, c, g, or t
  modified_base (337)..(338): a, c, t, g, unknown or other
  misc_feature (337)..(338): n is a, c, g, or t
  modified_base (340)..(369): a, c, t, g, unknown or other
  misc_feature (340)..(369): n is a, c, g, or t
tcagactgtacagtcacgaccggtgctcgatttagctgcgtcacgatctctcttgggatagaagttattcagcaggcacacaacagaggcagttccagaattcactctccaccatcagcagcctgcagcctgatgtattttgctaacttattactgccaanaataataataattattcgacctacttttcggccaggggaaccaaggtggagatacaaacgaacgtgnggctgccaccatctgtcttcatccttcccgctattcctggaacttcgtacctagtctggagccgggtctggcaaggtccgcgaacttaggnagcagctgctnnagctanncnnnnnnnnnnnnnnnnnnnnnnnnnnnnnn

SEQ ID NO: 26456 - DNA, 613 bp, Homo sapiens
  misc_feature: GYAE6OF02GSA36.25.36.D03.1.454.CMB.1.raw
  modified_base (309)..(309): a, c, t, g, unknown or other
  misc_feature (309)..(309): n is a, c, g, or t
  modified_base (323)..(323): a, c, t, g, unknown or other
  misc_feature (323)..(323): n is a, c, g, or t
  modified_base (421)..(421): a, c, t, g, unknown or other
  misc_feature (421)..(421): n is a, c, g, or t
tcagactgtacagtcacgaccggtgctcgatttagctgcgtcacgatctctcttggggtctggcgccaggggtcccttccaatatcagcaccatggcctggactcctctctttctgttcctcctcacttgctgcccagggtccaaatctcagactgtggtgactcaggagccctcactgactgtgtccccgaggagggacagtcactctcacctgtgcttccagcgctgggtcagtcaccagtgagaaccatccaaacttggtccagcagaacctggacaaccaccgagggcacgtgtattagtggtanacaaactaaaaacncttacgtacggacccctcgtccgtctcgacgtcctccctcgtacggggacaacgtcgtcgcccgtgacctacgtcgtcgtagatgtcgacgacgtcgnggaggacgcggacgtcaccgtacactcgtactcgcttacgtcctcggtgggttggtcgtcggtttcgggtcggttccgggcggaacgggacccaacgttccggacccggttcggttacgggcctacgggacccaaccggtcccgtccccgacccggttccggtccctccgttcccggttccgtaccccccgg

SEQ ID NO: 26457 - DNA, 691 bp, Homo sapiens
  misc_feature: GYAE6OF02HMB59.25.36.D03.1.454.CMB.1.raw
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagtcgttgggttttcctcgttgcttcgttttaagaggtgtccactgtcaggtgcaccgtggtggagtcgtggggggacgtcgtggtccaggccgtggggacgtccctgagtacctctccttggtgaacgtccctgtaggttattttacgtttcaggttggttcgtggtcagttcgcgtaccgtgggtcccgccgaggtcctaccgagggccgaagggggccgtaggttgggtgcgtagtttangaccatagtgagttggtaatttcgaagtaattnttangactacgtacgttcggaggaacgggtcctaattaccacctatccgtacaagtacgtaactaaccgtttacccgaattacgttcggttaacgttacggttaagtaacggttcgtaacgacggttccagggtaacggtaccgtaacggaccgggttacctcgggttacctttgttacggttaacgtttaccgtcggtacggaacggttacggtacggggtttacggggttaaggggtttaggttaacggttttaaccgggg

SEQ ID NO: 26458 - DNA, 742 bp, Homo sapiens
  misc_feature: GYAE6OF02GW64Y.25.36.D03.1.454.CMB.1.raw
  modified_base (175)..(175): a, c, t, g, unknown or other
  misc_feature (175)..(175): n is a, c, g, or t
tcagactgtacagtcacgaccggtgctcgatttagctgcgtcacgatctctcttgggggcagaagtctctctcagtcaggacacagcatggacatgagggtccctgctcagctcctgggactcctgctgctcgtggcctccagactaccagatgtgacgtcagatcgaccagtcnccactcctcctgtctgctattcgtgttaggacgacagaatcgagcaatctacgtcggccgggacgaggtcgagggactagttacgacttaagtttattcgcttaggttacaaccgtaacgaacggaaaccggaagggtacgtacgtttaccgtaacgtccgttccgtagtacttcgtaacgttcgtcgtcgtcccttacccgtaacgttaccgtaccgtaccggtaaccggggttccctagtttccggtttaccggttacgtaccggacggtacgtaacggtcgtaacgttacgggtacggaacgttacggtaccgttaccgtaacgtcctaactaccttacgaccgtacgaccgtacgcccgttagaccgtaacggcccgttaaaggacgttacgttaccggttaataccgttaaaccgttttacgttaacgttaacgttaaacgttaaagttactaacgtttacccgtcccttaaccgtttacccgttacccggttaccgggtttcgggtaaccggtaacggggttaaaccgtaggggtaacggtaaccgttaaccggtaaccgg

SEQ ID NO: 26459 - DNA, 1027 bp, Homo sapiens
  misc_feature: GYAE6OF02HPZPY.25.36.D03.1.454.CMB.1.raw
tcagactgtacagtcacgaccggtgctcgatttagctgcgtcacgagtctctcttggggagctctgggagaggagccccagccctgagattcccgaggtgtttccattcagtgatcagcactgaacacaggacggactcaccagtggagttgggactgagcgtggtactttttccgtttggacttagttttaaaggtgtacctagtgtagaagtgactacgtggtggagttcggtggggggagtccgttaggtacgacggtccgtagggaccgacgggtccccgtaggaacgtccttccgttacccgttgggttaacgccgtaacgtccccgttcggtaacggacttttacccgttaaccgttttggaacgtttacggttaaatttaccggtcgttaaccccgtagtttacggaccccggttaaccggggttaccggggggttaccccggaaccgttaaccggggtacgtaccccgggggtaaagggggtaaccgggggtccccgtttagggggtacggtttccggggtttaacctaggggtaaccgggttttaaggtttaacgggtttaaaagggaaacgtttaggggttacggtaaaacggtcgtttaaacgggtacgggtaaccgtttaaggtaccggtaacgggtaacggtaccccggttaaccgggttaacgggaaaccggggtacccgttaacggtaaccggtaacccgttaacggtacccgtttaaccggaacggtaccgggtaaccgaccggtaaccctaaccggtaaaaccggttaaaccctttaacccgggttttactaaaccgggttacttaaacccggtttaaacggttaaaccggaaaccggttaaaccggtacgttacccggttaaacggtaacccggttaaaccgggtcgggttaacccgtttaacggttacccgttttaaaccgggtttaccgtaaccggggttccgggtttaaaccgggttacccgggtaaaacggttaaccgggtaacccgggtttaaccccggggggg

SEQ ID NO: 26460 - DNA, 712 bp, Homo sapiens
  misc_feature: GYAE6OF02JX9GO.25.36.D03.1.454.CMB.1.raw
  modified_base (192)..(192): a, c, t, g, unknown or other
  misc_feature (192)..(192): n is a, c, g, or t
  modified_base (339)..(339): a, c, t, g, unknown or other
  misc_feature (339)..(339): n is a, c, g, or t
  modified_base (373)..(373): a, c, t, g, unknown or other
  misc_feature (373)..(373): n is a, c, g, or t
tcagactgtacagtcacgaccggtgctcgatttagctgcgtcacgatctctcgttggggagctcgtgggagaggagcccagcactagaagtcggcggtgttccattcggtgatcagcactgaacacagaggactcaccagtggtagtttggctgagtcgttcgggttttctcgttgtccttacgttttaagngggttctactacgtgtcgtaggtcgccgaccgttggtaggtggtggtgggggtacgtcgtcggtacgacggtcgtagggcgtcctaggacgtcctcgtacgttgacgtacgtcgtcgttaggtactttcgtcgtggtcgtttaccgnggacttagtcggacgtacggttccggccgaaccnggtaaccgtcggaacgggtaccgggaacggggtccgtaggttgggtggtaagtcggttacctaaggccaagtggtaggtagttaccgggtaaacttgtaaggtaccttttaagcgttaccggataacgtcgtacggtaacggaccgtcgtactccgtaactagtcccttaggacgtaacgtaactaacggtacccgtagtagtcggttaacgtacggttacaacggtttgaaacggtccgtaaggttccgaggtaacgaacggtcgacgtacgtcggtcgttaagttcccgtagtggtgtaaccggtgtaccggttaaggtcgtaggttaaacgttggg

SEQ ID NO: 26461 - DNA, 874 bp, Homo sapiens
  misc_feature: GYAE6OF02G07ZF.25.36.D03.1.454.CMB.1.raw
  modified_base (183)..(183): a, c, t, g, unknown or other
  misc_feature (183)..(183): n is a, c, g, or t
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
tcagactgtacagtcacgaccggtgctcgatttagctgcgtcacgagtctctcttggggagctctgggagaggagcccagcactagaagtcggcggtgttccattcggtgatcagcactgaacacagaggactcaccagtggagtttgggctgacgctgggttttcctcgttgctctttaagnggtcgtcactgtcaggtcncacctggtggagtcnggggggagcgtcggtccagccgttgggacggtccctgacgtactctcctgtacgaacgtcctcgtacggtactttaggttacgtaggttcggttacgtggtccagttcgacgtcgtcgggtacccgccgacggtcctacccgaggtaccggaaacgggggtccgtaacggttcgggtcgtacgtacgttaacggtacggacctacgtaagttcggtaaagtacgggttaaagtttccgtaaggtaaatttacgttacggtaacggtaccctaaacgggtaccctttacccggggtaaacggtaaacgggggtacccgtttaaagtttacccgaaaaccccggttactttacccggtaaccggttaaacggtaacccggttaacttaaaaccccgggtccgggtaaaacctttacggtttagggtttaaacccgtttacggttaaaacgggttaccggtttaacgttacccgggtaacgttccggttaaacgggtacggttaaccggtaccgggtaacgggtaaccccggtttaggaccggtttaccgtttacggtttaacgttaaccccggttaaggttcccgggttaacgggttacggtacccgggtttaacgggggttaacgggtttaccgggttaacgtttttaaacccggggg

SEQ ID NO: 26462 - DNA, 697 bp, Homo sapiens
  misc_feature: GYAE6OF02FU5Y0.25.36.D03.1.454.CMB.1.raw
  modified_base (226)..(226): a, c, t, g, unknown or other
  misc_feature (226)..(226): n is a, c, g, or t
  modified_base (308)..(308): a, c, t, g, unknown or other
  misc_feature (308)..(308): n is a, c, g, or t
tcagactgtacagtcacgaccggtgctcgatttagctgcgtcacgatctctcgttgggggggggtcacaagaggcagcgctctcgggacgtctccaccatggcctgggctctgctgctcctcactctcctcactcaggacacgagggtcctgggcccagtctcggcctgactcaccgtgccctcgtgtcgtgggtcctccgtggacgtcaacgtcacctctttccngcacgtcggaaccagcacgtgacgttgtcgtacttacttcgtaccttgtcttcgtacgtaaccaaccgaaccgacccggaanaacggtcctaaccgtaaactcttaatttaagtttacgacgtaaccgtaagtacgcccgtcccgttaggtttcgggtttaactagttactcgttacaccggtgtacctaccgtaggtcgtaggacaaccggaccgtccctaccgtaaacacttccgtcgcggtcctacggacgttacgaggaaccggtcgtcgttacgttgtttacgttccgtagtccgttagttcgtagtcgttcggtagacgttaaactaaagttggttcgtacggtacggccgggtaacgggaccgttaactacggttcgtaccggttaataccggtcggaccgtaccgacggttccctcccggttacctacgtaccctaccggttccgtcccgtccccgttacccg

SEQ ID NO: 26463 - DNA, 741 bp, Homo sapiens
  misc_feature: GYAE6OF02GVXHE.25.36.D03.1.454.CMB.1.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
tcagactgtacagtcacgaccggtgctcgatttagctgcgtcacgatctctcttggggggggtcacaagaggcagcgctctcgggacgtctccaccatcggcctgggctctgctgctctcactctcctcactcaggacacagggtcctgggcccagtctggcctgactcaactgcctcgtgtctgggtctcgtggacgtcaatccactnttccngctactggaaccngcactgatgtgctacttgaccttgtctcttggtaccaacaaccgaccggtacaaaggctaccaaactctataattttgacgtaaccagtaacgccggcccttcgttggggtttctaaggtcgtattctactggctaccgaagtctggcaacgaccggcctacccgtacaacttcctacgtcgggtcctaccgcggtctacggaagacggaggtcgttacgttttatttccgttcggtcttcgggttagtaccgtttagtcggtttacgggaccgttaacggtaaaaaccgtttagggttttacgggttaccgggtccggttaccggggttaccggggaaaccggggttaacccccaagggttttccggaaccccgggttttacgtttaaaccgggttcccgaaccgggttacccccgtaaacgggtccccgtttaccccgggtccccccggtttaccggggttaccccttaacccggtttccctttaccgggtttaccccctttaaccccccgg

SEQ ID NO: 26464 - DNA, 669 bp, Homo sapiens
  misc_feature: GYAE6OF02FKJKR.25.36.D03.1.454.CMB.1.raw
  modified_base (430)..(430): a, c, t, g, unknown or other
  misc_feature (430)..(430): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (548)..(548): a, c, t, g, unknown or other
  misc_feature (548)..(548): n is a, c, g, or t
tcagactgtacagtcacgaccggtgctcgatttagctgcgtcacgatctctcttgggatagaagttattcagcaggcacacaacagaggcagttccagaattcactctcacctataccagcacgcctgacgacgcctggacttggtactttttcggacctaactttagttctcgacctaactaaagtaatttaattaaattttaacttaccgtacctttaaccggtttttcggacccggtagggggtaaaccctaaagggttcgggtaacgaacttaaccgaaaaccgtaacgttacgggttgtccggttcgaccttaacccattccgtacgttcttccaatttcccgtccccgaccttcttccgtaacgtaacgttcgtacgtacttcggacggttaacgggcggttaaccgcggtcggtaacggaccncggtaagtagcacatgaacnctggcncgtnagagcgctgcttgngngtcatagtactcgcgtcgcgtagtaggtacgtctacgtacgttatacgtacagtacgtacgtaacagtacgngtacgtccgtcggtccgtccctacctcgttcgtaccgtacggagtaacgtaactcgtcgaccgtacggccgttacgcgtaatactgacgtacgtagtcgaccgactcacctgtcgtaacgg

SEQ ID NO: 26465 - DNA, 643 bp, Homo sapiens
  misc_feature: GYAE6OF02F3HGB.25.36.D03.1.454.CMB.1.raw
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
tcagactgtacagtcacgaccggtgctcgatttagctgcgtcacgagtctctcttggggagagaagacaggattcaggacaatctccagcatggccggcctccctctcctcctcaccctcctcactcactgtgcagggtcctgggcccagtctgtgctgactcagccaccctcagtgtcgtcggggacccccgggnaggagggtcctccagtcctcttgttctgggancagctccgacgtcggaaatagttgctacgtgtaccagcagctccagaaccggcccccaagcctcctcatctataggaatgatcagcggccctgaggggtatacctgaccgtattcctactggcctcgaagtctaggcttccgtcggccctcccgtgggaccctatccaggtcgggcctccggtacgagggactggacggctagaattacttacgtgtggctaggtttgggatcggacctaggtcgttaggagttcgggtacccggtacgggttcggttccggggacgggaccggggtacccaagggtcctaccgggttaacccggtcccggttaacggggtcccggtaaccggacccggtaccgggtcccggtacccccggtccccggttccggttacccgtccgttacccccgg

SEQ ID NO: 26466 - DNA, 778 bp, Homo sapiens
  misc_feature: GYAE6OF02GC7O6.25.36.D03.1.454.CMB.1.raw
tcagactgtacagtcacgaccggtgctcgatttagctgcgtcacgatctctcttggggacataacaaccagattcttcctctaaaagaagccccctgggagcacagctcatcaccatggactggacctggaggttcctctttgtggtggcagcagctacaggtcgtccacctcccgaggtccagcgtggtgcaatcgtgggcctggacggtgaagaggccgtgggtcctcgggtagtacgggtcctccgtaggtacggtcgtaccggaagcgaggttgtcggttcgcagacatacactcgaccgtcgggccgcacggtcctcggtaggaaccgtcgggacctgggagggtcggggtaacggaacgtaaccgtaccggaacccggcctaccgggaaccggtaaacgaacgtagggaacggtccgacctaacgtacgtacgtaggttaccggaacgggtcgaaaggttccgttaacccgtttaaccccggtttttccgggaacggttaaccgtaaaccgggttcccgggtaacccgggccggtaacgtaacggttaaactaacggtacgtacgtaaccgttcctaacgtaacctaccggtaaccggttcgtaccggttagggtttaccggaaccggtaccgggtaccggtacgttacgtttacgtacgttacggtaaccgggtacgtaaggtaccgttcggtaccgtcggtaaccgttaacgaacgttcccgaagcgtacgtccggtaccggtaccccggtaccgggtacggtacccggg

SEQ ID NO: 26467 - DNA, 248 bp, Homo sapiens
  misc_feature: GYAE6OF01DGK6J.28.85.H08.1.454.CMB.1.raw
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
tcagagtacgctatcacgaccggtgctcgatttagtatcactcagtcgcgggtgcctccctgaccatctctgggctccaggctgacgatgacggtgattattactgctgctcattgcaggcacccgcactgtgatcttcggcggagggaccaagctgaccgtcctaggtcagctcaaggctgccccctggtcactctgttcccgcctctcatagcgtactctggagcgggctaggcaaggcncatagn

SEQ ID NO: 26468 - DNA, 251 bp, Homo sapiens
  misc_feature: GYAE6OF02IS3AJ.28.85.H08.1.454.CMB.1.raw
  modified_base (250)..(251): a, c, t, g, unknown or other
  misc_feature (250)..(251): n is a, c, g, or t
tcagagtacgctatcacgaccggtgctcgatttagtatcactcagtcgcgggtgcctccctgaccatctctgggctccaggctgacgatgacggtgattattactgctgctcatttgcaggcacccgcactgtgatcttcggcggagggaccaagctgaccgtcctaggtcagctcaaggctgccccctcggtcactctcgttcccacctcctcatagcgtactctgagcgggctggcaaggcgcatagnn

SEQ ID NO: 26469 - DNA, 250 bp, Homo sapiens
  misc_feature: GYAE6OF02GE0QG.28.85.H08.1.454.CMB.1.raw
  modified_base (242)..(242): a, c, t, g, unknown or other
  misc_feature (242)..(242): n is a, c, g, or t
  modified_base (248)..(250): a, c, t, g, unknown or other
  misc_feature (248)..(250): n is a, c, g, or t
tcagagtacgctatcacgaccggtgctcgatttagtatcactcagtcgcgggtgcctccctgaccatctctgggctccaggctgacgatgacggtgattattactgctgctcatttgcaggcacccgcactgtgatcttcggcggagggaccaagctgaccgtcctaggtcagctcaaggctgccccctggtcactctgttcccgcctcctcatagcgtactctgagcgggctggcaaggcncatagnnn

SEQ ID NO: 26470 - DNA, 251 bp, Homo sapiens
  misc_feature: GYAE6OF02IM9C5.28.85.H08.1.454.CMB.1.raw
  modified_base (250)..(251): a, c, t, g, unknown or other
  misc_feature (250)..(251): n is a, c, g, or t
tcagagtacgctatcacgaccggtgctcgatttagtatcactcagtcgcgggtgcctccctgaccatctctgggctccaggctgacgatgacggtgattattactgctgctcatttgcaggcacccgcactgtgatcttcggcggagggaccaagctgaccgtcctaggtcagctcaaggctgccccctcggtcactctgttcccgccctcctcatagcgtactctgagcgggctggcaaggcgcatagnn

SEQ ID NO: 26471 - DNA, 255 bp, Homo sapiens
  misc_feature: GYAE6OF02GSCDK.28.85.H08.1.454.CMB.1.raw
  modified_base (252)..(255): a, c, t, g, unknown or other
  misc_feature (252)..(255): n is a, c, g, or t
tcagagtacgctatcacgaccggtgctcgatttagtatcactcagtcgcgggtgcctccctcgaccatctctgggctccaggctgacgatgacggtgattattactgctgctcatttgcaggcacccgcactgtgatcttcggcggagggaccaagctgaccgtcctaggtcagctcaaggctgccccctcggtcactctgttcccgccctcctcatagcgtactcctgagcgggctggcaaggcgcatagnnnn

SEQ ID NO: 26472 - DNA, 283 bp, Homo sapiens
  misc_feature: GYAE6OF02JKDCB.28.85.H08.1.454.CMB.1.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (250)..(283): a, c, t, g, unknown or other
  misc_feature (250)..(283): n is a, c, g, or t
tcagagtacgctatcacgaccggtgctcgatttagtatcactcagtcgcggggtgcctccctgaccatctctgggctccgaggctgacgatgacggtgattattactgctgctcatttgcaggcacccgtcactgtgatcttcggcggagggaccaagctgaccgtcctaggtcagctcaaggctgccccctggtcactctgttcccacctcctcatagcgtacnctgagcggctggcaaggcncatagnnnnnnnnnnnnnnnnnnnnnnnnnnnnnnnnnn

SEQ ID NO: 26473 - DNA, 250 bp, Homo sapiens
  misc_feature: GYAE6OF02JHT1X.28.85.H08.1.454.CMB.1.raw
  modified_base (248)..(250): a, c, t, g, unknown or other
  misc_feature (248)..(250): n is a, c, g, or t
tcagagtacgctatcacgaccggtgctcgatttagtatcactcagtcgcgggtgcctccctgaccatctctgggctccaggctgacgatgacggtgattattactgctgctcatttgcaggcacccgcactgtgatcttcggcggagggaccaagctgaccgtcctaggtcagctcaaggctgcccctcggtcactctgttcccacctcctcatagcgtactctgagcgggctggcaaggcgcatagnnn

SEQ ID NO: 26474 - DNA, 411 bp, Homo sapiens
  misc_feature: GYAE6OF01EQ9PZ.16.1.A01.1.454.CMB.1.raw
  modified_base (409)..(411): a, c, t, g, unknown or other
  misc_feature (409)..(411): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggcttttgatttctggggccaagggacagtggtcaccgtctcttcagcctccaccaagggcccatcggtcttcccctggcaccctcctccaagagcacctctgggggcacagcggccctgggctgcctggtcaaggactacttccgagtagtacactgagcgggctggcaaggcgcatagnnn

SEQ ID NO: 26475 - DNA, 513 bp, Homo sapiens
  misc_feature: GYAE6OF01CYZ46.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaactcatcatttatgaagtctctaagcggccctcaggggtatctaaatcgcttctctggctccaagtctggcaacacggcctcctgaccgtctctggcctccagactgaggacgaggctgattatactgccactcatatagaagtagtactactctgtgtttcggcggaggaccaagctgaccgtccgtaggtcaggcccaaggtctcgccccctcggtcactctgttacccc

SEQ ID NO: 26476 - DNA, 411 bp, Homo sapiens
  misc_feature: GYAE6OF01CRV86.16.1.A01.1.454.CMB.1.raw
  modified_base (408)..(411): a, c, t, g, unknown or other
  misc_feature (408)..(411): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggcttttgatttctggggccaagggacagtggtcaccgtctcttcagcctccaccaagggcccatcggtcttcccctggcaccctcctccaagagcacctctgggggcacagcggccctgggctgcctggtcaaggctacttccgagtagtacactgagcgggctggcaaggcgcatagnnnn

SEQ ID NO: 26477 - DNA, 517 bp, Homo sapiens
  misc_feature: GYAE6OF01EXENQ.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaaagcccccaaaactcatcatttatgaagtctctaagcggccctcaggggtatctaaatcgcttctctggctccaagtctggcaacacggccctccctgaccgtctctggcctccagactgaggacgagctgattattactgccactcatatagaagtagtactactcctgtggttttcggcggaggaccagctgaccgtcgtaggtcagcccaaggctcgcccctcggccactcgtgttccccg

SEQ ID NO: 26478 - DNA, 516 bp, Homo sapiens
  misc_feature: GYAE6OF01BO8GY.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggcaaagcccccaaactcatcatttatgaagtctctaagcggcctcagggtatctaatcgcttctctgctccaagtctggcaacacggcctccctgaccatctctgggctccaggctgaggacgagggtgattattactgcagctcatatagaagtggcagctactcttcggtacttcgggcggtcggaccaagtccgtgaccgttccgtaggtccgacgcccgaaggcctcgccccctggtcctaccg

SEQ ID NO: 26479 - DNA, 515 bp, Homo sapiens
  misc_feature: GYAE6OF01A1KIR.16.1.A01.1.454.CMB.1.raw
tcagtgtactactccacgaccggtgctcgatttagacgtctcatcagggggtctcaggaggcagcgctctcaggacatctccaccatggcctggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgacccgtctctggcctccagactgaggacgaggctgattattactgccactcatatagaagtagtactactcctgtggttttcggcggaggaccaagctgaccgtctaggtcagcccaaggcctcgccccctggtccactctcgtccccg

SEQ ID NO: 26480 - DNA, 412 bp, Homo sapiens
  misc_feature: GYAE6OF01A74A1.16.1.A01.1.454.CMB.1.raw
  modified_base (409)..(412): a, c, t, g, unknown or other
  misc_feature (409)..(412): n is a, c, g, or t
tcagtgtactactccacgaccggtgctcgatttagacgtctcatcagggaagggcctggagtggattgggtacatctattacactgggagcacctactacaaaccgtccctgaagagtcgagctaccatattagttgacccgtctaggaaccaattctccctgaagatgacctttgtgactgccgcggacacggccgtctactactgtgcgaggaggtggagtcggagggcttttgatttctggggccaagggacagtggtcaccgtctcttcagcctccaccaagggcccatcggtcttcccctggcaccctcctccaagagcacctctgggggcacagcggccctgggctgcctggtcaaggactacttccgagtagtacactgagcgggctggcaaggcgcatagnnnn

SEQ ID NO: 26481 - DNA, 412 bp, Homo sapiens
  misc_feature: GYAE6OF01DIHG2.16.1.A01.1.454.CMB.1.raw
  modified_base (409)..(412): a, c, t, g, unknown or other
  misc_feature (409)..(412): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggcttttgatttctggggccaagggacagtggtcaccgtctcttcagcctccaccaagggcccatcggtcttcccctggcaccctcctccaagagcacctctgggggcacagcggccctgggctgcctggtcaaggactacttccgagtagtacactgagcgggctggcaaggcgcatagnnnn

SEQ ID NO: 26482 - DNA, 600 bp, Homo sapiens
  misc_feature: GYAE6OF01A04D3.16.1.A01.1.454.CMB.1.raw
  modified_base (259)..(259): a, c, t, g, unknown or other
  misc_feature (259)..(259): n is a, c, g, or t
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
  modified_base (594)..(594): a, c, t, g, unknown or other
  misc_feature (594)..(594): n is a, c, g, or t
tcagtgtactactccacgaccggtgctcgatttagacgtctcatcagggtgtccttgggttttgggggaagaggaagactgacggtcccccaggagttcaggagtcgggcccaggaccggtgaggccttcagagaccctctccctcacctgcgcggtctctggtgactccatgaacagtggtggtacctactggagctggatccgccagcagccagggaagggcctggagtggattgggtacatctattacactgggancacctactacaacccgtcctgaagagtcgagctaccatattagttgacccgtntaggaaccaattctccctgaagatgacctttgngactgccgcggacacggccgtctactactgtgcgaggaggtggagtcggagggcttttgatttcgtggggccaagggacaggtggtcacgtctcttcacgcctccaccgaacgggccccagtccggtccttcccccgtggcccacccctcctaccaacgcgccacctcgtcggggccacgacggccggcccgtgggcctggcccgtgggtaccgaacggaccttaccgttcccggaagttacggtaccncgtcgg

SEQ ID NO: 26483 - DNA, 504 bp, Homo sapiens
  misc_feature: GYAE6OF01EK0UC.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccatctctgggctccaggctgaggacgagggtgattattactgcagctcatatagaagtggcagcactctcgtattcggcggtgggaccaagcgtgaccgtctggtcagcccaaggcctcgccccctggtctaccg

SEQ ID NO: 26484 - DNA, 526 bp, Homo sapiens
  misc_feature: GYAE6OF01CNV03.16.1.A01.1.454.CMB.1.raw
  modified_base (365)..(365): a, c, t, g, unknown or other
  misc_feature (365)..(365): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacaggtcctgggcccagtctgccctgactcagcctgcctccgtgtctgggtctcctggacagtcgatcaccatctcctacactggaaccaacattgacgttggtgattataactttgtctcctggtaccaacaacacccaggcaaacgccccaaactcatcatttatgaagtctctaagcggccctcagggtatcgtaatcgcttctctggctccaagtctggcaacacggcctcccngaccgtctctggcctccagacctgaggacgaggctgattattactgccactcatatagaagtagtactactcctgtggttttcggcggtagggaccaagctgaccgttctaggtcagcccaaggcctcgccccctcggtacacctctcgttcccgtccccg

SEQ ID NO: 26485 - DNA, 629 bp, Homo sapiens
  misc_feature: GYAE6OF01BP6QL.16.1.A01.1.454.CMB.1.raw
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (431)..(431): a, c, t, g, unknown or other
  misc_feature (431)..(431): n is a, c, g, or t
tcagtgtactactccacgaccggtgctcgatttagacgtctcatcagggtgtccttgggttttggggggaagaggaagactgacggtcccccaggagttcaggagtcgggcccaggactggtgaggccttcagagaccctctccctcacctgcgcggtctctggtgactccatgaacagtggtggtacctactggagctggatccgccagcagccaggggaaggcctggagtggattgggtacatctattacacgtgggagcacctactacaacccgtccctgaagagtcgagctaccatattagtgacccgtntaggaaccattccnccctgaagatgacctttgngactgccgnggacncggctctactactgtgcgaggaggtggaggtcggagggtcgtttgtagtttcgtcggggccgaacggganaggtggtccaccgtctcttcacgcctaccaccaacgggcccacgtccggttccttcccccgtcggccgtaccccttcccgtccctaagaccgccaacccgtcgtcgggggtccaaccgacggcccgggcccgtcgggccgtccgccgttcgggtaccgaacgtaaccgttacgttacccggacgtaggttcccaacgg

SEQ ID NO: 26486 - DNA, 413 bp, Homo sapiens
  misc_feature: GYAE6OF01BL3FQ.16.1.A01.1.454.CMB.1.raw
  modified_base (409)..(413): a, c, t, g, unknown or other
  misc_feature (409)..(413): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggcttttgatttcgtggggccaaggggacagtggtcaccgtctcttcagcctccaccaagggcccatcggtcttcccctggcaccctctccagagcacctctgggggcacagcggccctgggctgcctggtcaaggactacttccgagtagtacactgagcgggctggcaaggcgcatagnnnnn

SEQ ID NO: 26487 - DNA, 411 bp, Homo sapiens
  misc_feature: GYAE6OF01A0EY3.16.1.A01.1.454.CMB.1.raw
  modified_base (407)..(411): a, c, t, g, unknown or other
  misc_feature (407)..(411): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggcttttgatttcgtggggccaagggacagtggtcaccgtctcttcagcctccaccaagggcccatcggtcttcccctggcaccctcctccaagagcacctctggggcacagcggccctgggctgcctggtcaaggctacttccgagtagtacactgagcggctggcaaggcgcatagnnnnn

SEQ ID NO: 26488 - DNA, 595 bp, Homo sapiens
  misc_feature: GYAE6OF01ERR24.16.1.A01.1.454.CMB.1.raw
  modified_base (414)..(414): a, c, t, g, unknown or other
  misc_feature (414)..(414): n is a, c, g, or t
tcagtgtactactccacgaccggtgctcgatttagacgtctcatcagggtgtccttgggttttggggggaagaggaagactgacggtcccccaggagttcaggagtcgggcccaggactggtgaggccttcagagaccctctccctcacctgcgcggtctctggtgattccatgaacagtggtggtacctactggagctggatccgccagcagccagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcgggaggtcttttgatttcgnggggcaagggacagtggtcaccgtctcttcagcctccaccaacgggcccatccggtccttcccctggccaccctccctccgaagacgaccacctccgtcgggggcacgcggccggcccgtcggggcctggcccgtggtccgaacgggtacctacgttacccggagttacggtaccgtacgg

SEQ ID NO: 26489 - DNA, 600 bp, Homo sapiens
  misc_feature: GYAE6OF01E0JFW.16.1.A01.1.454.CMB.1.raw
  modified_base (354)..(354): a, c, t, g, unknown or other
  misc_feature (354)..(354): n is a, c, g, or t
tcagtgtactactccacgaccggtgctcgatttagacgtctcatcagggggtctcaggaggcagcgctctcaggacatctccaccatggcctggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggacaaacgccccaaactcatcatttatagaagtctctaagccggcctcgagggtatctaatcgcttctctggctcaagtctgcaacncggcctccctgaccgtctcgtcggtccctccagactgacggtacgaggctagtattacttactcgaccctacgtacattaataagtaacgttagtaacctaccgttccgttaggtttcgggttttccgggacgggtacgggaaccctaaggtccgtacgacccgttccgtacggtaccgacggacccgtaacggtccctcccggtcccccgttcggtaccctaccgttcccgtccggttccccccg

SEQ ID NO: 26490 - DNA, 571 bp, Homo sapiens
  misc_feature: GYAE6OF01C6CXT.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaactcatcatttatgaagtctactaagcggccctcgaggggtatctaatcgcttctctggctcaagtctggcaacacggcctccctcgtaccgtctctcggcctccagactggacggacgaggctgtacttattactcgccactctaatatagaagttacgtaacttacttccgttggttcgggttttcggaccgggtagggaccgaaggtccgtacgtacccgtccgtacggtacacggcccgaaggtcctcggtccccccttcggtacctacctccgtccgttcccccg

SEQ ID NO: 26491 - DNA, 415 bp, Homo sapiens
  misc_feature: GYAE6OF01CVSTY.16.1.A01.1.454.CMB.1.raw
  modified_base (410)..(415): a, c, t, g, unknown or other
  misc_feature (410)..(415): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggcttttgatttctggggccaaggggacagtggtcaccgtctcttcagcctccaccaagggcccatcggtcttcccctggcaccctcctccaagagcacctcgtggggcacgagcgccctgggctgcctggtcaggactacgttccgagtagtacactgagcgggctggcaaggcgcatagnnnnnn

SEQ ID NO: 26492 - DNA, 681 bp, Homo sapiens
  misc_feature: GYAE6OF01BM0YT.16.1.A01.1.454.CMB.1.raw
tcagtgtactactccacgaccggtgctcgatttagacgtctcatcgagggggtctcaggaggcagcgctctcaggacatctccaccatggcctgggctctgctgctcctcaccctcctcactcgagggcacgagggtcctgggcccagtctgccctgactcagcctgcctcgtgtctgggtctccgtggacagtcgatcaccatcctcctgccacgtaggaaacccaatagtttgacggtttgggtatatttaattacttttgtcttccgtacggtaaccaaacaaccacccgaggacaaaccgacccccaaactccatactaatttatagtaacgtctacgaacgccgtcctagagggtactactatcgtcttctctgctcagtcgtgaccacgaccggtcctccgtcgtaccgtctcgtacggtcctccgagacgtggacgggacggaggtcgtacggtattacttacgtcgacctactactaagttaataacgtaagttaacgtaccgttacgttccggttacgggtttgggttttaccgggacgggtaccgggtaccgtaacggtaccgttccgggtacccggttacggtaccggttaccgaccggacccgacggtacccgtcccggtaccccccggttcggttacccctaccgttccgttcccgttaacccccccg

SEQ ID NO: 26493 - DNA, 417 bp, Homo sapiens
  misc_feature: GYAE6OF01C6MF8.16.1.A01.1.454.CMB.1.raw
  modified_base (411)..(417): a, c, t, g, unknown or other
  misc_feature (411)..(417): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgaccttttgtgactgccgcggacacggccgtctactactgtgcgaggaggtggagtcggagggtctttgatttcgtggggccaagggacagtggtcaccgtctcttcagcctccaccaagggcccatcggtcttcccctggcaccctcctccaagagcacctcgtggggcacagcggccctgggctgcctggtcaaggactacttccgagtagtacacgtgagcggctggcaaggcgcatagnnnnnnn

SEQ ID NO: 26494 - DNA, 558 bp, Homo sapiens
  misc_feature: GYAE6OF01C7ZV5.16.1.A01.1.454.CMB.1.raw
  modified_base (313)..(313): a, c, t, g, unknown or other
  misc_feature (313)..(313): n is a, c, g, or t
  modified_base (355)..(355): a, c, t, g, unknown or other
  misc_feature (355)..(355): n is a, c, g, or t
  modified_base (411)..(411): a, c, t, g, unknown or other
  misc_feature (411)..(411): n is a, c, g, or t
tcagtgtactactccacgaccggtgctcgatttagacgtctcatcagggtgtccttgggttttggggggaagaggaagactgacggtcccccaggagttcaggagtcgggcccaggactggtgaggccttcagagaccctctccctcacctgcgcggtctctggtgactccatgaacagtggtggtacctactggagctggatccgccagcagccagggaagggcctggagtggattgggtacatctattacactgggagcacctactacaacccgtccctgaagagtcgagctaccatattagttgaccgtntaggaaccaattctccctgaagatgacctttgtgactgccgnggacacggccgtctactactgtgcgaggaggtggagtcggaggcttttgatttcgngggcgaaggacagtgtcacgtctctcagcctcaccaacggccatcgtctcccctggccaccctcctaccaacgacgcacctcgtggggcacgagccggcccgtcgggctcgcctggtcaacggtactacgttccgagtagtactacg

SEQ ID NO: 26495 - DNA, 705 bp, Homo sapiens
  misc_feature: GYAE6OF01EXB2W.16.1.A01.1.454.CMB.1.raw
  modified_base (236)..(236): a, c, t, g, unknown or other
  misc_feature (236)..(236): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcacgtacggaaccaactattgacgttggtntaattattactttgtctctggtaccaaacaaccacccaggacaaacgcccccaaactcatctatttatagaacgtctacgtaagccggtaccctcgagggtatactaatcgtcttctctcgctaccaagtctcggacaacgacgtccctacctcgaccgtcctcgtcgtccctaccgacgtacgtacggacgggacgacggtacgttagttaacgtttaacttaccgtaccgtacctaacgttactaagttaagtaaacgttaacggttaacttaaccttacccgttaccggtttacgggtttacgggtttttaccggggacgggtaacgggtaacccgtaacggtcccgttaacggtaccccggttaccggtttaacggcccgtacccggaacccggtaccgggtcccgttacccccggtacccccgttccggtaaccttcccgttcccgtcccggtttaaccccccg

SEQ ID NO: 26496 - DNA, 517 bp, Homo sapiens
  misc_feature: GYAE6OF01DXZ6N.16.1.A01.1.454.CMB.1.raw
  modified_base (299)..(299): a, c, t, g, unknown or other
  misc_feature (299)..(299): n is a, c, g, or t
  modified_base (432)..(432): a, c, t, g, unknown or other
  misc_feature (432)..(432): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctaggtaaccaacaaccaccaggacaaacgcccccaaactcatctattangaagtctctaagcgcctgagggtatctaatcgtcttctctgctacaagtctggacaacacggccctcccgtgaccgtctctcggccctacagactgaggacgagtctagtattatctgccatcatatagaatntactctcgtgttggttcgacggagacagctgaccgtcgtagcacgcccaagtctccgtccccgtcgtccactcgtccgtaccccc

SEQ ID NO: 26497 - DNA, 531 bp, Homo sapiens
  misc_feature: GYAE6OF01D16DL.16.1.A01.1.454.CMB.1.raw
  modified_base (429)..(429): a, c, t, g, unknown or other
  misc_feature (429)..(429): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttataattatgtctcctggtaccaacagtaccaggcaaacgccccaaactcatgatttatgagtcagtaatcggcctcgtagggtttctaatcgtcttctctggctcaagtctcggacaacgcggcctccctgacatctctcggcctccgaggcgtgaagggacgtagggtcgtatttattacgtgacacgtctanataagtagtaagtggcagctactctcggttacgttcggcgggtaggaccaacgctcgaccgttaccgtaggtaccacggacccaaggcctccgccccgtcgg

SEQ ID NO: 26498 - DNA, 534 bp, Homo sapiens
  misc_feature: GYAE6OF01D4BLY.16.1.A01.1.454.CMB.1.raw
  modified_base (221)..(221): a, c, t, g, unknown or other
  misc_feature (221)..(221): n is a, c, g, or t
  modified_base (234)..(234): a, c, t, g, unknown or other
  misc_feature (234)..(234): n is a, c, g, or t
  modified_base (503)..(503): a, c, t, g, unknown or other
  misc_feature (503)..(503): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcactggaaccaanattggacgttggngtattataactttgtctcctggtaccaacaacacccaggcaaagcccccaaatcatcatttatgaagtctctaagcgccctcagggtatctaatcgtcttctctggctccaagtctggcaacgacggcctccctgaccgtctctcggcctccagctgaggcgaggctgtattattactcgcctacgtacataatagaagttagtacctacgtccttggttcggtttcggcggagggaccagcgtgaccgtcgtagtcacgcccgagtcncgtccccctcgtaccacctctcgttaccccc

SEQ ID NO: 26499 - DNA, 635 bp, Homo sapiens
  misc_feature: GYAE6OF01ENA9Q.16.1.A01.1.454.CMB.1.raw
  modified_base (261)..(261): a, c, t, g, unknown or other
  misc_feature (261)..(261): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaagggcctggagtggattgggtacatctattacactgggancacctactacaacccgtccctgaagagtcgagctaccatattagttgacccgtctaggaaccaattctccctgaacgatgacctttgtgactgccgcggacacggccgtctactactgtgcgaggaggtggagtcgggagggtcttttggattttcgtgggggaccgaagggaccgagtggtcacccggttctcgttcacgccctccacccgtaacgggccctacgtccggttcccttcccccgtcggccctaccccgtccctacccgaacgaccgcctaccctccggtcggggccaccgacggcccggcccgtcgggcctcggcctcgggtaccaaacggtacctaccgttacccgtaggtacgtacgtacgg

SEQ ID NO: 26500 - DNA, 634 bp, Homo sapiens
  misc_feature: GYAE6OF01EYRSM.16.1.A01.1.454.CMB.1.raw
  modified_base (260)..(260): a, c, t, g, unknown or other
  misc_feature (260)..(260): n is a, c, g, or t
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
  modified_base (416)..(416): a, c, t, g, unknown or other
  misc_feature (416)..(416): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaaggcctggagtggattgggacatctattacacgtgggancactactacaacccgtcctagaagagtcgagctaccatattagtcgaccgtntaggaaccaattctccctgaagtntgtacctttgtgactgccgcggacaccggcctctactactgtgcgaggaggtggagtcgggagggttctttgatttcggnggggaccaagggactaggtggtccaccgttctcttcgacgccctcaaccgaacggcccacgttccggttaccccttccccgtcggcccctaccccgtccctacccgaacgaccgtcctacccgtcggtcggggacctaccgacggcccggtcccgtcgggtcctcggtccgtcggtacgaacggtaccttaccgttaccgtaggttacgtcgtaacgg

SEQ ID NO: 26501 - DNA, 902 bp, Homo sapiens
  misc_feature: GYAE6OF01D7JWB.16.1.A01.1.454.CMB.1.raw
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
tcagtgtactactccacgaccggtgctcgatttagacgtctcatcagggtgtccttgggttttgggggaagaggaagactgacggtcccccaggagttcaggagtcgggcccaggactggtgaggccttcagagaccctctccctcacctgcgcggtctctggtgactccatgaacagtggtcggtacctacgtggagctggactccgccagcagccgaggggaacggcctggagtggattgggtacatcgtattacacgtgggancacctactaccaacccgtcctagaagngtcgagcctaccattagttagttcgacccgtataacggaacctaagtttcctacccgtaggaacgtactttcggtaacccgtttttggacgtaccgttcggacccggtacgggaaccgtacccgggtccgttacctaacgttaacggtcggttacggacggtaaggggtacgggttggaacgggttcgggggtaagggtttccttttttacgggtaacgtttttccgggacgggggtaccggtaaaggggtaccgtaacggggttcgggttaccgtaacccggtttccgttacgttaccgtaccggtaccccttacccgaaacccggtaacccggggtacccctaaccggtttccccggttaccccgtttccccccgggtacgggtaccccctaacccccgttacccgtaacccgtaaacggtaccggtacccgtacccggttaccgggtacggggggtacccaaaccgggtaccgggtacccgggtacccccgggttcggggtacccgttacccgggtccccgggttacgggtaacccggaaaccgggttacccgtttacccgggttaacccggttaacgggttaaaccgtaacccggttaacccggg

SEQ ID NO: 26502 - DNA, 724 bp, Homo sapiens
  misc_feature: GYAE6OF01BN801.16.1.A01.1.454.CMB.1.raw
  modified_base (233)..(233): a, c, t, g, unknown or other
  misc_feature (233)..(233): n is a, c, g, or t
  modified_base (293)..(293): a, c, t, g, unknown or other
  misc_feature (293)..(293): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctacactggaaccaacattgacgttggtnattatactttgtctctgtaccaacaacaccaggacaaacgcccccaaactcatcatttangtaagtctactaagcggccctcgagggtatctaatcgcttctctgctcaagtctggacaacacgccctccctgacccgtctctcggccctacacgtactggacggacggacggtcgtagtaatttaacgtttacctacgtaccctacctactaacttaagtaacggtaaacgtttacgttaaaccttacccgtttaccgtttaggggtttttccggggtttttacccggggacggggttaacggggaaaccctaaacgggtcccgttaaccggtaacccccgggtttacccggtttaccggggtaaccgtaaccgggtaccccccggtaaacggggtccccgttacccccgggtccccccccggtttaccgggttaccccttaaccccggtttcccgttttacccccgggttccccccgttacccccccgg

SEQ ID NO: 26503 - DNA, 800 bp, Homo sapiens
  misc_feature: GYAE6OF01DMVC3.16.1.A01.1.454.CMB.1.raw
  modified_base (231)..(231): a, c, t, g, unknown or other
  misc_feature (231)..(231): n is a, c, g, or t
tcagtgtactactccacgaccggtgctcgatttagacgtctcatcaggggggtctcaggaggcagcgctctcaggacatctccaccatggcctgtgctctgctgctcctcaccctctcactcagggcacagggtcctgggcccagtctgccctgactcagcctgcctcgtgtctgggtctcctggacagtcgatcacatctcctgcactggaaccaacattgacgttggtntattaattaactttgtctctaggtaccaaacaacaccaggacaaacgaccccaaactcatactattatagagtctactaagcggccctacgaggggtactacgtaatcgtacttctcgtcggtactaccgtaacgttactcgggaccaaccgaccggtccccttacccgtcgtaacccggttccttaccgtccgggtaccccttacccgaagtaaccgttacgggaaacgggtaccggtaaacgggtaccgttagggttaactttttaacgtttaaaccgttccggtaaccccttaacctttaccctaaagtttaaacgttaaaggttaaaacgttaacggttaaccctttaaccgtttcccgttttacgggttttaccgggggtttttttaccgggggaccggggtaacggggtaaaccccgtaacggtacccggttacgggtaacccccggttaccggttaaacggggtacccggtaaacggtacccccggtaaacgggtacccgttaccccggtacccccccggttaccgggttacccctaacccgtttcccgtttaaccccccgg

SEQ ID NO: 26504 - DNA, 713 bp, Homo sapiens
  misc_feature: GYAE6OF01C9ASE.16.1.A01.1.454.CMB.1.raw
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagacccctctccctcacctgcgcggtctctgtgactccatgaacagtggtggtacctacgtggagctggatccgcagcagccagggaggcctggagtggattgggtacatctattacactgggancacctactaccaacccgtccctagaagngtcgagctaccatattagttcgacccgtntaggaaccaattctccgtgaagatgtaccgtttgcgtactcgccgcggacaccggtcctctactacgtgtgcgaggagggtggaggtcgggagggttcttttagagttttcggacggggaccgaagggactaggtcggtcgtacccgtctcttcacgtccctaccgacccgacggcccctagttcccggttccccgttcccccgtcggacccctaccccttaccccgtacccgaacgaccgtcccgtaacccgttccgggtcggggggaccaccggaccgggtcccgggtaccccggtcggggtacccgttcgggtccccggttacgggtacccggtaaaccgggttacccgtttaacccgttacccggtaacggttaaccggtaacccgtaccggg

SEQ ID NO: 26505 - DNA, 437 bp, Homo sapiens
  misc_feature: GYAE6OF01BENTW.16.1.A01.1.454.CMB.1.raw
  modified_base (412)..(437): a, c, t, g, unknown or other
  misc_feature (412)..(437): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggtcttttgatttcgtggggccaagggcagtggtcaccgtctcttcagcctccaccaagggcccatcggtcttcccctggcaccctcctccaagcgcacctctgggggcacgagcggccctgggctgcctggtcaaggtctactccgagtagtacactgagcggctgggcgaaggcgcagtagnnnnnnnnnnnnnnnnnnnnnnnnnn

SEQ ID NO: 26506 - DNA, 661 bp, Homo sapiens
  misc_feature: GYAE6OF01EVF4O.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccaacattgacgttggtagtattaattaactttgtccttccgtacggtaaccaacaacaccaggacaaacgacccccaaactcaactctatttatagtaacgtctactaacgccggtccctcgtaggggtatactaagtcgtcttctctggctacgaagtctggaccaacgaccggtaccctcccgtacgtaccgtctcgtcgccctccgaacgtactcggaaggacggacggcttagtaatttagttacctacgtccgtactaccgtaattacgtaagtaacgttagttaacgttaccttacgttggttcggggttttacggacgggtacgggaacctaaaggtccgtacgggtacccgttaccggtacgtaccgacggtacccggaacggtccttacccggtacccccgttcggtaccttacccttcccgtacggttccccccgg

SEQ ID NO: 26507 - DNA, 618 bp, Homo sapiens
  misc_feature: GYAE6OF01A6ES8.16.1.A01.1.454.CMB.1.raw
  modified_base (261)..(261): a, c, t, g, unknown or other
  misc_feature (261)..(261): n is a, c, g, or t
  modified_base (317)..(317): a, c, t, g, unknown or other
  misc_feature (317)..(317): n is a, c, g, or t
  modified_base (388)..(388): a, c, t, g, unknown or other
  misc_feature (388)..(388): n is a, c, g, or t
  modified_base (418)..(418): a, c, t, g, unknown or other
  misc_feature (418)..(418): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaagggcctggagtggattgggtacatctattacactgggancacctactacaacccgtccctgaagagtcgagctaccatattagttcgaccccgtntaggaaccaattctccctgaagatgacctttgtgactgccgcggacacggccgtctactactgtgcgaggnggtggagtcggagggtcttttgattttcgnggggccaagggacagtggtcaccgtctcttcagccctccaccacgggcccatcggtccttcccccgtcggccacccctcctaccaacgacgccaccgtcgtcggggcacgacggccgggtcccgtcgggtcctcggtcccgttcgggtaccgtaaacgggtacccttacgttacccggacgttacggttaccgtaaccgg

SEQ ID NO: 26508 - DNA, 602 bp, Homo sapiens
  misc_feature: GYAE6OF01CFNLP.16.1.A01.1.454.CMB.1.raw
  modified_base (259)..(259): a, c, t, g, unknown or other
  misc_feature (259)..(259): n is a, c, g, or t
  modified_base (308)..(308): a, c, t, g, unknown or other
  misc_feature (308)..(308): n is a, c, g, or t
  modified_base (407)..(407): a, c, t, g, unknown or other
  misc_feature (407)..(407): n is a, c, g, or t
  modified_base (436)..(436): a, c, t, g, unknown or other
  misc_feature (436)..(436): n is a, c, g, or t
tcagtgtactactccacgaccggtgctcgatttagacgtctcatcagggtgtccttgggttttggggggaagaggaagactgacggtcccccaggagttcaggagtcgggcccaggactggtgaggccttcagagaccctctccctcacctgcgcggtctctggtgactccatgaacagtggtggtacctactggagctggatccgccagcagccagggaaggcctggagtggattgggtacatctattacactgggancactactacaaccgtcctgaagagtcgagctaccatatagttgaccgtntaggaaccaattctccctgaagatgacctttgtgactgccgcggacacggccgtctactactgtgcgaggaggtggagtcggagggcttttgatttcgnggggccaagggacaggtggtcaccgtctnttcagcctccacaacggccatcggtcctcccctggcctacccgtcctaccaagcgaccaccgttcgtgggggcctacgacggccggtccccgtcggggcctcggtcccgtgggttaccgaaacgggtaccttaccgttcccggtaaacgttaggtaccgtaaccgg

SEQ ID NO: 26509 - DNA, 717 bp, Homo sapiens
  misc_feature: GYAE6OF01BPT76.16.1.A01.1.454.CMB.1.raw
  modified_base (188)..(188): a, c, t, g, unknown or other
  misc_feature (188)..(188): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctcgtgtctgggtctcctggacngtcgatcaccatctcctacactacgaaccaactattgacgttggtagtattataactttgtctcgtaggtaccaacaacaccgagacaaacgaccccaaactcatactatttatagtaacgtctacgtaacggccgtacctacggtagggttactactaactccgtcttcgtcgtcggtcctacgtaacgtcgtacggaccctaaaccgtaccggtccccttacccgtacggtaccccgttccgtccgtccggtcccttaccgaacgtaccgttacgggaaccgggtacggacggtacgtttaggtaacttttaaccgttacgttaccgtaccctaaccgttactaattaacgtaagttaaacgttaacttaaccgttaaccgtttcgttacgggtttcgggttttaccgggacgggtacggaacgaacggtccgtacgtaccgttaccgtacggtaccaccggaccgtaccggccttcccggaccccgttcggtaccctaccgtttccgttcccgtcccccgtacccg

SEQ ID NO: 26510 - DNA, 582 bp, Homo sapiens
  misc_feature: GYAE6OF01AHJGS.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaaccaacattgacgttggtgtatttataactttgtctcctggtaccaacaacacccaggcaaacgcccccaaactcatctatttatgatctctaagcggccctcgagggtatctaatcgtacttctctcggctccagtctcggacaacgaccggtccctcccgtgtacccgtctccgtcgcctccagactgacggacgaggctagtattacttactcgcctactctaatataagtaacgtaacgttaactaccttccgttaggtttcggtttacgggacggacggaccgtaagcgtacgacccgttcgtacggtacacgccgaacgtcctaccgcccccgttgtaccctctccgttcgttaccccccg

SEQ ID NO: 26511 - DNA, 761 bp, Homo sapiens
  misc_feature: GYAE6OF01DTZRB.16.1.A01.1.454.CMB.1.raw
tcagtgtactactccacgaccggtgctcgatttagacgtctcatcaggggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggacagtcgatcaccatctcctgcacgtacggaaaccaactagtttcggacggtttgggtagtaatttaacttaaactttttcgtccgttccttacgggtaaacccaaaccaaaacccaaccccgaagggaaccaaaacccgacccccctaaaacctcctaacttcctaattttagtagtaaacgttacctacgtaacgccggtccctacggtaacggggttatacctaagtccgtctttactccgtggtacctaccgtaaggttcgtaggtaccaaaccgtacccggtccccttacccgtcggtacccgttccgtccgttccgggcccttaccgacgtaacgtacggacgggtacggacggtcgtagtactttaacttctcgacctacgtactaacttaagtaagtaacgttaacgttaaccttacttaccggtttgggtttgggttttcccggggagggtacgggtaaccgtaggtaccgtacggtacccggtccggtacggttacgaccgggtcccgaacggtcccgtcccgtccccgtcggtcctacccgttccgtcccggttacccccc

SEQ ID NO: 26512 - DNA, 624 bp, Homo sapiens
  misc_feature: GYAE6OF01DEF0S.16.1.A01.1.454.CMB.1.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacgagggtcctgggcccagtctgccctgactcagcctgcctcgtgtctgggtctctggacagtcgatcaccatctcctgcactaggaaccaactattgtacgttggagtatttataactttgtctcctgtaccaacaacaccaggacaacgaccccaaancatactattangaagtctactacgcgcctagagggtatactaatcgtcttctcgtggcctacgaagtcgtacggacaaccgacccgtccctcccgtcggtaccgttcctcgtccggccctaccgacgtacgtcgggaacggacggagtctagttactttacttacctcgtaccagtacaagttagtaagtaacgtaactacttaaccgttcgttggttcggtttacgggacggtacggaccgaacgtccgacgtaccgtaccgtggtacccgaacggcccgtaacggtcctacccggtaccccctacggtcctaacccgtcgttccccgtacccccg

SEQ ID NO: 26513 - DNA, 683 bp, Homo sapiens
  misc_feature: GYAE6OF01EWN0O.16.1.A01.1.454.CMB.1.raw
  modified_base (234)..(234): a, c, t, g, unknown or other
  misc_feature (234)..(234): n is a, c, g, or t
  modified_base (297)..(297): a, c, t, g, unknown or other
  misc_feature (297)..(297): n is a, c, g, or t
tcagtgtactactccacgaccggtgctcgatttagacgtctcatcagggggtctcaggaggcagcgctctcaggacatctccaccatggcctgggctctgctgctcctcaccctcctcactcgagggcacagggtcctgggcccagtctgccctgactcagcctgcctcgtgtctgggtctcctggacagtcgatcaccatcctctgcacgtacgaaccatagttgacgttggngtaattactaactttgctcctggtaaccaacaccaccagacaaaccgccccaatcatctattnagtactctacgtacgcggtacctcgtacgggttatactaatcgtcttctcgtgtactacgtaagtcgtgaccaacgtaccggtccctccgtaccggacctcctcgtaccgcctaccgagtcctaggtacgggcgtacggtccgtagttacgtttaacttaccggtacgtaccacgttacgtaattaacggtaacgtaacggttaacgttaaccttaccgtttaccggttgggtttacgggttttcgggaaccgggtacgggtaacctaacgggtccgttaccgggtacccggttacgtaacggcctaaacccggtcccggtacggtccccgtaccccggttccccccgtagggtaccccgttaccttcccgttcccggtacccccc

SEQ ID NO: 26514 - DNA, 605 bp, Homo sapiens
  misc_feature: GYAE6OF01E2QSZ.16.1.A01.1.454.CMB.1.raw
  modified_base (329)..(329): a, c, t, g, unknown or other
  misc_feature (329)..(329): n is a, c, g, or t
  modified_base (404)..(404): a, c, t, g, unknown or other
  misc_feature (404)..(404): n is a, c, g, or t
  modified_base (437)..(437): a, c, t, g, unknown or other
  misc_feature (437)..(437): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtcgtggtctccgtggacagtcgatcaccatcctcctgcacgtacggaaccaactattggacggtttgggtacgtatttaattaaccttttgtccttccgttaggtaacccaaacaaccacccgaggaccaaaccgacccccaaactcatctatttanagtaactctactaacgccgcctgagggtatactagtcgtcttctcgtgctacagtctgacaacgccgtcctccgngtccgtctcgtcgcctcagtcgtggacggacgngtctgtattactactcgccactcaatagtaagtaagtcgtaactcgttcgttagggttcggtttccgggacggtacggaccgtacgcgtacggaccgttaccgtacggcgaccggtcccgacggtcctcccggtcccctcgtaccctccttccgtcccgttacccccg

SEQ ID NO: 26515 - DNA, 1028 bp, Homo sapiens
  misc_feature: GYAE6OF01B3UTD.16.1.A01.1.454.CMB.1.raw
tcagtgtactactccacgaccggtgctcgatttagacgtctcatcagggtgtccttgggttttggggggaagaggaagactgacggtccccccaggagttcagggaggtccgggcccaggactgggtgacggtccttcagacgacccttcctccctcaccgtgccgcggttctcgtggtcgacctccatacgaacgtaggttgggtacggtacctacgtggacgtcgtaggacctcccgcacgcacgaccggaaggggacgccgtaggtaggtggtagttggtacattctaacttaccgacggtagggactcctaaccctactaaccctaccccgttcccgaagaaggacgttacgaccgtacctaacctatttacgtttaggtccggtaaccccgttacgtaaccgggaaaccttaacctttcccgtcccgtaaggtaaacgtacgttaccgtttaacccgtttttggtaccgtaccgttcccgggcccggtaaccgggaacccggtaccccgggtaccgtttacttaacccgttaccggtttgggacccgggtacggggtaagggttaacgggggtgggtaaccgggggtacggggtacgggttttactttttaggtaccggtttttcggggaaccgggggtaaccggtaaacggggttaccgtaggggttacccggtacccgttaaccccggttctttacccgttacgtaccccgtacccccggtttaacccaaaccccgggtaaccgggtaccccccttagggtttccccccggtttacccccgtttaccccccgtaacggtaccccccgttaacccccgttcccccggtaaacccgtaaaacccggtccggttaaccccctaaccgggttcccggggtaacgggggacccctaaccggtaacccgggccccgggtccccgggttaaccggggcccttaccgggtccccggtacggttaacggaaaccggttttaccccgttaccgttaccgggtaaccggttttaaccgaccggttaaccggg

SEQ ID NO: 26516 - DNA, 847 bp, Homo sapiens
  misc_feature: GYAE6OF01BX7R9.16.1.A01.1.454.CMB.1.raw
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtgtacctactggagctggatccgccagcagccagggaggcctggagtggattgggacatctattacacgtgggagcacctactaccaacccgtcctgaagagtcgagctaccatattagttcgacccgtctacggaaccaatttcctaccctgaagatagtaccttttgtacgactggcccggacggtacgaccgggtccgttactaacgttacgtggtcgcggaagggcgggtgggaggttccggggtagggttcttttttaggacgtttttcgggtacggggggtaccgtaaacgggggtacgtaggggttcgggttaccgtaccccggtttccgttccgtttaccgaaccggttccccttacccggaaacccggtaaaccggggtccccctaacggtttcccgggtttcccctttcccccccggtcgggtacccctacccccgttcccgttaacccgtaaacggaccgtacccgtaacccgttcccgggttacggggggacccaaccgggtaccggggccccgggtccccgggttcgggggtaccccgttaccggggtccccggtttaccggggttaacccggtaaaccggggttacccgtttaacccggtttaacccggggtaaacggtttaaaccgggttaacccggttaaacccgggg

SEQ ID NO: 26517 - DNA, 433 bp, Homo sapiens
  misc_feature: GYAE6OF01EEC37.16.1.A01.1.454.CMB.1.raw
  modified_base (245)..(245): a, c, t, g, unknown or other
  misc_feature (245)..(245): n is a, c, g, or t
  modified_base (273)..(273): a, c, t, g, unknown or other
  misc_feature (273)..(273): n is a, c, g, or t
  modified_base (321)..(321): a, c, t, g, unknown or other
  misc_feature (321)..(321): n is a, c, g, or t
  modified_base (385)..(385): a, c, t, g, unknown or other
  misc_feature (385)..(385): n is a, c, g, or t
  modified_base (415)..(433): a, c, t, g, unknown or other
  misc_feature (415)..(433): n is a, c, g, or t
tcagtgtactactccacgaccggtgctcgatttagacgtctcatcagggaagggcctggagtggattgggtacatctattacactgggagcacctactaccaaccccgtccctgaagagtcgagctaccatattagttgacccgtctaggaaccaattctccctgaagatgacctttgtgactgccgcggacacggcctctactactgtgcgaggaggtggagtcggaggtctttttgatttcgngggccaagggcagtgcaccgtctctcancctccaccaggcccatccgtccttcccctggccaccctcctccaaganccacctcgtggggcacgagccggccctgggctgccgtggtcaaggacctactcgagtacgtacncgtgacgcggctcggcgaaggcgacatagnnnnnnnnnnnnnnnnnnn

SEQ ID NO: 26518 - DNA, 934 bp, Homo sapiens
  misc_feature: GYAE6OF01CV9QV.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctctcactcagggcacgagggtcctgggcccagtctgccctgactcagcctgcctccgtgtctggtctcctggacagtcgatcaccatctcctgcacgtacggaacctaacagttgacgtttggtagtaatttaacttaacgttttgtccttccgttacggttaacccaaaccaaccaacccacggaccaaaaccgacccccaaactaccatacctattttactagaacgtcttacctaaacggtccggtccctacgaacggggttacttacgtaaacttccggtctttccttcgttcgggaccttaccgtaaacggttccgtacgggtacctaaaccgtacccgggtaccccctttccccgtaccggtaaccccgtttcccgttaccgttccgggtacccccgttacccgtaaccgggtaaccgttacgggaaacggggtacccggaacgggtaccgttagggtaacttttaactttaaccgttaccggtacccctaaccttacctaaacgtttaaccgttaaaggtaaacggttttaaaccgttaaccgtttaaccccgttttacccgggttacgggttttcggggttttttaacccgggggaccggggtaacggggtaaaccccggttaaacgggtacccttaccggggttaaacccccggttacccggtttaaaccggggttaccccgtaacccgggttaaacccccggtaaccgggggttaccccttacccccggggttaccccccccggttaccgggttacccccgtttaaccccgtttccccggttttcccccgggttttaaccccccccccggg

SEQ ID NO: 26519 - DNA, 671 bp, Homo sapiens
  misc_feature: GYAE6OF01B4KY0.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcgagggcacgacgggtcctgggcccagtctcgccctgactcacgcctgcctccgtgtcgtgggtctcgtggacagtcgatccacatcctactgcacgtacggaaccctaatagttggtacgttggtatatttaacttaccgtttgttccttccgtacgtaacccaacaaccacccgaacggaaccaaaccgaccccaaactctactacgtatttacgtagtagtactacgtaacgtccgtaccgttacggtacgggtttacttaagtccgttcgttctcgtacgtcctaccgtaagttcgtacggacctaaccgtaccgtccctccgtacgacctactcgtcgcggtcctacggcgtacgtagggacgggtaacgtagggttagtaactttacgtacgtagactacgtacttaagaattaaggtacggtaagtcgaaccacgtacctcgttcgttacggtacgtcgggacggtacggtaaccgacgttcgacgtaccgtcgtaagccgtacgaccgacgtccctccggacccgtcgtcccgtcgttcccg

SEQ ID NO: 26520 - DNA, 657 bp, Homo sapiens
  misc_feature: GYAE6OF01C9MIN.16.1.A01.1.454.CMB.1.raw
  modified_base (242)..(242): a, c, t, g, unknown or other
  misc_feature (242)..(242): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatccacctatcctcctgcaacgtcgaaaccaacattgacggttggtanatttataactttgtctcctggtaaccaacaaccacccaggacaaacgaccccaactcatactatttatagtaagtctactaaggccggtccctagacgggtatctaatcgtcttctcgtggtcctacctaacgtcgtgacaaccgaccgtccctacccgtcgtacccgttctccgtcggacccttcccagtaccgtaggaacgggacgaggtcgtacggtactttacttactcgaccctactacgtaataagtaagtaagttaacgtaccttacgttccgttggttcgggtttcggacggggtacggtaccaacggtcctaccgggtaccgttccggtacggttaccgacggtcccgaacggtcccttacccggcccccgttacggttcctaccttcccgttccgttaccccccg

SEQ ID NO: 26521 - DNA, 711 bp, Homo sapiens
  misc_feature: GYAE6OF01EVKF3.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacgagggtcctgggcccagtctgccctgactcagcctgcctccgtgtctgggtctcctggacagtcgatcatcatcttctgcactggatccagcagtgtacgttggtagttataattatgtctcctggtaccaacacgtaccagaccaaacgcccccaaactcatacgtatttagtagtaggtacagttaactccggcccttacggtacggggtttactaagtcgtacttctcgtcggcctaccgaacgttccgtggaccaaaccgaccggtcccttacccctcgtaaccctacttcccgttccgtaccgggcctacccgacgggtcgtacgggacgggacgggtaagggtgttaatttacgtttaacgtcgtaccgtacggtaccttaacctaagttaagtaaggtaacggtcggacctacgggcctaaccggttccgttacggttaacggtttccgggaccggggttaggggaacccgtaagggtacccgttaccgggtaccccggtttaccggttaacgggtacccgtaaccgggtacccccgaaacgggtccccgttccccggtccccccggttaccggg

SEQ ID NO: 26522 - DNA, 725 bp, Homo sapiens
  misc_feature: GYAE6OF01AM6KH.16.1.A01.1.454.CMB.1.raw
  modified_base (221)..(221): a, c, t, g, unknown or other
  misc_feature (221)..(221): n is a, c, g, or t
  modified_base (299)..(299): a, c, t, g, unknown or other
  misc_feature (299)..(299): n is a, c, g, or t
tcagtgtactactccacgaccggtgctcgatttagacgtctcatcagggggtctcaggaggcagcgctctcaggacatctctaccatggcctgggctctgctgctcctcaccctcctcactcagggcacagggtcctgggcccagtctgccctgactcagcctgcctccgtgtctgggtctcctggacagtcgatcaccatctcctgcactggaaccaacnttgacgttggtgatttataactttgtctctacggtaccaacaacaccacgacaaacgcccccaaactcatctatttanagaacgtctctaacgccggccctacgagggttactactaactcgtctttctcgtcggcctaccgaagtccgtacggaccaaccgaccgggtcccttccccgtacggtaccccgtttccttccgttccgggtccccttacccgaacggtaccgtacgggaacgggtaccgagggtccttaagttaactttaactttaccgtcgaccctaacttactaattagtaaccgtaagttaacgttaaccttacgttcccgttaggtttacgggttttaccgggacgggtacgggtaaccgaacggtccgttaccgggtaacccgttaccgtaccgggtaccctaaccgggacccgaaacggggtccccttacccgggtacccccccggttcggttaccctaacccgtttccgttccccgtttaccccccccg

SEQ ID NO: 26523 - DNA, 848 bp, Homo sapiens
  misc_feature: GYAE6OF01DVJTD.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcgagggcacgagggtcctgggcccagtctgccctgactcagcctgcctccgtgtctgggtctccgtggacagtcgatcacctatcctcctgctacgtacggaaaccctaatagttcgtacggttggtagtaattttaacttaaccttttggtaccttccgtacggttaaacccaaaacctaaacccaacccgacggaaccaaaacccgacccccctaaaactcctaacttaccttaattttaacgtaacgtaacgttccttaccgtaacggcccggaccctacggtacgggttacttacgtaatccgtcttccgtacgtcggtcctactaacgtcgtacggactaaccgaccggtacccctcccgtacgtacccgttcctccgttccgccctccgaacgacgtacggaacggtacggaggtccttaggttaactttacgtttaccgtcgtaccctacttactaacgttaagttaagtaaacggttaacgttaacccgttaaccgtttcccggtttagggttttaccgggttttaccggggaccgggttaaccggggtaacccgtaacgggtacccgttaccgggtaaccccggttacccggttaacgggtaccccgaaaccccgggtaaccccgtaaacccgggttccccggtcccccggttaccccccgggttaccggttaccccttacccggtttcccccgttaccccggtttaaccccccccgg

SEQ ID NO: 26524 - DNA, 818 bp, Homo sapiens
  misc_feature: GYAE6OF01BLPEF.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcgagggcacgagggtcctgggcccagtctcgccctgactcacgcctgccctccgtgtcgtgggtcctccgtggacagtcgatccacctattcctcctgacctaacgtacggaaaaccctaactagttcggtacggtttggtagttaacttttaacttaaccgttttcgttaccttcccgttacggttaaacccaaaaccaaaccaaccccgaacggaccaaaaccgacccccaaactaccaacttactaatttatacgaactccgtacgtaacggccggtacccgtacggtaacgggttactacgttaacgtccggttccttccgtcgtcggtacctaccgaacggtcgtacggaacctaaccggacccggtcccgtcccgtacgtacccgtcgttccgtccggtaccctaccgacgtaccgtacggaacgggacggtacggtactacgtagtttacttacgtccgtaccctactactaaagttaacgtaaacgttaacgttacgttaacccgttacgtttccggtttacgggtttacggggtttacggggaaccggggtacgggtaacccggaacggttcccggttaccggtacccggtttaccggtacgggtacccacccgggtacccgaccggttcccgttccccggtacccccgttacggtaccctcccgttccggttcccccgtaccccccg

SEQ ID NO: 26525 - DNA, 608 bp, Homo sapiens
  misc_feature: GYAE6OF01CZ0X3.16.1.A01.1.454.CMB.1.raw
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (353)..(353): a, c, t, g, unknown or other
  misc_feature (353)..(353): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (457)..(457): a, c, t, g, unknown or other
  misc_feature (457)..(457): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
tcagtgtactactccacgaccggtgctcgatttagacgtctcatcagggtgtccttgggttttggggggaagaggaagactgacggtcccccaggagttcaggagtcgggcccaggactggtgaggccttcagagacccctctccctcacctgcgcggtcctctggtgactccatgaacagtggtacggtacctactggagctggactccgccagcagccagggaggcctggagtggattgggtacatcgtattacncgtgggaancaccctactaccaacccgtccctaggaacgagtacgacgcctaaccatacgttagttcgaccgtctagaacctaatcctcctagaantgtaccttgtcgactgcccgcggacncggccgtctactagtgngcgaaggngtaggagtggaggtctttgattcgngggcaaggacngtgtcnctcgtctcgcncctcaccgacgccngtcgtcctcccgcgccnccctccgtcacgcgctaccgtcggacggggctaccggacggtccggacccgtcgggtactccggtccgtcgggtaaccaacgggtaccttaccgtaccggtaagttccggtaatacccgg

SEQ ID NO: 26526 - DNA, 747 bp, Homo sapiens
  misc_feature: GYAE6OF01A326O.16.1.A01.1.454.CMB.1.raw
  modified_base (189)..(189): a, c, t, g, unknown or other
  misc_feature (189)..(189): n is a, c, g, or t
tcagtgtactactccacgaccggtgctcgatttagacgtctcatcagggggtctcaggaggcagcgctctcaggacatctccaccatggcctggctctgctgctcctcaccctcctcactcagggcacgagggtcctgggcccagtctcgccctgactcagcctgcctcgtgtcgtggtctcgtggacngtcgatcacctatctcctgcctactagaaaccatagttcgtacgttggtagtaattattaacgtttcgttctcgtacgtaaccaacaaccacccaggaccaaccgaccccaactcatactattactagtacgtctactaacggccggtccgtacggagggtactacgtaactcgtccttctcgtcgtcctacgtacgtcgtacgacacgaccgtcctccgtcgtaccgtctcgtccgtcctaccgacgtacgtacggacggtacggaggtctagttactttactaccgttcaccgtactacgtaagttacgtaaacggttaagttaacgtttaaccgttaccgtttaccggtttcgggttttacggggtttaccggggtaccgggtaaccggtaacggtaaccggttcccgttaaccggtaaccccggttaccgttaccgggttcccgtaacccggtaccccggtaaacgggttcccccgttaccccgggtaccccccggtttacccggttaccccgtaccccggtttccccggtttccccccggtttacccccccgg

SEQ ID NO: 26527 - DNA, 698 bp, Homo sapiens
  misc_feature: GYAE6OF01DKH3D.16.1.A01.1.454.CMB.1.raw
  modified_base (113)..(113): a, c, t, g, unknown or other
  misc_feature (113)..(113): n is a, c, g, or t
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
  modified_base (328)..(328): a, c, t, g, unknown or other
  misc_feature (328)..(328): n is a, c, g, or t
tcagtgtactactccacgaccggtgctcgatttagacgtctcatcagggggtctcaggaggcagcgctctcaggacatcctccaccatggcctgggctctgctgcctcctccnccctcctcactcgagggcacgaggtccgtcgggccctagtctcgccctgactcgagtcctcgtcccttccgtgtcgtgggttcctccgtaggacagtcgactccaacctntcctcctagcacgtacgaaccactgttgtacggttgtatatttatacgtttntcctctacgtaaccaacaccaccagaccaaccgaccccaatctatactattanagtacgtctacgtacgccgtacccgtaggtacggtacttactactcgtcctttcgtcgtacgtcctactacgtcgacgtacccaaccgtacccgtccctaccgtccgtaccgttcgtaccgtccgcctacacggtaaccgtgggaacggagtcgtagtacttatttacctacgctactacgtcaagttagtaagtacttaacgttaccttacgtttcggtttacgggtttccggggtttacggaccgggtaacggtaccgtaacggtccgttaaccgggtccgttaccgtaacggttccgaaccggtcccgtacggtcccctacccgggtcccgttcggtaacccttcgtcccgttccccgttaccccgg

SEQ ID NO: 26528 - DNA, 748 bp, Homo sapiens
  misc_feature: GYAE6OF01A0IM4.16.1.A01.1.454.CMB.1.raw
  modified_base (265)..(265): a, c, t, g, unknown or other
  misc_feature (265)..(265): n is a, c, g, or t
  modified_base (360)..(360): a, c, t, g, unknown or other
  misc_feature (360)..(360): n is a, c, g, or t
tcagtgtactactccacgaccggtgctcgatttagacgtctcatcagggtgtccttggggttttgggggggaagaggaagactgacggtccccccaggagttcaggagtcgggcccaggactggtgaggccttcagagaccctctccctcacctgcggcggtctctggtgactccatgaacagtggtggtacctacgtggagctggatccgcagcagccgagggaggcctgggagtggattgggtacatctattacacgtgggancacctactaccgaacccgtcctagaagagtcgagctaccatattagttcgaccctctaggaacctaattcctcctagaagctcgtaccgttttgngtactgtcccgcggtaccaccggccgttctaactactcggtgcggtaggtagggtggacggttcgggagggttcgttttaggacgtttttcgggacgggggtacccgaaggggtacgtagggtcggtaccgtacccggttcttccgttcctacggtaccccgttacccaacccggtaaccgggcccctaacgttccccgggttccctttccccccggtacggtccccctaccccgttcccgtacccgtaaacgaccgtaccctacccgtacggtccggggccctaacggaccggccccgggtcccggtcgggaccgtccggtcccggtacggtaccggtaacggtacccttaaccggtttaccgtacggttacggttaccgtaccggg

SEQ ID NO: 26529 - DNA, 934 bp, Homo sapiens
  misc_feature: GYAE6OF01BWG81.16.1.A01.1.454.CMB.1.raw
  modified_base (192)..(192): a, c, t, g, unknown or other
  misc_feature (192)..(192): n is a, c, g, or t
tcagtgtactactccacgaccggtgctcgatttagacgtctcatcaggggggtctcaggaggcagcgctctcaggacatctccaccatggcctgggctctgctgctcctccaccctcctcactcgagggcacgagggtccgtcgggcccagtcctgccctgactcacgcctgcctcgtgtctgggtcctcgngacagtcgactcacactcctcctgactacgtacggaaacccaatattcggtaacggtttgggtattaatttaacgttaacgttttcgttccttaccgttacggttaaacccaaaccaaacccaacccgaacggaacccgtaaaacccgaccccccaaaactaccaactttacctaagttttacgtaacggtaaacgttccgttaaccgttaacgggcccggttacccggttaccgggtaacgggggttacttaaccgttaacgttccgttacctttcgttccggtaccggttacccgtttaccgtaaccggtttccggtacggtaaccgtaaacccgccccggggttacccctttacccccgttaccggtaaccccgtttcccggtttaccggtcccgggtaccccttacccggtaaccggttaccgtaacggggtaaccggggtaacgggtacggttaccggttaggttaaccgttttaccgttaacgttccgaccccgttacttacgtaagttaacgttaacggttaaggtttaaccgttaccgtttaccgtttacgggtttcgggttttacggggtttaccgggaccgggggtaaccgggtaaccaacgggttccggtaaacccgggttaccccgttaccggttacgggttacccaccgggtacccgtaaccggtccccggttacccgtcccccggttacggtacccgttacccgttcccgtttccccgttaccccccg

SEQ ID NO: 26530 - DNA, 724 bp, Homo sapiens
  misc_feature: GYAE6OF01EBVTX.16.1.A01.1.454.CMB.1.raw
  modified_base (109)..(109): a, c, t, g, unknown or other
  misc_feature (109)..(109): n is a, c, g, or t
  modified_base (279)..(279): a, c, t, g, unknown or other
  misc_feature (279)..(279): n is a, c, g, or t
  modified_base (658)..(658): a, c, t, g, unknown or other
  misc_feature (658)..(658): n is a, c, g, or t
tcagtgtactactccacgaccggtgctcgatttagacgtctcatcagggggtctcaggaggcagcgctctcaggacatctccaccatggcctgggctctgctgcctccnccaccctcctcactcgagggcacgcgggtcctcgggaccctagtcctcgccctagactcacgcctgtcccttccgtgtccgttcgggtcctccgtgggactcgtcgactccacctacttccgtaccgtgacctacgtaaccgaaacctaacttgttacggtggttaggtnttaaacttttactacgtttcgttacctaccgtaaccgtaaccaacctaaccaccgtaacggaaccaaacccgaccccaaactctaagttctaatttacgtacgtaacgttccacgtaacggcccgtaccgtacggtaagggttactacgttaacgttccgtctttcgcgtcggtacctacgtaacgtcgtacggaacctaaccggtccgtccctccgtacggtccttaccgtcgttccgcctacgacgacgaggtacgcgagtatcgttaactcgtccacgacctcgtatacgtagtacgtagtacttaccgtctcggttagggtttccggtacggacggaacgacgtacgtcggaaccgttcccggtagtcccggtanaccggtcccggaacgttcccgtaccccggtcccttcggtacctaccgtttcccgacccgttccccg

SEQ ID NO: 26531 - DNA, 720 bp, Homo sapiens
  misc_feature: GYAE6OF01EXKVQ.16.1.A01.1.454.CMB.1.raw
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggactccggccagcagccaggggaagggcctaggagtggagttgggacatctattacacgtggagcacctacctaccaaccccgtccctagaagagtcgacgctaccatattagttacgacccgtataacggaaccaacttcctaccctagaagtactcgtacctttgtgactcgccgacggaccgaccggtccgttactactacgtggttacggcggaagggtacgggtgggtagggtcgggtacgggttcttttgggtacgttttcggtacgggggtaccggaaggggtaacgtaggttacggtccgtaccgttccgttccttaccgtacgccctacccaacccggaaccggtcccgtacgttccggttcccgttccccgtcgaccctacccctaccctaccgaacgtaccgaccacccgtcggccggggacaccggaccggcccggcccggtccgggtctccggtccgtcggtaccgtaacggtaccttaccgttaccgtaacgtacgtaacgtacg

SEQ ID NO: 26532 - DNA, 740 bp, Homo sapiens
  misc_feature: GYAE6OF01B6TMR.16.1.A01.1.454.CMB.1.raw
  modified_base (199)..(199): a, c, t, g, unknown or other
  misc_feature (199)..(199): n is a, c, g, or t
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctacgtgganctggactccgaccagcagccgaggggaaggcctgggagtggattgggacagtcttatacacgtggganccactactaccaacccgtcctagaagtacgtacganctaaccattattacgttcgacccgttctaacggaacctaattccctccgtagtaagtctacgtactttgagtactcgaccgacgaccgaccggtcctacgtaccgtatcgggtgacggtagggaggtggtacggtcgggtaggtttctttaggtacgttttcggacgggggactaacggggtactagggtttcggtacccgtacccgttacgttccgttaccgaccgttcccgtaacccgaacccggaccgggacccttaccggtttccccggtaccctttcccccgaggtcccccttacccgtacccgttaccgacggtaccacccgtaccggtaccgggtcggggaccacggtaccgggcccggtaccggtcggacctcggtcccggttagaccgtaacggttacccttacgtaccggtaggttacgcgtacggg

SEQ ID NO: 26533 - DNA, 573 bp, Homo sapiens
  misc_feature: GYAE6OF01EP4K9.16.1.A01.1.454.CMB.1.raw
  modified_base (257)..(257): a, c, t, g, unknown or other
  misc_feature (257)..(257): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
  modified_base (505)..(509): a, c, t, g, unknown or other
  misc_feature (505)..(509): n is a, c, g, or t
  modified_base (511)..(511): a, c, t, g, unknown or other
  misc_feature (511)..(511): n is a, c, g, or t
  modified_base (514)..(515): a, c, t, g, unknown or other
  misc_feature (514)..(515): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (525)..(525): a, c, t, g, unknown or other
  misc_feature (525)..(525): n is a, c, g, or t
  modified_base (536)..(537): a, c, t, g, unknown or other
  misc_feature (536)..(537): n is a, c, g, or t
  modified_base (565)..(565): a, c, t, g, unknown or other
  misc_feature (565)..(565): n is a, c, g, or t
  modified_base (568)..(568): a, c, t, g, unknown or other
  misc_feature (568)..(568): n is a, c, g, or t
  modified_base (572)..(572): a, c, t, g, unknown or other
  misc_feature (572)..(572): n is a, c, g, or t
tcagtgtactactccacgaccggtgctcgatttagacgtctcatcaagggaagggcctgggagtggattgggtacatctattacactgggagcacctactacaacccgtcctgaagagtcgagcctaccatatttagttgacccgtctaggaacccaattctccctgaagactgacccttttggtgactgccgcggacacggcccgtcacttactggtgcgaggaggtggaggtcggagggtctttttgattttcgngggaccaagggacagtggtcaccggttctacttcacgcctcccgaccaacggggccctaatccggtccttccccgtggccacccctccctaccaacgacgtccacctcggtcggggacaccggagccggcccgtgggcctacgccgtggtaccgtaacggacttaccgtaccgtagttagaacgtacgcggaggtcgggcgtacggcgtaacggcgataacgtgnganctgncgnagcagtgctcngnnnnntncgnncgntngngtnacgacgcgagnngtcgtcgtacgagcgagacgactctcanacncgcnc

SEQ ID NO: 26534 - DNA, 925 bp, Homo sapiens
  misc_feature: GYAE6OF01AILRH.16.1.A01.1.454.CMB.1.raw
  modified_base (866)..(866): a, c, t, g, unknown or other
  misc_feature (866)..(866): n is a, c, g, or t
tcagtgtactactccacgaccggtgctcgatttagacgtctcatcagggtgtccgttggggttttggggggaagaggaagactgacggtcccccaggagttcaggagtcgggcccaggactggtgaggccttcagagaccctctcctcacctgcgcggtctctggtcgactcgatgaactaggttcggtcgtaaccttacgtgggacgcgtgggactcccgccagcacgccggaaggggtacggccgtaggagtgggtagttcgggtaactacgtactttaacgttaccgacgtacgggacgtaccctaaccttaaaccgtaacccgtaaacccccgttaccccgtaaggaaaccgggtaacggtaaccggtaaccgtaaccttaacccgtaatttaaagttttaccgggttacccggttaccccggttaaccgtaaccgggtaaaacccctttaaactttccccgtaacccggttaccgaaagttaccgttacccggtttacccggttttacggacgttaccggtccgggtacccggtaccgggacccggtaaccgggtccccttaccgttaaccgttaaccgtgggttaccggacggggtaagggtaccggggtgggtaacgggttacgggttacgggtttacgttttgggtacgttttcggggaccggggtaaccgtaacggggtacggttaacgggttccggtcccggttacccggttcctttaccgttaccgtaccgtacccctaaccggtacccggacccggtccgtaccggtttcccgtacccgttcccgttaccggcccctacccgtccctacgacgtacccgctaccggtacggtccgacgtcgaccgccggtccgnggtccgtcggcgttacgacgtaagtacccgttacgtacggtaacggtcgtaaccgtcgg

SEQ ID NO: 26535 - DNA, 626 bp, Homo sapiens
  misc_feature: GYAE6OF01DZL0G.16.1.A01.1.454.CMB.1.raw
  modified_base (122)..(122): a, c, t, g, unknown or other
  misc_feature (122)..(122): n is a, c, g, or t
  modified_base (167)..(167): a, c, t, g, unknown or other
  misc_feature (167)..(167): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
  modified_base (550)..(551): a, c, t, g, unknown or other
  misc_feature (550)..(551): n is a, c, g, or t
  modified_base (554)..(554): a, c, t, g, unknown or other
  misc_feature (554)..(554): n is a, c, g, or t
  modified_base (560)..(561): a, c, t, g, unknown or other
  misc_feature (560)..(561): n is a, c, g, or t
  modified_base (571)..(571): a, c, t, g, unknown or other
  misc_feature (571)..(571): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
  modified_base (588)..(589): a, c, t, g, unknown or other
  misc_feature (588)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (595)..(596): a, c, t, g, unknown or other
  misc_feature (595)..(596): n is a, c, g, or t
  modified_base (599)..(599): a, c, t, g, unknown or other
  misc_feature (599)..(599): n is a, c, g, or t
  modified_base (604)..(604): a, c, t, g, unknown or other
  misc_feature (604)..(604): n is a, c, g, or t
  modified_base (606)..(607): a, c, t, g, unknown or other
  misc_feature (606)..(607): n is a, c, g, or t
  modified_base (611)..(611): a, c, t, g, unknown or other
  misc_feature (611)..(611): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
  modified_base (619)..(620): a, c, t, g, unknown or other
  misc_feature (619)..(620): n is a, c, g, or t
  modified_base (622)..(624): a, c, t, g, unknown or other
  misc_feature (622)..(624): n is a, c, g, or t
  modified_base (626)..(626): a, c, t, g, unknown or other
  misc_feature (626)..(626): n is a, c, g, or t
tcagtgtactactccacgaccggtgctcgattttagacgtctcatcagggaagggcctggagtggattgggtacatctattacactgggagcacctactacaacccgtcctgaagagtcganctaccatattagttgacccgtctaggaaccaattctccctgaagntgaccttttgtgactgccgcggacacggcgtctactactgtgcgaggaggtggagtcgggagggtcttttgatttcgtggggccaagggacagtcggtcaccgtcttcttcgacgccctccgaaccgacgggccagtccggttccttccccgtgcccctaccccgtccctaccgaagccgacctacccgttcgggtccgggggactaaccgacccggggtccggtccccggtgggggtcccttccggtccgttacggggtaccaaaacgggttacccgttaaccgtttaccggggtaagttaacgttaacctaaccggtgggtaaccgggccgggtacggtacgggacggaaacgggccgaacgtaagtagngtcganaccgnngcngtatcnncgtacgtcgngcgtanangcgcngcgnntntngnnacntagtntnnctcngctngncnngnnngn

SEQ ID NO: 26536 - DNA, 907 bp, Homo sapiens
  misc_feature: GYAE6OF01B3D55.16.1.A01.1.454.CMB.1.raw
tcagtgtactactccacgaccggtgctcgatttagacgtctcatcagggtgtccgttgggttttggggggaagaggaagactgacggtcccccaggagttcaggagtcgggcccagggactggtagagggccttcgagacgaccctctccctcacctggcgcggtctcgtggtgactccatgaacaggtggtggtacctacgtggaggctgggactccgccagcgagccgagggaggccgtggaggtggagttgggtacatcgtaattaccgacgtgggagccaaccctacgtaacctacccggttccaggaacggacgtaccgacggacctaaccctattaacgtttacggttacggtaacccccgttacggtaaaccggtaaaacctacgttttacccgtacccgtaggtaaacgttacgtacggtttaaccgtttttggacgtaccgttacgacccgggacgacccggtaccggttccgtacgttaccgtacggtcggttcggacgggtacgggacggttcgggacgggttcggggtacggtttcgttttcggtaaggttttcccgggagggggtaccgtaacggggtacgtagggttccgggtacgttacccggtaccgttaccgttcgaccgttcccgtaccgttaaacccggaccgggttacccgaccggtttcccggttaccccgttaccccggtccgtaaccccgttaccccgttcccgttaaccggaaccggtacccgttaccggaacccggttccgggtaaccgggggtcccgtaaccgggtaccgggcccccgggttaccggtccgggttcccggtccggttacccggtacgggtaacccgtaacggtaccccggttaaccggtaccgtttaaccggtaccgttaccgtaacgggg

SEQ ID NO: 26537 - DNA, 897 bp, Homo sapiens
  misc_feature: GYAE6OF01D65BA.16.1.A01.1.454.CMB.1.raw
  modified_base (218)..(218): a, c, t, g, unknown or other
  misc_feature (218)..(218): n is a, c, g, or t
tcagtgtactactccacgaccggtgctcgatttagacgtctcatcagggggtctcaggaggcagcgctctcaggacatctccaccatggcctggctctgctgctcctcaccctcctcactcgacgggcacgtagggtcctcgggccctagtctcgccctgacctcacgcctcgccctcgtgtcgtcgggtcctacgtggacctaggtcactccacctntccgtcctcgacacgtacgaaacccaatacgttggtacggtttggacttaatttaacgttaaccgtttcgttcccttaccgttacggtaaacccaaaaccaaaccgaaccccgaacggtaacccaaaaccccggtaacccccctaaaaccttacctaactttaccgttaaacttttaacggttaacgtaaaccgtttacccgttaacgtaaaccggtccccggtacccggtaacgggtaacggggttaacttaccttaaccgtccgttcgtttaccctccggtacgtacccttaacgtaacgttccggtacggaacctaaccgcccggtcccctacccgttccgtacccgtccgttccggtccgtaccccgtaccgtaaccggtagtaccgggtaacggggacgtacgggtcttaacggttaatttacctccggtaccacccgttacgttacctaaaggttacgtaaacggtaacgttaccctttaccgttaccgttaccggggttttggtttaccgggtttaccgggaccgggttaaccgggaacctaccgggtccgtaccgggttaaccccgttaccggtaaccggttaccgaacccgtcccggggtaacgtcccggttaacccccgtccccggttacctacccgttacccgttacccgttcccccgttaacccccg

SEQ ID NO: 26538 - DNA, 948 bp, Homo sapiens
  misc_feature: GYAE6OF01E0TTM.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacgagggtcctgggcccagtctgccctgactcagcctgcctccgtgtcgtgggtctcgtggacagtcgatccaaccatcctctgaccacgtacggaaaccaacgtagtttacggtacggttttgggtagttaacttttaactttaaacgtttttcggttcccttacccgtttacggttaaaccccaaaaccaaccctaaccccgaaccggaaccaaaaccggtaacccccccaaaccttacctaactttactaattttaatacggtaacgttaccgttaccgtaaaccggtcccggtaccccgttacgggtaacgggggttacttaacgttaacgttcccggtacctttccgttaccgtcggtaccttaccgtaaacgttcggtacggaacccgtaacccgtaacccgggttcccccgttacccgtaccggttaccccggttacccttcccgggttaccggtccccgttacccgtaaacgggtaccggttacgggaaccggggtaacccgggtaggtacccgtttaagttaacgttttaaccgtttaccgttaccgtacccctaacgttaaccgtaaagtttaaccggttaaagggtaaaccggtttaagtttaacccgtttacccggtttaccgttttacggggttttacggggttttaccgggggacgggtaaccggggtaccgtaacgggttcccgtaacggtaacccggttacccgggttacgtacccgggtaaccggacccgggtaacgtccccgtaccccggttacccccggtcccggttaccctaacccgttcccgttccccgttaaccccccg

SEQ ID NO: 26539 - DNA, 622 bp, Homo sapiens
  misc_feature: GYAE6OF01CLZO1.16.1.A01.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
tcagtgtactactccacgaccggtgctcgatttagacgtctcatcagggggtctcaggaggcagcgctctcaggacatctccaccatggcctggctctgctgctcctcaccctcctcactcagggcacgagggtccgtcgggcccagtcctcgcccctgactcacgcctcgcctccgtgtctgggtcctccgnggacagtcactccaccatcctccngaccactacgaaccaactagttgacggttgagtatttatactttntctctacgtaccaaacaccaccaggacaaaccaccccaatcatntattangactctanacgcgctgaggtanctancgtctctcgngctacagctagacacgcgcctccacgtcacgtccgtcgcctacgacgacgtacggaacggacgtaggtctagttaactttactcgtaccgtaccgtactacaagtaacgtaagtaacgttaacttaccgttacgtttccggtttcgttcgggggtttccgaacggggacgtaaaccgtacggtcgttaccggaccgttaccggtacgtacgacccgtaccgtacccgccgttccgtccccgtacgttcaacccgttccgttcccgttacccccg

SEQ ID NO: 26540 - DNA, 802 bp, Homo sapiens
  misc_feature: GYAE6OF01BDNNX.16.1.A01.1.454.CMB.1.raw
  modified_base (213)..(213): a, c, t, g, unknown or other
  misc_feature (213)..(213): n is a, c, g, or t
  modified_base (260)..(260): a, c, t, g, unknown or other
  misc_feature (260)..(260): n is a, c, g, or t
  modified_base (315)..(315): a, c, t, g, unknown or other
  misc_feature (315)..(315): n is a, c, g, or t
tcagtgtactactccacgaccggtgctcgatttagacgtctcatcagggtgtccttgggtttgggggaagaggaagactgacggtcccccaggagttcaggagtcgggccaggactggtgaggccttcagacgacccctctccctcgacctgccgcggtctcgtggtgactccatgaacaggtggtgtacctagtggagcgtggactccgacngcagccgagggacgctgagtcgagttggacatctatacgacgtggancaaccgtactaccacccgtcctagagtagcgagcctacatattgtacgacccgtntaacgggaacctacgttcctccgtagaagagttcgtaccgttttagtaccgtacgttcgaccggccggaccggaaccggccgtactaccgtaacgtggtacggccggaaggggtacgggtagggtacggtccggggtagggttacgttttacggtacgttttccgggtacgggggtacccggtaaagggtcgtaacgggttacggttcccgtaaccggtttacctccgtttaccgaccgtcccgtacccaaccgggtaccggacccgtacggttaacccggttcccctttacccccgcggtccctaccccgttacccggtacccgttaaacggcccgttaccgtaacccggttccgggtaccggggtccctacccggtaacgggccccgggtcccggttcggggccccgttaacggtcccggtaacgggtaacccgtaccggtaccgttacccggttaaccggaccggtttaggacccgttaacggg

SEQ ID NO: 26541 - DNA, 812 bp, Homo sapiens
  misc_feature: GYAE6OF01DSDBP.16.1.A01.1.454.CMB.1.raw
  modified_base (194)..(194): a, c, t, g, unknown or other
  misc_feature (194)..(194): n is a, c, g, or t
tcagtgtactactccacgaccggtgctcgatttagacgtctcatcagggggtctcaggaggcagcgctctcaggacatctccaccatggcctgggctctgctgctcctcaccctcctcactcgacgggcacgacgggtccgtcggccagtctcgccctgactcacgctcgtcctcgtgtcgtggtctcgtgacngtcgactcgacctactctccgtagactacgtaacggaaccaacgttagttacggtacggtttggtacttaatttaacgttttaaccgtttcgttccgttaccgttaacggttaaacccaaaactaaacccgaccgaaccggaaccaaaaccccgacccctaaacctactacgtaacttacgtttaacggtataaacgttccgtaactaaccgggtcccgtacccgtagggttaacggtaacttacgttaaccgtcttaccttcgtcgtcgtacctacttacggtacgtcgaccaaccgcctcccgtaccgtacgtcccgtttgcccgtcgtacctaccgtagtaccggtacgggacggtaacggtcggtacgttaacgtaactttaccgtacgttaccgaccttactaacggtaattaacggtaagttaacgttaacgtttaaccgtaccgtttccggttaacgggttttccgggttaacggggtacgtaacggggtaacccgtaggttaccgtacgtacccggttaccggtaccgttaccggaaccgtacccggtaacggtccccgtacccgtacccgtcccgttaccgttaccctccgttccccgtttacccccgg

SEQ ID NO: 26542 - DNA, 582 bp, Homo sapiens
  misc_feature: GYAE6OF02I0TTN.16.1.A01.1.454.CMB.1.raw
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (489)..(489): a, c, t, g, unknown or other
  misc_feature (489)..(489): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(582): a, c, t, g, unknown or other
  misc_feature (541)..(582): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgcccgcggacacggccgtctgactntgngacggaggnggnggcggtgggaggtttctttgtagtttcgggcgggaacggaacggactaggtcgtaccgaccgtcttccttacgacgtccctaccccaacggaacccgggacccctaacggttccggttcccccctttccccccggtggaccccctacccccgttcccctaaccgaaaggccgaccctacccttcggggtccgggggccacgacgggccccggtccggtcggcgtcgcgttcggtacgaacggtaccttcccgtacggtagtactaacncgtaggacgggccgggtcgtcggacggaacgggccgacgtaagtaggngngnnnnnnnnnnnnnnnnnnnnnnnnnnnnnnnnnnnnnnnnnn

SEQ ID NO: 26543 - DNA, 417 bp, Homo sapiens
  misc_feature: GYAE6OF02HGEND.16.1.A01.1.454.CMB.1.raw
  modified_base (411)..(417): a, c, t, g, unknown or other
  misc_feature (411)..(417): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggcttttgatttctggggccaaggggacagtggtcaccgtctcttcagcctccaccaagggcccatcggtcttccccctggcaccctcctccaagagcacctctgggggcacagcggccctgggctgcctggtcaaggactacttccgagtagtacactgagcgggctggcaaggcgcatagnnnnnnn

SEQ ID NO: 26544 - DNA, 516 bp, Homo sapiens
  misc_feature: GYAE6OF02G6GIV.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctcaagtctggcaacacggcctccctgacccgtctctcggcctccagactgaggacgaggctgattattactgccactcatatagaagtagtactactcctgtgttttcgcggaggacgagctgaccgtcgtacggtcacgccgacggctcgccccgtcgtccactctcgttccccg

SEQ ID NO: 26545 - DNA, 510 bp, Homo sapiens
  misc_feature: GYAE6OF02IN2K2.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccaacattgacgttggtgattataactttgtctcctggtaccaacaacaccaggcaaagccccaaactcatcatttatgaagtctctaagcggcctcaggggtatctaatcgcttctctggctccaagtctggcaacacggcctccctgaccgtctctggcctccagactgaggacgaggctgattattactgccactcatatagaagtagtactactcctgttggttttcgcgggaggaccaagctgaccgtcgtaggtcagcccagctcgcccctcggtcactctgtccccg

SEQ ID NO: 26546 - DNA, 515 bp, Homo sapiens
  misc_feature: GYAE6OF02HVPLH.16.1.A01.1.454.CMB.1.raw
  modified_base (233)..(233): a, c, t, g, unknown or other
  misc_feature (233)..(233): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtnattataactttgtctcctgtaccaacaacaccaggcaaagcccccaaactcatcatttatgaagtctctaagcgccctcagggtttctaatcgcttctctgctcaagtctcgcaacacggcctccctgaccatctcgtggctccgaggctgaggacgagggtgattatactgacagctacatatagaagtggacagcactcgtcgttagttcggcggttggaccagctacggacccgtcctaggtccagcccaaggcctccggccccctcggtcacttcccg

SEQ ID NO: 26547 - DNA, 516 bp, Homo sapiens
  misc_feature: GYAE6OF02H7X51.16.1.A01.1.454.CMB.1.raw
  modified_base (508)..(508): a, c, t, g, unknown or other
  misc_feature (508)..(508): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggcaaagcccccaaactcatcatttatgaagtctctaagcggccctcaggggtatctaatcgcttctctggctccaagtctggcaacacggcctccctgacccgtctctggccctccagactgaggacgaggctgatttatactgccactcatatagaagtagtactactcctgttggttttcggcggagggaccaagctgaccgtctaggtcagcccaaggctcgcccctcggtcactcngttccccg

SEQ ID NO: 26548 - DNA, 419 bp, Homo sapiens
  misc_feature: GYAE6OF02HLO4Y.16.1.A01.1.454.CMB.1.raw
  modified_base (412)..(419): a, c, t, g, unknown or other
  misc_feature (412)..(419): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggctttttgatttctggggccaaggggacagtggtcaccgtctcttcagcctccaccaagggcccatcggtcttccccctggcaccctcctccaagagcacctctgggggcacagcggccctgggctgcctggtcaaggactacttccgagtagtacactgagcgggctggcaaggcgcatagnnnnnnnn

SEQ ID NO: 26549 - DNA, 555 bp, Homo sapiens
  misc_feature: GYAE6OF02I2UEI.16.1.A01.1.454.CMB.1.raw
  modified_base (233)..(233): a, c, t, g, unknown or other
  misc_feature (233)..(233): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtnattatactttgtctcctgtaccaacaacaccaggacaacgacccccaactcatcatttatgaagtctctaagccggtccctcgagggtatctaactcgtcttctctcgctaccagtctggcaacaccgtcctcctcgacctcctctcggcctccagactggagacggaggtctgtattacttactcgacctctacatatacgaagtagtactactcgttggttcggtttcggcggacggaccagctcgaccgtccgtaggtaccacggtacccgaaggtccgtccgtcccccgttcggtaccacgttccgtccgttcccccg

SEQ ID NO: 26550 - DNA, 579 bp, Homo sapiens
  misc_feature: GYAE6OF02IFT38.16.1.A01.1.454.CMB.1.raw
  modified_base (449)..(449): a, c, t, g, unknown or other
  misc_feature (449)..(449): n is a, c, g, or t
tcagtgtactactccacgaccggtgctcgatttagacgtctcatcagggtgtccttgggttttggggggaagaggaagactgacggtcccccaggagttcaggagtcgggcccaggactggtgaggccttcagagaccctctccctcacctgcgcggtctctggtgactccatgaacagtggtggtacctactggagctggatccgccagcagccagggaaggcctggagtggattgggtacatctattacactgggagcacctactacaacccgtccctgaagagtcgagctaccatattagttgacccgtctaggaacccaattctccctgaagatgaccttttgtgactgccgcggacacggccgtctactactgtgcgaggaggtggagtcggaggggcttttgattttcgtggggtccaagggacagtggtcaccgtctcttcngcctccaccaagggcccatccggtcttccccctggccaccctcctccaagacgccacctctcgggggccacgacgccggcccgtgggcctcggcctggtcaacggactaccgtccggagtacgtactacg

SEQ ID NO: 26551 - DNA, 547 bp, Homo sapiens
  misc_feature: GYAE6OF02IAEKH.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgatcaccatctcctgcactggaaccaacattgacgttggtgattataactttgtctctgtaccaacaacaccagcaaagcccccaaactcatcatttatgaagtctctaagccggccctcgagggtatctaatcgcttctctgctcagtctggcaacacgcctccctgaccctctctcggcctccagactgacggacgaggctagattattactgccactcatataagaagtatactactccgtgttcggttttcggcggtacggaaccaagctacgacccgtcgtacgggtccacggacccgaacggtccgtcgaccccccgttcgggtccctaccgttccctcgttaccccccg

SEQ ID NO: 26552 - DNA, 415 bp, Homo sapiens
  misc_feature: GYAE6OF02GGFJV.16.1.A01.1.454.CMB.1.raw
  modified_base (243)..(243): a, c, t, g, unknown or other
  misc_feature (243)..(243): n is a, c, g, or t
  modified_base (411)..(415): a, c, t, g, unknown or other
  misc_feature (411)..(415): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcgggagggcttttgatttcnggggccaagggacagtggtcaccgtctcttcagcctccaccaagggcccatcggtcttccccctggcaccctcctccaagagcacctctgggggcacagcggccctgggctgcctggtcaaggactacttccgagtagtacactgagcgggctggcaaggcgcatagnnnnn

SEQ ID NO: 26553 - DNA, 514 bp, Homo sapiens
  misc_feature: GYAE6OF02HLX8T.16.1.A01.1.454.CMB.1.raw
  modified_base (360)..(360): a, c, t, g, unknown or other
  misc_feature (360)..(360): n is a, c, g, or t
  modified_base (419)..(419): a, c, t, g, unknown or other
  misc_feature (419)..(419): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctctggtaccaacaacaccaggcaaacgcccccaaactcatcatttatgaagtctctaagcggccctgagggtatctaatcgcttctctggctcaagtctgcaacacgcctccngaccgtctcgtggccctccgagactgaggacgaggctgattattacgtgccactcatanagtaagtagtactactccttgttggtttcggcggaggaccagtctagaccgtcgtaggtcacgcccaagctcgccctcgtccactctcgtccccg

SEQ ID NO: 26554 - DNA, 548 bp, Homo sapiens
  misc_feature: GYAE6OF02HMZHJ.16.1.A01.1.454.CMB.1.raw
  modified_base (233)..(233): a, c, t, g, unknown or other
  misc_feature (233)..(233): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtnattataactttgtctcctggtaccaacaacacccaggacaaagccccccaaatcactcatttatgaagtctctaagcgccctcgaggggtatctaatcgcttctctggctaccaagtctgcaacgacggcccttccctgtacccgtctcgtcggccctaccagtactggaggacgaggcctgtatttattactcgtaccatcatatagaagtagtactactctggtcgtttcggcggaggaccagcgtagtaccggtctaggtaccacgacccgtaagcctccggcccctaggtccacttccgtcgttccccccg

SEQ ID NO: 26555 - DNA, 522 bp, Homo sapiens
  misc_feature: GYAE6OF02GKKLY.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctacactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctcctcgaccgtctctggcctccagactgaggacgaggctgattattactgccactcatatagaagtagtactactcctgttggtttcggcggtagggaccaagctgccgtactaggtcacgccgaagctcgcccctcggtccactctcgtcccctaccccg

SEQ ID NO: 26556 - DNA, 580 bp, Homo sapiens
  misc_feature: GYAE6OF02F4K50.16.1.A01.1.454.CMB.1.raw
  modified_base (260)..(260): a, c, t, g, unknown or other
  misc_feature (260)..(260): n is a, c, g, or t
tcagtgtactactccacgaccggtgctcgatttagacgtctcatcagggtgtccttgggttttggggggaagaggaagactgacggtcccccaggagttcaggagtcgggcccaggactggtgaggccttcagagaccctctccctcacctgcgcggtctctggtgactccatgaacagtggtggtacctactggagctggatccgccagcagccagggaagggcctggagtggattgggtacatctattacactgggancacctactacaacccgtccctgaagagtcgagctaccatattagttgacccgtctaggaaccaattctccctgaagatgacctttgtgactgccgcggacacggccgtctactactgtgcgaggaggtggagtcgggagggtcttttggattttcgtggggccaagggacagtggtcaccgtctcttcagcctccaccagggcccatcggtccttccccgtggccaccctcctccaagcgccacctcgtggggccacgcgccggcccgtgggcctcggccttggtccgaacggcttaccgttccgacgttacgtactacg

SEQ ID NO: 26557 - DNA, 608 bp, Homo sapiens
  misc_feature: GYAE6OF02GQ1HW.16.1.A01.1.454.CMB.1.raw
  modified_base (416)..(416): a, c, t, g, unknown or other
  misc_feature (416)..(416): n is a, c, g, or t
  modified_base (446)..(446): a, c, t, g, unknown or other
  misc_feature (446)..(446): n is a, c, g, or t
  modified_base (482)..(482): a, c, t, g, unknown or other
  misc_feature (482)..(482): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaaggcctggagtggattgggtacatctattacactgggagcacctactacaacccgtccctgaagagtcgagctaccatattagttgacccgtctaggaacctattcctccctgaagatgacctttgtgactgccgcggacacggcctctactactgtgcgaggaggtggagtcgggaggtcttttgacttttcgnggggcaagggcagtggtcaccgtctcttcncgcctccaccaacggcccacgtccgtccttccccgngcccacccgtcctccgaagacgccacctcgtcggggacacgacggcccggacccgtcggggcctcggtcccgtacgggtaccgaacgggtaccttaccgttacccggacgttacgtacgtaaccgg

SEQ ID NO: 26558 - DNA, 610 bp, Homo sapiens
  misc_feature: GYAE6OF02GRM4I.16.1.A01.1.454.CMB.1.raw
  modified_base (208)..(208): a, c, t, g, unknown or other
  misc_feature (208)..(208): n is a, c, g, or t
  modified_base (411)..(411): a, c, t, g, unknown or other
  misc_feature (411)..(411): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtccgtgggtctccgtggacagtcgatcatcatcttntgcactggactccagcagtcgacgttggtagttataattatgtctctgtacacagtacccagacaaacgaccccaaactcatgtattatgagtcagtatcgcctgtagggttactaatcgtcttctctgtctaccaagtcgtgacaacgaccgtccctcctacgaccactctcgtggcctccgagcgtagaggacggagggtntaagttattaccgtgccgagtactataagtagtaaggaggtacggactaaggtacctacgttacgttacgtttacggttaccggggtccgggtacggggtaacccgtaaacggtccgttacgtaccccgggttaccgtaacgggtcccgaaccggtaccccgaaacgggttcccggttacccgtaccccccggttccgg

SEQ ID NO: 26559 - DNA, 776 bp, Homo sapiens
  misc_feature: GYAE6OF02IK1QB.16.1.A01.1.454.CMB.1.raw
  modified_base (129)..(129): a, c, t, g, unknown or other
  misc_feature (129)..(129): n is a, c, g, or t
  modified_base (200)..(200): a, c, t, g, unknown or other
  misc_feature (200)..(200): n is a, c, g, or t
tcagtgtactactccacgaccggtgctcgatttagacgtctcatcagggggtctcaggaggcagcgctctcaggacatctccaccatggcctgggctctgctgctcctcaccctcctcactcaggcacngggtcctgggcccagtctcgccctgactcagcctgcctcgtgtctgggtctcctggacagtcatcaacctntctcctgactacgtacggaaaccaatgttcggacgtttgggtataactttaacttaacgtttcgttcttccgttacggtaaccaaacaaccaacccgaggaaccaaaccgaccccccaaactacctaactactaagtttacgtacgtaacgttcctacgtaacggtccggtaccccttacggaaggggtacttactaaacgtcgtccttctcgtcggctccgtaagtcgtacggaccaacgaccggtcctacccgtacgtacccgttcttccgtcgtacctacgtaccgaacggttacgacgggacggtaacggtcgttacgttaacttaacgtttacgtacggtaaccctactaccgttaaataacgtaaacgttaaaggttaagttaacctttaccgttaacctttcgggtttcgggttttaccgggtaccgggtaacgggtaaaccggaacccggttacgacccggttaacggttacccggttaaccgggtacgtaccggtacccgtaacccgtacggtccccggtcccgttccccgggtacctttacccgtaccttcccgtttaaccccccg

SEQ ID NO: 26560 - DNA, 598 bp, Homo sapiens
  misc_feature: GYAE6OF02G1XR3.16.1.A01.1.454.CMB.1.raw
  modified_base (260)..(260): a, c, t, g, unknown or other
  misc_feature (260)..(260): n is a, c, g, or t
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
  modified_base (411)..(411): a, c, t, g, unknown or other
  misc_feature (411)..(411): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaaggcctggagtggattgggtacatctattacactgggancacctactacaacccgtccctgaagagtcgagctaccatattagttgacccgtntaggaaccaattctccctgaagatgacctttgngactgccgcggacacggccgtctactactgtgcgaggaggtggagtcggaggctttgatttcgngggcagggacagtggtcacgtctcttcacgcctccaccgaacgggcccagtcggtccttcccccgtggccaccccgtcctccgaacgacgccacccgtcgtcgggggccaccgacgccggcccgtcggggccgtcggcccgtcggtccgaacgggtaccttaccgttacccggtagtacgtactacg

SEQ ID NO: 26561 - DNA, 597 bp, Homo sapiens
  misc_feature: GYAE6OF02ILJFR.16.1.A01.1.454.CMB.1.raw
  modified_base (416)..(416): a, c, t, g, unknown or other
  misc_feature (416)..(416): n is a, c, g, or t
  modified_base (518)..(518): a, c, t, g, unknown or other
  misc_feature (518)..(518): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaaggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtcggagtcgggaggtcttttgattttcgnggggccagggacaggtggtcgacgtctcttcacgcctccaccgaacggcccagtccgtccttccccgtgcccacccgtccctaccaacgtcgaccacctcgnggggccacgacgccggcccgtcgggcctcggcccttggtacgaacgggtaccttaccgttcccggaggtacgtactacg

SEQ ID NO: 26562 - DNA, 649 bp, Homo sapiens
  misc_feature: GYAE6OF02I6Q82.16.1.A01.1.454.CMB.1.raw
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
  modified_base (549)..(549): a, c, t, g, unknown or other
  misc_feature (549)..(549): n is a, c, g, or t
  modified_base (607)..(607): a, c, t, g, unknown or other
  misc_feature (607)..(607): n is a, c, g, or t
  modified_base (613)..(613): a, c, t, g, unknown or other
  misc_feature (613)..(613): n is a, c, g, or t
tcagtgtactactccacgaccggtgctcgatttagacgtctcatcagggtgtccttgggttttggggggaagaggaagactgacggtcccccaggagttcaggagtcgggcccaggactggtgaggccttcagagaccctctccctcacctgcgcggtctctggtgactccatgaacagtggtggtacctactggagctggatccgccagcagccgagggaagggcctggagtggattgggtacagtctattacacgtgggagcacctactaccaacccgtcctagaagacgtcgagctaccagtacttagttcgacccgtntaaggaacctaattcctccctaggaacgtntacgtaccttttgtcgtactcggccgcggaaccgacggtccgtctactactgtcgcggaggaggtcggaggtacgggtaggtcttttaggtacgttttcgtcgggggaccctaaaggggcctaggtcggttaccaccggttcttaccgttcgacgcctaccgaacgtacggccctagttcccggtacctttccccgnggccctacccgttccgtaccgagtaccgcctcgtcggacggcaccgcgccggtaccgnggtccncgtcgtcgtacgacgtcgtaccgtcggagtacgctg

SEQ ID NO: 26563 - DNA, 592 bp, Homo sapiens
  misc_feature: GYAE6OF02GIELV.16.1.A01.1.454.CMB.1.raw
  modified_base (348)..(348): a, c, t, g, unknown or other
  misc_feature (348)..(348): n is a, c, g, or t
  modified_base (415)..(415): a, c, t, g, unknown or other
  misc_feature (415)..(415): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaaggcctggagtggattgggtacatctattacactgggagcacctactacaacccgtccctgaagagtcgagctaccatattagttgacccgtctaggaaccaattctccctgaagatgaccttttgngactgccgcggacacggccgtctactactgtgcgaggaggtggagtcggagggtcttttgatttcgnggggcgaagggacagtggtcaccgtctcttcacgcctccaccgaacgggcccagtccggtccttcccccgtggccaccctcctccaacgcgccaccctcgtcggggccaccgacgccggcccgtcgggcctcggccgtcggtcgaacggtctaccgttaccgacgttacgtactacg

SEQ ID NO: 26564 - DNA, 654 bp, Homo sapiens
  misc_feature: GYAE6OF02JS7CE.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtccctctgtacaacacaccagcaagccccaactcatcattatgaatctctaagcgccctgacgggtatactaactcgtcttcctctcggtcctccgaagttctggaccaacgaccggtccctccctcgaccgtctcgtacggccctcgacgacctggacgtaccggagtctgaatttatactcgcctactccaattaacgtagaaacgttagtaccttaccgttaccgttgggtttcgggtttttaccggggaccgggacgggtaaaccctaagtccgttacggtaaccccggtttaccggttaacggtaccccgtaagggtaacccccggtaagggtcccgttcccccgggtcccccccgtttaacgggtccctaaccgtttccccgtacccggttttcccccccggg

SEQ ID NO: 26565 - DNA, 678 bp, Homo sapiens
  misc_feature: GYAE6OF02IHCZY.16.1.A01.1.454.CMB.1.raw
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccntctcctgcactggaaccaacnttgacgttggtnattatacttgtctctgtacaacacaccagacaaacgccccaatcatctattatagtaagtctctaacgcggtccctcgaagggtactactaacgtcgtcttctctggctaccgtaagtctggaccaacgaccggtcctaccctcgtacccgtcttccgtcggtccctccgaacggtactacgggacggacggtacgggtacttaggtaactttaacgttaaccgttcggtacccttacgtacctaagttaacgtaagtaaacggttaacggttaaccttaccgtacccgtttagggtttacgggtttttaccggggaccgggtaaacgggtaaccgtaaacggtccgtacggtacccggtttaccgtacgggtaccgtacggtacccgtaacggccgttcccggtaccccgtccgttaccggaccttacgttcccgttacccccg

SEQ ID NO: 26566 - DNA, 569 bp, Homo sapiens
  misc_feature: GYAE6OF02HAAF2.16.1.A01.1.454.CMB.1.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (420)..(420): a, c, t, g, unknown or other
  misc_feature (420)..(420): n is a, c, g, or t
  modified_base (441)..(441): a, c, t, g, unknown or other
  misc_feature (441)..(441): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacaggtcgatcaccatctcctgcactggaaccanattgacgttggngtattattaactttgtctctgtaccaacacacccaggacaaacgcccccaaactcaactcatttatagaacgtctctaagccggccctcgaggggtactactaatcgtcttctactggctcgaagtctcggacaacaccggtaccctcccgtacgccgttctactcggcctcagactggacgacgagntcgattactactcgaccactnatataagagttacgtactctcttggttggtttcggcggtacggacctagcgtagtccgtacgtacggtacacggaccctaaggccgtacctccccggtcggtacctacgttccgtcccgttacccccg

SEQ ID NO: 26567 - DNA, 640 bp, Homo sapiens
  misc_feature: GYAE6OF02IWL3A.16.1.A01.1.454.CMB.1.raw
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccaggggaaggcctggagtggattgggtacatctattacactgggagcacctactaccaacccgtccctgaagagtcgagctaccatattagttgacccgtctaggaaccaattctcctgaagatgtacctttgtgactgccgcggacacggccgtctactactgtgcgaggaggtggaggtcggagggtcttttggattttcgtggggccaagggacaggtggtccaccgtctcttcagccctccgacacgggccctacgtcggttcctcccccgtcggccctacccctcctacccaacggacgcccgtaacccgttcggtaccggggggtaccaccgacggcccgggtccccgtggggtccgttacgcccgtcggtaccgaacggtaccgttaccgttaccggtaacgttacgtacctaaccgg

SEQ ID NO: 26568 - DNA, 528 bp, Homo sapiens
  misc_feature: GYAE6OF02FXN2Z.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcgaggggtatctaatcgcttctctggctccaagtctgcaacacggcctccctgacccgtctctgcctcagctgaggcgagctgattacttactgcctactcatatagaagtagtactactccgttgttcggttttcggcggtacggaccaagctacgaccgtccgtaggtcacgcccaaggcctcgccccctcggtcacctcttgttacccccc

SEQ ID NO: 26569 - DNA, 638 bp, Homo sapiens
  misc_feature: GYAE6OF02F1DAP.16.1.A01.1.454.CMB.1.raw
  modified_base (433)..(433): a, c, t, g, unknown or other
  misc_feature (433)..(433): n is a, c, g, or t
  modified_base (614)..(614): a, c, t, g, unknown or other
  misc_feature (614)..(614): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgtattataactttgtctctggtaccaacaacaccaggacaaacgcccccaaactcatcatttatagtaagtctacgtaacgccggccctgacggggtatctaagtccgtcttctcgtcggtcctaccgaagtcgtcggaccaacgaccggtcccttcccgtcgacccgtctacgtcggccctcgacgactaggacggacgngctagtattacttctacgcctactactagtataagtaagttacgtaccttaccttccgttggttttcgggttttaccggggacgggaacgggtaacccgaacggtccgtaccggtacccgttaccggtacggtaccgaccgtacccggtaagtcccgtcccgtcccccggtcggttacccncccgttccgttcccgttccccccg

SEQ ID NO: 26570 - DNA, 618 bp, Homo sapiens
  misc_feature: GYAE6OF02GNHSV.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctctggtaccaacaaccaccagaccaaacgcccccaaactcatacatttatgaatctactaagcggccctgagggtatctaagtcgtcttctctcgctacagtctggacaaccaccggcctacccgtacgtaccgttacctcgtaccggccctacccgagccgtaggacggaccggtacggtacgtgtaatttacgttacgtacgaccctactctaataatagtaaagttacgtaacttaccgttcgttggtttcgggttttcgggacggtacggtaaccaaggtccgtacgtaccgtccgttaacggtaccaacggcccgtaacggtccgtaccgccccgttccggtactaccttccgtccgtttcccccg

SEQ ID NO: 26571 - DNA, 766 bp, Homo sapiens
  misc_feature: GYAE6OF02IG244.16.1.A01.1.454.CMB.1.raw
  modified_base (163)..(163): a, c, t, g, unknown or other
  misc_feature (163)..(163): n is a, c, g, or t
  modified_base (174)..(174): a, c, t, g, unknown or other
  misc_feature (174)..(174): n is a, c, g, or t
  modified_base (184)..(184): a, c, t, g, unknown or other
  misc_feature (184)..(184): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagtgtactactccacgaccggtgctcgatttagacgtctcatcaggggtctcaggaggcagcgctctcaggacatctccaccatggcctgggctctgctgctcctcaccctcctcactcgagggcacgagggtccctgggcccagtctcgccctgactcancctgcctcgtntcgtgggtcncgtaggcagtcgatcacntcncctgcncgtacggaaccaatcttaggcgttggagtatttaactactttgtccttctaggtacctaacaaccaccaggaccaaacgaccccccaaaattccaattctacgtttactagtaaccgttactacgttaacggcccggtaacccgtcggtaacgggttactttaacgtaacgtttccgtacctttccgttcgttacgggaccttaccgtaaacggtccgttaacggaccgtaaaccgtacccgggtcccttaccccgtaggtaccccgtttcgcccgttacggtcccttaccgaaccggtaccgtacgggaacggtacgggacggtacgttacgtacgttaactttacgttacgtaccgactactattacgtaagtaacgttagttaaccttaccgtaccgtttagggttacgggtttttcggggaaccgggttacccgggaacgtaacggttaccgtacggtaccggttaccggtacgggtacgtaccggtaccgaacgggtccgtacccggtcccgttaccgggtcccttacggttcccgttaccttacccccg

SEQ ID NO: 26572 - DNA, 417 bp, Homo sapiens
  misc_feature: GYAE6OF02GTDYO.16.1.A01.1.454.CMB.1.raw
  modified_base (410)..(417): a, c, t, g, unknown or other
  misc_feature (410)..(417): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggcttttgatttctggggccaagggacagtggtcaccgtctcttcagcctccaccaagggcccatcggtcttcccccctggccaccctcctccaagagcacctctgggggcacagcggccctgggctgcctggtcaaggctacttcgagtacgtacactgagcgggctggcaggcgcatagnnnnnnnn

SEQ ID NO: 26573 - DNA, 585 bp, Homo sapiens
  misc_feature: GYAE6OF02HKCBD.16.1.A01.1.454.CMB.1.raw
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (355)..(355): a, c, t, g, unknown or other
  misc_feature (355)..(355): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaanattgacgttggtnattataactttgtctcctggtaccaacacaccaggcaaacgccccaaactcatcattangaagtctntaagccggccctcgaggggtatctaatccgtcttctctggctcaagtctgcaacncgcctccctgacctctctcgccctccgagtctggacggaccgaggctgaacttattactgcagtcttagtactacgaggacaaactaattaccttttggtaccttttacggaaacgttacgggaaccgtaacggttccgtaccgttaccgtcggtaccacgaccccggtaaacgtcccccaaaccccgacgttaccggtacctaccgttccgtccgttcccctaaccccg

SEQ ID NO: 26574 - DNA, 521 bp, Homo sapiens
  misc_feature: GYAE6OF02G9O50.16.1.A01.1.454.CMB.1.raw
  modified_base (233)..(233): a, c, t, g, unknown or other
  misc_feature (233)..(233): n is a, c, g, or t
  modified_base (294)..(294): a, c, t, g, unknown or other
  misc_feature (294)..(294): n is a, c, g, or t
  modified_base (362)..(362): a, c, t, g, unknown or other
  misc_feature (362)..(362): n is a, c, g, or t
  modified_base (452)..(452): a, c, t, g, unknown or other
  misc_feature (452)..(452): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtnattagtaactttgtctcctggtaccaacaacaccaggcaaacgcccccaaatcatcattangagtctactaagccgcctcgagggtactacgtaatcgcttctctgctcagtctcgcacacggcctccngaccatctcgtgggcctcgagctaggaggacgaggtgtattattaacgtgctagctacatagtagaagtgacagcactctcgtattcggnggtaggaccaaggccgtgacccgtctaggcacggtaccgaggtcctaccggtccccgtggtacctaccg

SEQ ID NO: 26575 - DNA, 574 bp, Homo sapiens
  misc_feature: GYAE6OF02IQIWC.16.1.A01.1.454.CMB.1.raw
  modified_base (416)..(416): a, c, t, g, unknown or other
  misc_feature (416)..(416): n is a, c, g, or t
  modified_base (445)..(445): a, c, t, g, unknown or other
  misc_feature (445)..(445): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaagggcctggagtggattgggtacatctattacactgggagcacctactaccaacccgtccctgaagagtcgagctaccatattagttgacccgtctaggaaccaattcctccctgaagatgacctttgtgactgccgcggacacggccgtctactactgtgcgaggaggtggagtcggaggtctttgattttcgnggggcaagggacagtgtcacgtctcttcncgcctccaccaacgggcccagtcggtcctccccgtgccaccctcctaccaacgacgccacctcgtggggcacgcgcggcccgtgggcctcgcctggtcgaacggactaccgtccgagtacgtactacgg

SEQ ID NO: 26576 - DNA, 594 bp, Homo sapiens
  misc_feature: GYAE6OF02GM44C.16.1.A01.1.454.CMB.1.raw
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
  modified_base (512)..(512): a, c, t, g, unknown or other
  misc_feature (512)..(512): n is a, c, g, or t
  modified_base (591)..(591): a, c, t, g, unknown or other
  misc_feature (591)..(591): n is a, c, g, or t
tcagtgtactactccacgaccggtgctcgatttagacgtctcatcagggtgtccttgggtttgggggaagaggaagactgaccggtcccccaggagttcaggagtcgggcccaggactggtgaggccttcagagacccctctccctcacctgcgcggtctctggtgactccatgaacagtggtgtacctatggagctggatccgcagcagccagggaggcctggagtggattgggacatctattacacgtgggancacctacacaaccccgtccngaagagtcgagctaccatattagtgacccgtctaggaacctaattcctccctagaagatcggtaacctttggcacgtcgccgacggaccgacgggcctctaacgtacgtgtggacgaggaggtggaggtacgggagggttcttttggacgttttcggcggggtaccaaggggtactaggtggtaccgacggttcttacgtcacgtccctacacgaccggccagtccgtccttcccgngccctccctctacagcgccacctggcggacacgcgccggccgtggctcgcgtggtacgacgtctacgtcgaatcggtanacg

SEQ ID NO: 26577 - DNA, 760 bp, Homo sapiens
  misc_feature: GYAE6OF02J2EGB.16.1.A01.1.454.CMB.1.raw
  modified_base (160)..(160): a, c, t, g, unknown or other
  misc_feature (160)..(160): n is a, c, g, or t
  modified_base (371)..(371): a, c, t, g, unknown or other
  misc_feature (371)..(371): n is a, c, g, or t
  modified_base (407)..(407): a, c, t, g, unknown or other
  misc_feature (407)..(407): n is a, c, g, or t
  modified_base (432)..(432): a, c, t, g, unknown or other
  misc_feature (432)..(432): n is a, c, g, or t
  modified_base (676)..(676): a, c, t, g, unknown or other
  misc_feature (676)..(676): n is a, c, g, or t
  modified_base (688)..(688): a, c, t, g, unknown or other
  misc_feature (688)..(688): n is a, c, g, or t
tcagtgtactactccacgaccggtgctcgatttagacgtctcatcgagggggtctcaggaggcagcgctctcaggacatcctccaccatggcctgggctctgctcgcctcctccaccctcctacactcgaggcacgtcgggtcctacggccctagttccnccgacctgactcacgtcctcgtcctccgtgtccgtcggtcctaccgtaggacctcgtaccactacccacctctccgtcgtacgacctaacggtaaccgaacctacgttgttacgtacggttgtattaacttacgttcttcgtacctaccgaaccgaaaccaaccaaccgaccgacgaaaccccacccgtaacctaatctagtactagttanacgttactcgacgtaccgccgactagggtacttacnctcggttctcgtacgcgtcgtaacncgctaccgcgaaccaccgttcccgtacgtcccgtacttccgtcgtaccccgtacgaccgttacgcggacgttacgggacgttacctacgtcgttaactcctttacgaccgtaaccttaccgaaacgtttacgtaaagttacggtacttaaaaccgttccttaccgttacggttttacggttccgggttaacgggttaaccgcggtaaaaccgtcgtaacccggtcgtacccgttcgggtaaccncccggttaaccnggttaaaccccgttcgccccgtttacccgtcccgtttacggccctttacccgttccccggtaccgttacccg

SEQ ID NO: 26578 - DNA, 631 bp, Homo sapiens
  misc_feature: GYAE6OF02F1ITW.16.1.A01.1.454.CMB.1.raw
  modified_base (296)..(296): a, c, t, g, unknown or other
  misc_feature (296)..(296): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaacgcccccaaactcatgatttanggaggcaagtaagcgccctgaggtatttcaatcgcttctctcggcctccgacgttcgtcgcaaacgcggccctccctagacaactctctcgcctccaggctggacggacgaggtctagtaatttattacgtgtctgtcctactaattacttacgtaacgttcgttacgttactaactttagttcgttcggttttttacgggacgggtaacggggtaccgtaaagggtacgggtaacccggttccggttaacgggttacccgtaccgtaccccggtaacgggtacccgttacccggtaccccccgttaccgggttaccctaacccgtttcccccgg

SEQ ID NO: 26579 - DNA, 664 bp, Homo sapiens
  misc_feature: GYAE6OF02G2BIP.16.1.A01.1.454.CMB.1.raw
  modified_base (232)..(232): a, c, t, g, unknown or other
  misc_feature (232)..(232): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctcgtgtctgggtctctggacagtcgatcaccatctcctgcacgtggaaccaacattgacgttggtnattataactttgtctcctgtaccaacaaccaccaggacaaacgcccccaaactcatctatttatgaagtctactaacggccgccctcgagggtatactaatcgtcttctctgctactagtctgacaacgccgccctccgtcgacccgtctcgtcggccctaccgacgtacgtacggacgggacggacggtcgttagtaactttacttaacgtcgtaccctaccgtaactaattaagtaagtaaaggttaacgttaacctttacccgttccgtttagggtttaccggggttttaccgggtacggggtaacggtaaccgtaacggccgttacggtacccgttaccggtacggtaccaaccggtacccgaaccggtccctacccggtcccccggtttccgtacccgttaccttccggttccccgttaccccccgg

SEQ ID NO: 26580 - DNA, 574 bp, Homo sapiens
  misc_feature: GYAE6OF02FVQAE.16.1.A01.1.454.CMB.1.raw
  modified_base (426)..(426): a, c, t, g, unknown or other
  misc_feature (426)..(426): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
tcagtgtactactccacgaccggtgctcgatttagacgtctcatcagggggtctcagggaggcagcgctctcaggacatctccaccatggcctgggctctgctgctcctcaccctcctcactcagggcacagggtcctgggcccagtctgccctgactcagcctgcctccgtgtcgtgggtctcctggacaggtgatcaccatcctcctgcacgtaggaaacccaactagttggacgttgggtagtatttaattaacttttgtcctcctaggtacccaaacaaccacccaggaccaaacgaccccccaaactcatactatttatgtaagtctctaacgccggccctcgaagggtatactaagtcgtcttctctggtctacaagtcgtgacacaccggcctccgagaccactctcgtggtcctccgngcgtggaggacgtagggtatnttatcgtgcagctnatagtaagagtgcagctacgtcttagtcgtcggcgggttacggacacggtacctcgtaccgtcggtacgccgaacggtcccgacgtccgtacccggccccgtcggtacctccg

SEQ ID NO: 26581 - DNA, 664 bp, Homo sapiens
  misc_feature: GYAE6OF02I4IE8.16.1.A01.1.454.CMB.1.raw
  modified_base (235)..(235): a, c, t, g, unknown or other
  misc_feature (235)..(235): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcactaggaaccaacattgacgttggtntattataactttgtctcctggtaaccaacaaccaccaggaccaaacgacccccaaactccatctatttatgtaagtctataacgccggtcctacgagggtatctaatcgtcttctctcgctacgagtcgtgcaacagtcgccctccgtacgacctctcgtccgtcctacgacgtcgaggaacggacggtacggacgttacgtaatttacgttacgtcgacctactactagttaacgtaacgttaagttaaccgttacttaccgttcgtttagggtttccgggtttaacgggaccgggtaaacgggtaccgtaacggtccgttaaccggtacccggttacgttaccggtacgtaacccggtaacccggtacggtacccgtaccccggttaccccggttcggtacccgttaccgttcccgtttacccccgg

SEQ ID NO: 26582 - DNA, 606 bp, Homo sapiens
  misc_feature: GYAE6OF02I2D85.16.1.A01.1.454.CMB.1.raw
  modified_base (316)..(316): a, c, t, g, unknown or other
  misc_feature (316)..(316): n is a, c, g, or t
  modified_base (353)..(353): a, c, t, g, unknown or other
  misc_feature (353)..(353): n is a, c, g, or t
  modified_base (389)..(389): a, c, t, g, unknown or other
  misc_feature (389)..(389): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaagggcctggagtggattgggtacatctattacactgggagcacctactacaaccccgtccctgaagagtcgagctaccatattagttgacccgtntaaggaaccaattcctccctgaacgatgaccttttgngactgccgcgacacggcctctactactgtgcgaggnggtggagtcggaggtctttgatttcgtggggtcgaagggacaggtggtcaccgtctctacacgcctaccacgaacggcccatccggttccttcccccgtgcccaccctccgtaccgaacgcgccaccgttccggtcgggtaccacgcggccggtcccgtcgggtcctcggcccgtggtacgacggtaccttaccgtcccgtaagttacgtacgtacg

SEQ ID NO: 26583 - DNA, 455 bp, Homo sapiens
  misc_feature: GYAE6OF02GIP0P.16.1.A01.1.454.CMB.1.raw
  modified_base (425)..(455): a, c, t, g, unknown or other
  misc_feature (425)..(455): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggtctttttgatttcgtggggccaaggggacagtggtcaccgtctcttcagcctccaccaagggcccagtcggtccttccccctggccaccctcctccaagagccacctcgtgggggcacgacgccggcccgtgggcctcgccgtggcaaggactactcgagtacgtacactgagcgggctggcaacggcgcatagnnnnnnnnnnnnnnnnnnnnnnnnnnnnnnn

SEQ ID NO: 26584 - DNA, 716 bp, Homo sapiens
  misc_feature: GYAE6OF02HCHEB.16.1.A01.1.454.CMB.1.raw
tcagtgtactactccacgaccggtgctcgatttagacgtctcatcagggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggacagtcgatcaccatctcctgccacgtggaaaccaactgttagacgttggtagaatttataacttttgtctccgtggtaccaacaaccaccagaccaaacgcccccaaactcactacatttatagaagtctacgtaacgccggccctgacggggttatactaatccgtacttcctcgtcggctaccgtacgtctacggtaccaaaccgtaccggacccttaccctcggtaacccgtctcgttccggcctacccgagtaccgttaggacgggacgacggacgttagtagtttaacttactccgtacctacttccgaaattacttaaggtaacgtaacggttaaccttaccgtttccggttacggttttcgggttttacccgggtacgggtaaacccggggtaactaacggtccgttaccgggtacccgtttacccgtaacgggtcctaaacccggacccgtaacggggtcccttaccccggcccccggtttacgggaccttaacccggttccttccggttaaccccccc

SEQ ID NO: 26585 - DNA, 777 bp, Homo sapiens
  misc_feature: GYAE6OF02JW90E.16.1.A01.1.454.CMB.1.raw
  modified_base (190)..(190): a, c, t, g, unknown or other
  misc_feature (190)..(190): n is a, c, g, or t
tcagtgtactactccacgaccggtgctcgatttagacgtctcatcagggggtctcaggaggcagcgctctcaggacatctccaccatggcctgggctctgctgctcctcaccctctcactcacggcacagggtcctgggcccagtctgccctgactcagcctgcctccgtgtctcgggtctccgtggacngtcgatccaaccatcctcgtgacctactacggaacccaaacgtacttgtacggttggtagtaatttacgttactttgtcctccgtaggtaaccaacgtaaccacccgaggacccaaaaccggtacccccctaaatccgtaactaccctaattttaacgtacgtaaacgttcctaccgtaaacggtcccggtacccttacgggtaacggggttaacctacgttaaacgtcgtccgttacctacgtcggtacctacgtaacggtccgtagaccctaaacgtcccggtacccttacccgtacggttaacccgttctaccgttccggacccttacgacggtaccgtacgggacgggtaacgcggttcgttaacgtagtttaactaccgtccgtaacccgtctaaccgtaattaacggtaggtaaacttaccggttaaccttacccggttacgtttcggggtttccggtttaccggggacggtaaacccgggactacgggtccgtaccggtaccgttaccgtggtaccaccggtaccacggtcccgtacccgtccccggtacgtaccctccgttccgtaccccgttaccccg

SEQ ID NO: 26586 - DNA, 603 bp, Homo sapiens
  misc_feature: GYAE6OF02GQ2NR.16.1.A01.1.454.CMB.1.raw
  modified_base (261)..(261): a, c, t, g, unknown or other
  misc_feature (261)..(261): n is a, c, g, or t
  modified_base (392)..(392): a, c, t, g, unknown or other
  misc_feature (392)..(392): n is a, c, g, or t
  modified_base (421)..(421): a, c, t, g, unknown or other
  misc_feature (421)..(421): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaagggcctggagtggattgggtacatctattacactgggancacctacacaacccgtccctgaagagtcgagctaccatattagttgacccgtctaggaaccaattctcccctagaacgatagaccttttgtgactcgccgcggacacgggccgtctactactgtgcgaggnggtggagtcggagggtcttttgatttcgnggggccaagggcagtggtcaccgtctcttcgacgcctccgaccgacggcccacgtccggtccttccccgcggcctaccctccgtaccaagacgcaccgtcgtggggaccacgacgccggtcccggtggccgtcgtcccgtggtaccgaacggacttaccgttccggacgttacgacctaacg

SEQ ID NO: 26587 - DNA, 623 bp, Homo sapiens
  misc_feature: GYAE6OF02F6ZWZ.16.1.A01.1.454.CMB.1.raw
  modified_base (267)..(267): a, c, t, g, unknown or other
  misc_feature (267)..(267): n is a, c, g, or t
  modified_base (332)..(332): a, c, t, g, unknown or other
  misc_feature (332)..(332): n is a, c, g, or t
  modified_base (354)..(354): a, c, t, g, unknown or other
  misc_feature (354)..(354): n is a, c, g, or t
  modified_base (393)..(393): a, c, t, g, unknown or other
  misc_feature (393)..(393): n is a, c, g, or t
  modified_base (412)..(412): a, c, t, g, unknown or other
  misc_feature (412)..(412): n is a, c, g, or t
  modified_base (445)..(445): a, c, t, g, unknown or other
  misc_feature (445)..(445): n is a, c, g, or t
  modified_base (524)..(524): a, c, t, g, unknown or other
  misc_feature (524)..(524): n is a, c, g, or t
  modified_base (545)..(545): a, c, t, g, unknown or other
  misc_feature (545)..(545): n is a, c, g, or t
tcagtgtactactccacgaccggtgctcgatttagacgtctcatcagggtgtccttgggttttggggggaagaggaagactgacggtccccccaggagttcaggagtcgggcccaggactggtgaggccttcagagacccctctccctcacctgcgcggtctctggtgactccatgaacagtggtcggtacctacgtgggagctggatccgccagcagccagggaaggcctggagtggattgggtacatcgtattacacgtgggacncctaacctactaccaacccgttccctagaacgagtcgagcctaccgatattagtcgaccccgttnaggaaccctattcctcctgaantgtacctttgagaccttgccgacggtacactgcccgttntaacctagtgtcgcgaggnggtggaacgtcggagggtcttttagatttcggngggacccaagggactaggtcggtaccacgtctccttcgacgtcctaccaccgaacggcccaagtccggtccttccccgngcctaccctccgtacaacgcnccaccgttcggcgggcaccgcggccggtcccgtaggcctcgccgtggtaccaggtcctaccgtaccgagtcgtaaccg

SEQ ID NO: 26588 - DNA, 760 bp, Homo sapiens
  misc_feature: GYAE6OF02F5LWW.16.1.A01.1.454.CMB.1.raw
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
tcagtgtactactccacgaccggtgctcgatttagacgtctcatcagggggtctcaggaggcagcgctctcaggacatctccacatggcctgggctctgctgctacctcaccgtcctacactcgagggcacgacgggtcctgggccaggtctcgcctgactcagcctgcctcgtgtctgggtactccgtaggacncgtcgacnccaacgntcctaccgtgactcgtagaaacccaatgttcggaacgtttgggactaatttcgttaacttttcgtctaccgttacggtaaccaaacgaactaaccgtacgaccgaaaccgtaaccccaaactcgtaactacttaactttagtactaacggtcctacgtaacggtccggacccgtcggtaagggttacctacgttaaacgtcgtacgtttacgtcgtcgtaccgttaacgacggtttcgtacgggtaccaaaccggtccgggtacccttcccgtaccggttaccgttaccgtttcggttaaccggtccgtttaaccgacgttaacggttcggggaaacgggtacggtacggtaacggtataaacggttttacgttaaccgtacggtcctacgtactaagtacgtaaggtaacgtaagtaccttacgtccgttagggtttacggttcgggaacggtacgtaaccgtacgtcgtacgtaccgtacggtacgtaccgaacgtcccgaacgtaccgcccgttaccgtccggtaactccgttccgtacctaccccg

SEQ ID NO: 26589 - DNA, 782 bp, Homo sapiens
  misc_feature: GYAE6OF02HBK9J.16.1.A01.1.454.CMB.1.raw
tcagtgtactactccacgaccggtgctcgatttagacgtctcatcagggggtctcaggaggcagcgctctcaggacatctccaccatggcctgggctctgctgcctcctcaccctcctcactcgagggcacagggtcctgggcccagtctgccctgactcagcctgcctcgtgtctgggtctccgtggactagtcgactcaacctatcctccgtaacacgtacggaaaccaactagttcgaacggtttgggtagtaactttaattaaacttttcgttaccgttccgttacggttaacccaaaaccaaaccaaaccccgtaacgggaaccaaaaaccgacccccccaaaaactacctaattacctaaagttttaataacgtaacgttaccttaacgtaaacggtccggtacccgtacggtaacgggggttaactacgttaaacgttcgtaccgttttcttcgttacggaccttaaccgtaacgttaccgttacgggaacctaaacccggaccggtaccccgttacccgtacgtaacccgttccgtaccgtacgggtaccctaccgtacgtaacgtacggaacggtacggtaacggtacgtacgtaatttaacgtactcgacctactactaagttaaactaagtaagtacgtactaccgtactttgggtttacgggtttacggaccggaagggtaaccaacgtcgtacgtaccgtacgtacggtaccaccgaccgtacgcgtcccgtacccgtcgtaccacgttcctaccgtcccttaaccccg

SEQ ID NO: 26590 - DNA, 859 bp, Homo sapiens
  misc_feature: GYAE6OF02HWPFG.16.1.A01.1.454.CMB.1.raw
  modified_base (191)..(191): a, c, t, g, unknown or other
  misc_feature (191)..(191): n is a, c, g, or t
  modified_base (407)..(407): a, c, t, g, unknown or other
  misc_feature (407)..(407): n is a, c, g, or t
tcagtgtactactccacgaccggtgctcgatttagacgtctcatcagggggtctcaggaggcagcgctctcaggacatctccaccttggcctgggctctgctgctcctccaccctcctcactcgagggcacgagggtcctcgggcccagtctcgcctgacctcagcctgccttcgtgtcgtcggtctccgnggactagtcgactcacctatcctcctgcactacggaaacctactagttcgtacggttaggtagttaatttaacgttactttcgtaccttccgttacggtaacctaaaccgaaccaacccggaacggaccaaaacccgtacccccaactctaactactatttacagtactctacgtacgccggtccctaggtacgggtataccgttaacgtccgttnttccgtcgttaccgtacttaaccgtacgtacggtcggtaaccgaaaccggtacccggtccccgttaccctaccgttaacccgttccgttcctcccggtacccctacgtaaccggttcggtaacggaacgggtaccgcggggttaaccttaacgttaacgtttaacccgttacggtaacccgtaaccttcgttaactaaacgtttaacggtaaaggttaaaccggttaacttaaacccgtttacccggttaccgttttggggttttaccggggtttaccggggaaccggggtaaccccgggtaacgtaaccgggtacggtttaccccgtaaaccgggtttcccggtaacggtcccgtaaacccgggtccgggaaacccggttcccgtcccccggtaccggttacccggtacccgttaacccgtttcccgtaaccccgttcccccttaccccgg

SEQ ID NO: 26591 - DNA, 728 bp, Homo sapiens
  misc_feature: GYAE6OF02GRT63.16.1.A01.1.454.CMB.1.raw
  modified_base (328)..(328): a, c, t, g, unknown or other
  misc_feature (328)..(328): n is a, c, g, or t
  modified_base (369)..(369): a, c, t, g, unknown or other
  misc_feature (369)..(369): n is a, c, g, or t
tcagtgtactactccacgaccggtgctcgatttagacgtctcatcagggggtctcaggaggcagcgctctcaggacatctccaccatggcctgggctctgctgctcctcaccctcctcactcgagggcacgagggtcctgggcccagtctcgccctgactcagcctgcctccgtgtcgtgggtctccgtgactagtcgatccacctatcctcctgcctacgtacgaaaccaactagttcgtacgttgggtataatttaacttaacgtttgtccttccgtaggtaaccaacaaccaccgacgacaaaccaccccaactcatactattanacgatctacgacgcgcctaggaggtactacgtatctcttcnctcgtctacgtagtcgacgacaacgaccgtccctccgagtccgtctcgtccgcctacgagtacgtggaacggtacgtacgtacgttacttaattaccgttacgtaccgtaccttaacgttaactaagttaaacgtaggttaaacgttaaacgttcccttaaccgtttcgtttcggggttttacgggttaccgggaaacgggtaccggtaaacgtaaccggtacgttacccgggtaacccggtttcggtaaccggttaacccggtaccggtaaccccgtaacggttcccgtacccccggtaacccccgggtttaccgtacccggtttaacccttcccgtttaccccgggttaaccccccc

SEQ ID NO: 26592 - DNA, 993 bp, Homo sapiens
  misc_feature: GYAE6OF02HD2TW.16.1.A01.1.454.CMB.1.raw
  modified_base (189)..(189): a, c, t, g, unknown or other
  misc_feature (189)..(189): n is a, c, g, or t
tcagtgtactactccacgaccggtgctcgatttagacgtctcatcagggggtctcaggaggcagcgctctcaggacatctccaccatggcctgggctctgctgctcctcaccctcctcactcagggcacgagggtcctgggcccagtctgccctgactcagcctgcctcgtgtcgtgggtctcgtgacngtcgactcacctatcctacctactacgtacggaaacctaactagttcggtacggtttggtagttaacttttaacgtttaacgttttccgttccgtttaccgttaaccggttaaaccccaaaaaccgtaaaacccgtaaccccgaacgggtaaaccccaaaaccccggtaaccccccctaaaaccgtacctaacttaccgtttaaactttttaacgtaacggtaacgtttacccgttaaccggtaaacccgggtccccggggttaccccgtacgggggtaagggtttaccttaaccgttaaccgttccggtttccttcccgttacggttacccggtaccgttaccgtaaacggtttccgtaaccggtaacccaaacccgggtcccggttaccccctttacccgggtacccggttaaccccggtttccgttcccgggttaccggtaccccgttaccgtaacggtaacgggtacggggaacgggtaacgggacggttactttacgttaacttttacgtacccgtaccgtaacccttaattactaacgttaaagtaacggttaaacgttaaccgtttaaccgtcccggttttaccggtttacggggttttacggggtttaccggggtaaccgggaaccgggtaaccgtaacggtccggtaacccgggttccccggttaacggttaacccgggtacccggtaacccgtaacccgggtaccgggttaccccggtcccccgttacccccgggtttacgtacccctttaccggtttaccccgttttcccccggaccccctttaacccccggg

SEQ ID NO: 26593 - DNA, 431 bp, Homo sapiens
  misc_feature: GYAE6OF02GP60E.16.1.A01.1.454.CMB.1.raw
  modified_base (418)..(431): a, c, t, g, unknown or other
  misc_feature (418)..(431): n is a, c, g, or t
tcagtgtactactccacgaccggtgctcgatttagacgtctcatcagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcgggagggtctttttgatttcgtggggccaaggggacaggtggtcaccgtctcttcagcctccaccaagggcccatcggtcttccccctggccaccctcctccaagagcacctctggggcacagcggccctgggctgcctggtcaaggactacgtccgagtagtacactggagcgggctggcaaggcgacatagnnnnnnnnnnnnnn

SEQ ID NO: 26594 - DNA, 740 bp, Homo sapiens
  misc_feature: GYAE6OF02IRV6E.16.1.A01.1.454.CMB.1.raw
  modified_base (179)..(179): a, c, t, g, unknown or other
  misc_feature (179)..(179): n is a, c, g, or t
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
tcagtgtactactccacgaccggtgctcgatttagacgtctcatcagggggtctcaggaggcagcgctctcaggacatctccaccatggcctgggctctgctgctcctccaccctcctcactcgaggcacgagggtcctcgggcccagtctcgccctgacctcacgcctcgcctccgtntcgtcggtccncgtggactagtcgatccactntcctcgtagcctacgtacggaaaccctaanagttcggtacggtttggtagtatttaactaacgtttcgtcttacctacggtaccaaaccgaaccaccgtaacgaaccgtaaaacccgaccccctaaactacctaacgtccttaacttacgtaggtaactccttaactaaccgccgggtccctagggtaaggtaacttacgtactccgtacttcgtctacgcccgttacctagtccgtacggctaaaccggtccggcccttaccgtcggttacccgttcgtaccgttcccgacccgttaccgtaacgtacccgtaacggtacgggaacggtgggtaccgttaagtaacgttaacgtacgtaccgtacctacctaactagttaagttaacggtaacgttaacgttacccgttacgtccggttaacgtttacgggtttaccgggacggtacggtaccgagtccgtacgtacgtacgtcgtacgacgtaccggtacgcccgtaccgtccccgtgactcccgtacgtctccccg

SEQ ID NO: 26595 - DNA, 698 bp, Homo sapiens
  misc_feature: GYAE6OF02IU04Z.16.1.A01.1.454.CMB.1.raw
  modified_base (211)..(211): a, c, t, g, unknown or other
  misc_feature (211)..(211): n is a, c, g, or t
  modified_base (323)..(323): a, c, t, g, unknown or other
  misc_feature (323)..(323): n is a, c, g, or t
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
tcagtgtactactccacgaccggtgctcgatttagacgtctcatccaggggggtctcagggaggcagcgctctcagacatctccaccatggcctgggctctgctgctcctcaccctcctcactcagggcacagggtcctggggcccagtctgccctgactcagcctgcctcgtgtcgtggtctctgactgtcgatacacctactctacctncgactacggaaaccaatagttgtaccgttggtagtattattaacgtttcgtcctccgtagtaccaaacaccgaccgacgacaaccgaccccaactcactactaagtttacgngtaacgtcctacgtaacggtccggccctacggtagggttactactacgtccgttccttcgtcgtacggctacgtaacgtctacgacgaactccggacctcccgacggtaccctcgtcgttccggtccctaacgacgtatacgggacggttacgcgggtacttaagtaacgttttacgtaaccgttccgtactaccgttanaacgtttanaacgggttaaagttaccgtaaccttaccgtttacgttcgggtttaacgggttccgggacggggtacgaaaccgtagtcccggttacgtacccggttacgtgtaccgtacggtccgacgtccgtcccggtcccgtaccggtaccttaccggtccttcccgtccccgg

SEQ ID NO: 26596 - DNA, 812 bp, Homo sapiens
  misc_feature: GYAE6OF02F88ZP.16.1.A01.1.454.CMB.1.raw
  modified_base (331)..(331): a, c, t, g, unknown or other
  misc_feature (331)..(331): n is a, c, g, or t
tcagtgtactactccacgaccggtgctcgatttagacgtctcatcagggtgtccttgggtttgggggaagaggaagactgacggtcccccaggagttcaggagtcgggcccaggactggtgaggccttcagagaccctctccctcacctgcgcggtctctggtgactccatgaacagtggtggtacctactggagctggatccgccagcagccaggggaacggcctggagtggagtttgggtacagtcctattacacgtgggagcaccgtacaccaaccccgtcctagaagagtacgagtctaaccgattattagttacgaaccccggttntaacggaaaccctaattcccgtccccgtaggaaacgtactcgtaacccttttgtcgaacctcggtacccggacgggtaacctaaccgggcccgttccgttaacctaccgtggttacgacggtaagggtacggtggacggttacgggagggttcttttaggacgttttcggagggggtaccgtaaaggggaccgtagggtacggtaccgtaaccggttctttccgttactacggtacccctaccgtaacccggaaccggggccctaacgttcccggttacccgtttcccccgtcgggcccctaacccccgttcccgtaccccgtaacggaccgtaccgtaacccgttccgggtacgggggaccctacggaccgggtaccccggacccggtacggggcccgttaacgggttccgtaccggggttaccgtaaacggtaccgtttaaccgttaacccggaacggtttaaccggtaccgttaacgg

SEQ ID NO: 26597 - DNA, 930 bp, Homo sapiens
  misc_feature: GYAE6OF02H9XQ8.16.1.A01.1.454.CMB.1.raw
  modified_base (171)..(171): a, c, t, g, unknown or other
  misc_feature (171)..(171): n is a, c, g, or t
tcagtgtactactccacgaccggtgctcgatttagacgtctcatcagggggtctcaggaggcagcgctctcaggacatctccaccatggcctgggctctgctgcctcctcaccctcctcactcgagggtcacgacgggtcctcgggcccagttcctcgccctagacctacngcctgcctccgtgtcgtggtcctcctaggacacgttcgactccaacctatcctcctacggcctaacgtacggaaaccaacttagttacggtacggtttgagttaactttaacgtttaaccgttttcgtcccgtttacccgttacggttaaacccaaaacctaaaaccccaaccccggtaacggtaaccccgaaaaaccccggtaaaccccccctaaaacgttaccctaatacccctttaagtttttaaccgttaacggttaaacgttaccgttaaccggtaaccgggtaccccggtacccccgtttaacgggtaacgggggttaacttaaccgtttaaccggttccggttaccttttccgtaccgttaccggttaccttaccgtaaccggttcgtaccgggtaaccaacccggtaccccggtcccttaacccggttcccggtaacccgtttcccggttccgtttaccggtaccccgttaacgtaacccggtaaccggttacggaaacggggacccgttacggtaccgttaggttaaccttttacgttacccgtaccttaaccttaacgtacgttaagtaacgtaaacggttagtttaaacgttaccgttccttacggttcgggttacgggtttaccggacgggcgtaaccgcggtacgtaccggacccgtttacggtacgtaccgtaaccgcccgtaacgtcccgtacccggttccccgtccgttacccggtcgtttaccccgtcccgttaaccccccg

SEQ ID NO: 26598 - DNA, 732 bp, Homo sapiens
  misc_feature: GYAE6OF02GYWEN.16.1.A01.1.454.CMB.1.raw
  modified_base (157)..(157): a, c, t, g, unknown or other
  misc_feature (157)..(157): n is a, c, g, or t
  modified_base (183)..(183): a, c, t, g, unknown or other
  misc_feature (183)..(183): n is a, c, g, or t
  modified_base (238)..(238): a, c, t, g, unknown or other
  misc_feature (238)..(238): n is a, c, g, or t
  modified_base (468)..(468): a, c, t, g, unknown or other
  misc_feature (468)..(468): n is a, c, g, or t
tcagtgtactactccacgaccggtgctcgatttagacgtctcatcagggggtctcaggaggcagcgctctcaggacatctccaccatggcctgggctctgctgctcctcaccctcctcactcaggcacaggtcctgggcccagtctgccctgactcngctgcctcgtgtctggtctctggacncgtgaactcaacctatctcctgctaccgtgaaacctaactagttcgacgttggtnaatttactacttttgcttcgtacgtaaccaaataccaaccgacggtaccaaaccgaacccctaactacgtactacgtattactacggtaactcctaacgtaacggtccgcccgtaggtaacgggtacttaacgtacttaccgtctttacgtcgacgggtaccttaccgaactccgtacgaaccgaacgtacccgtcctacccaggtaccctcgtacgttccggcgtaccncgtaaacggcgtacgggacgggtaaacgtcggtaaacgttagtttaaccgtttacgtacgtacgtaccttaccggtaacttaaagtaacggttaacgggtaaaggttaccgtacgtaacggtacccttacgttacggttaccgttacggtacggttacggggacctaccggaacgttccgtcccgggttaaccgttcggaacggacccttacgggaccctaacgggtccccgttaacccggtcccgtccggttacccttaccgg

SEQ ID NO: 26599 - DNA, 692 bp, Homo sapiens
  misc_feature: GYAE6OF02G5ZZ7.16.1.A01.1.454.CMB.1.raw
  modified_base (116)..(116): a, c, t, g, unknown or other
  misc_feature (116)..(116): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (457)..(457): a, c, t, g, unknown or other
  misc_feature (457)..(457): n is a, c, g, or t
  modified_base (491)..(491): a, c, t, g, unknown or other
  misc_feature (491)..(491): n is a, c, g, or t
  modified_base (664)..(664): a, c, t, g, unknown or other
  misc_feature (664)..(664): n is a, c, g, or t
tcagtgtactactccacgaccggtgctcgatttagacgtctcatcaggggtctcaggaggcagcgctctcaggacatctccaccatggcctgggctctgctgctcctcaccctctnactcaggcacgagggtcctggcccagtctagccctgactcagcctgcctaccgtgtcctgggtctcctaggactcgtgactccgaacctntcctaccgtanaccggtacgaaacctaactagtttcggaacggtttggatattaacttacttttcgtccttcgtacgtaccaaccgaaccaccgtagaccaaaccacccctaaactcaagtctaatttacgagtaatcctacgaacgtccgaccgtagagggttatacgtaactcgttccttctacgtgtcctactaacgtcgtacgacaccgtaccggtccctccgaccgtccgtactccgtcgtacccnccgacgtacgtacggagggaccgtagttaacgtnttaattaacgtccgttaccacctaccgtataactaagaagttaacgtaacgtaccttaccttcggttacgtttacggttccgggacgggttacgggaaactcgttccgtaccggtacccgtaggtacccgtagtaccgggccctaaggcccgtacccgtccctacggtacccnccgttacccgttccgtacccctacccgg

SEQ ID NO: 26600 - DNA, 252 bp, Homo sapiens
  misc_feature: GYAE6OF01AKYT4.47.83.H06.1.454.CMB.1.raw
  modified_base (229)..(252): a, c, t, g, unknown or other
  misc_feature (229)..(252): n is a, c, g, or t
tcagagctcacgtacacgaccggtgctcgatttagatcacgtgcgtcgcggggcccaggcagatgattgagtgtgattattacgtggtgtgctctatatgggcagtggcgtttggtgttcggcggaggccaagctgaccgtcttaggtcagcccaaggctgccccctcggtcactctgttcccgcccttcctctacgtgagctctgagcgggctggcaaggcgcatagnnnnnnnnnnnnnnnnnnnnnnnn

SEQ ID NO: 26601 - DNA, 230 bp, Homo sapiens
  misc_feature: GYAE6OF01BND74.47.83.H06.1.454.CMB.1.raw
  modified_base (228)..(230): a, c, t, g, unknown or other
  misc_feature (228)..(230): n is a, c, g, or t
tcagagctcacgtacacgaccggtgctcgatttagatcacgtgcgtcgcggggcccaggcagatgatgagtgtgattattactgtgtgctctatatgggcagtggcgtttgggtgttcggcggagggaccaagctgaccgtcttaggtcagcccaaggctgccccctcggtcactctgttcccaccctcctctacgtgagctctgagcgggctggcaaggcgcatagnnn

SEQ ID NO: 26602 - DNA, 229 bp, Homo sapiens
  misc_feature: GYAE6OF01DA69D.47.83.H06.1.454.CMB.1.raw
  modified_base (228)..(229): a, c, t, g, unknown or other
  misc_feature (228)..(229): n is a, c, g, or t
tcagagctcacgtacacgaccggtgctcgatttagatcacgtgcgtcgcggggcccaggcagatgatgagtgtgattattactgtgtgctctatatgggcagtggcgtttgggtgttcggcggagggaccaagctgaccgtcttaggtcagcccaaggctgccccctcggtcactctgttcccaccctcctctacgtgagctctgagcgggctggcaaggcgcatagnn

SEQ ID NO: 26603 - DNA, 232 bp, Homo sapiens
  misc_feature: GYAE6OF01ETDU8.47.83.H06.1.454.CMB.1.raw
  modified_base (228)..(232): a, c, t, g, unknown or other
  misc_feature (228)..(232): n is a, c, g, or t
tcagagctcacgtacacgaccggtgctcgatttagatcacgtgcgtcgcggggcccaggcagatgatgagtgtgattattactgtgtgctctatatgggcagtggcgtttgggtgttcggcggagggaccaagctgaccgtcttaggtcagcccaaggctgccccctcggtcactctgttcccgccctcctctacgtgagctctgagcgggctggcaaggcgcatagnnnnn

SEQ ID NO: 26604 - DNA, 230 bp, Homo sapiens; identical to SEQ ID NO: 26601
  misc_feature: GYAE6OF01ECBJD.47.83.H06.1.454.CMB.1.raw
  modified_base (228)..(230): a, c, t, g, unknown or other
  misc_feature (228)..(230): n is a, c, g, or t

SEQ ID NO: 26605 - DNA, 228 bp, Homo sapiens
  misc_feature: GYAE6OF01CB4A0.47.83.H06.1.454.CMB.1.raw
  modified_base (227)..(228): a, c, t, g, unknown or other
  misc_feature (227)..(228): n is a, c, g, or t
tcagagctcacgtacacgaccggtgctcgatttagatcacgtgcgtcgcggggcccaggcagatgatgagtgtgattattactgtgtgctctatatgggcagtggcgtttgggtgttcggcggagggaccaagctgaccgtcttaggtcagcccaaggctgcccctcggtcactctgttcccaccctcctctacgtgagctctgagcgggctggcaaggcgcatagnn

SEQ ID NO: 26606 - DNA, 228 bp, Homo sapiens
  misc_feature: GYAE6OF01BLBPT.47.83.H06.1.454.CMB.1.raw
  modified_base (228)..(228): a, c, t, g, unknown or other
  misc_feature (228)..(228): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgccccctggtcactctgttcccaccctcctctacgtgagctctgagcgggctggcaaggcgcatagn

SEQ ID NO: 26607 - DNA, 233 bp, Homo sapiens
  misc_feature: GYAE6OF01AGED4.47.83.H06.1.454.CMB.1.raw
  modified_base (228)..(233): a, c, t, g, unknown or other
  misc_feature (228)..(233): n is a, c, g, or t
tcagagctcacgtacacgaccggtgctcgatttagatcacgtgcgtcgcggggcccaggcagatgatgagtgtgattattactgtgtgctctatatgggcagtggcgtttgggtgttcggcggagggaccaagctgaccgtcctaggtcagcccaaggctgccccctcggtcactctgttcccaccctcctctacgtgagctctgagcgggctggcaaggcgcatagnnnnnn

SEQ ID NO: 26608 - DNA, 249 bp, Homo sapiens
  misc_feature: GYAE6OF01B4NSS.47.83.H06.1.454.CMB.1.raw
  modified_base (146)..(146): a, c, t, g, unknown or other
  misc_feature (146)..(146): n is a, c, g, or t
  modified_base (231)..(249): a, c, t, g, unknown or other
  misc_feature (231)..(249): n is a, c, g, or t
tcagagctcacgtacacgaccggtgctcgatttagatcacgtgcgtcggcggggcccaggcagatgagtgagtgtgattattactgtgtgcctctatatgggcagtggcgtttgggtgttcggcggagggaccaaggctgaccgtnttaggcagcccaaggcctgcccctggtcactctgtccccgcctctctacgtgagctcgtgagcgggtctaggcaaggcgcatagnnnnnnnnnnnnnnnnnnn

SEQ ID NO: 26609 - DNA, 230 bp, Homo sapiens
  misc_feature: GYAE6OF01BRM3C.47.83.H06.1.454.CMB.1.raw
  modified_base (228)..(230): a, c, t, g, unknown or other
  misc_feature (228)..(230): n is a, c, g, or t
tcagagctcacgtacacgaccggtgctcgatttagatcacgtgcgtcgcggggcccaggcagatgatgagtgtgattattactgtgtgctctatatgggcagtggcgtttgggtgttcggcggagggaccaagctgaccgtcttaggtcagcccaaggctgccccctcggtcactctgttcccgccctcctctacgtgagctctgagcgggctggcaaggcgcatagnnn

SEQ ID NO: 26610 - DNA, 253 bp, Homo sapiens
  misc_feature: GYAE6OF01CLASY.47.83.H06.1.454.CMB.1.raw
  modified_base (232)..(253): a, c, t, g, unknown or other
  misc_feature (232)..(253): n is a, c, g, or t
tcagagctcacgtacacgaccggtgctcgatttagatcacgtgcgtcggcgggggcccaggcagatgatgagtgtgattattactggtcgtgctctatatggggcagtggcgtttgggtgttcggcggagggaccaagcctgaccgtcttaggtcagcccaaggctgccccctggtcactctcgttcccacctcctctacgtgagctctgagcggctggcaaggcgcatagnnnnnnnnnnnnnnnnnnnnnn

SEQ ID NO: 26611 - DNA, 267 bp, Homo sapiens
  misc_feature: GYAE6OF01CZRM6.47.83.H06.1.454.CMB.1.raw
  modified_base (236)..(267): a, c, t, g, unknown or other
  misc_feature (236)..(267): n is a, c, g, or t
tcagagctcacgtacacgaccggtgctcgatttagatcacgtgcgtcggcgggggcccaggcagatcgatgagtgttgattatttactgtgtgctctatatgggcagtggcgtttgggtgttcggcggagggaccaagctgaccgtcttaggtcagtcccaaggctgcccccttaggtcactctgttcccgccctctctacgtgagctctgaggcgggctggcaaggcgcgatagnnnnnnnnnnnnnnnnnnnnnnnnnnnnnnnn

SEQ ID NO: 26612 - DNA, 231 bp, Homo sapiens
  misc_feature: GYAE6OF01AMAXQ.47.83.H06.1.454.CMB.1.raw
  modified_base (229)..(231): a, c, t, g, unknown or other
  misc_feature (229)..(231): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgccccctcggtcactctgttcccaccctcctctacgtgagctctgagcgggctggcaaggcgcatagnnn

SEQ ID NO: 26613 - DNA, 524 bp, Homo sapiens
  misc_feature: GYAE6OF01B49GY.47.83.H06.1.454.CMB.1.raw
tcagagctcacgtacacgaccggtgctcgatttagatcacgtgcgtcgcggggggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcatttgtggcttgagctctggctcagtctccactacatactcccccagctggtaccagcagaccccggcagactccacgcacgctcatctacaacacagacactcgctcttctcggggtcctgatcgcttctctggttccatccttgggaacaagctcgccctcaccatcggcggggcccaggcagatgatgagtgtgatttattactgtgtgctctatagtgggctagtggtcgtttgggtgttcgggcggagggaccgaaggtcgtggacccgttgttaggtcctacgcccgaaggcctcgcccccgttccgg

SEQ ID NO: 26614 - DNA, 239 bp, Homo sapiens
  misc_feature: GYAE6OF01DVGJO.47.83.H06.1.454.CMB.1.raw
  modified_base (230)..(239): a, c, t, g, unknown or other
  misc_feature (230)..(239): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagttgaccgtcctaggtcagcccaaggctgccccctcggtcactctcgttcccgccctcctctacgtgagctctgagcgggctggcaaggcgcatagnnnnnnnnnn

SEQ ID NO: 26615 - DNA, 231 bp, Homo sapiens; identical to SEQ ID NO: 26612
  misc_feature: GYAE6OF01A0E9D.47.83.H06.1.454.CMB.1.raw
  modified_base (229)..(231): a, c, t, g, unknown or other
  misc_feature (229)..(231): n is a, c, g, or t

SEQ ID NO: 26616 - DNA, 534 bp, Homo sapiens
  misc_feature: GYAE6OF01EAO0X.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacgtagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctaacaacacagacactcgctcttcgtggggtccctgatcgcttctctggttccatccttgggaacaagctcgccctcaccatcggccggggcccaggcagatgatgagtgtgtattattactgtgtgctctatagtgggcgtaggttgggtcggttttggggtgttcgggcgggtacgggaccaaggcgtggccggttacgg

SEQ ID NO: 26617 - DNA, 583 bp, Homo sapiens
  misc_feature: GYAE6OF01D9SP1.47.83.H06.1.454.CMB.1.raw
tcagagctcacgtacacgaccggtgctcgatttagatcacgtgcgtcggacgggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtcgtcccgtggagggacagtcacactcacttgtggcttgagctctggctcagtctccactacatacctcccccagctggtaccagccacgaccccgggcagacctccacgcacgctcatctacaacacagaccactcgctcttcgtggggtccctgatcgtcttctctggttccattccttagggaacaagctcgccctcacctatccggcggggcccaggcagatgatgagtgtgtattattacgttgtgtgtcttactagttagtggggtactagggttggggttccggtttttggggggtcggttttaccggggaccggggtaacggggtaaccctaaaggtcccgtaggtacccggttacgg

SEQ ID NO: 26618 - DNA, 232 bp, Homo sapiens
  misc_feature: GYAE6OF01D3AYD.47.83.H06.1.454.CMB.1.raw
  modified_base (228)..(232): a, c, t, g, unknown or other
  misc_feature (228)..(232): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgccccctggtcactctgttcccaccctcctctacgtgagctctgagcgggctggcaaggcgcatagnnnnn

SEQ ID NO: 26619 - DNA, 249 bp, Homo sapiens
  misc_feature: GYAE6OF01D5EXE.47.83.H06.1.454.CMB.1.raw
  modified_base (221)..(221): a, c, t, g, unknown or other
  misc_feature (221)..(221): n is a, c, g, or t
  modified_base (227)..(249): a, c, t, g, unknown or other
  misc_feature (227)..(249): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgccccctggtcactctgttcccaccctctctacgtgagctctgagcgggctggcaaggcncatagnnnnnnnnnnnnnnnnnnnnnnn

SEQ ID NO: 26620 - DNA, 231 bp, Homo sapiens
  misc_feature: GYAE6OF01EBJR7.47.83.H06.1.454.CMB.1.raw
  modified_base (229)..(231): a, c, t, g, unknown or other
  misc_feature (229)..(231): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcctcggtcagcccaaggctgccccctcggtcactctgttcccaccctcctctacgtgagctctgagcgggctggcaaggcgcatagnnn

SEQ ID NO: 26621 - DNA, 230 bp, Homo sapiens
  misc_feature: GYAE6OF01CJ1RK.47.83.H06.1.454.CMB.1.raw
  modified_base (228)..(230): a, c, t, g, unknown or other
  misc_feature (228)..(230): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgccccctggtcactctgttcccaccctcctctacgtgagctctgagcgggctggcaaggcgcatagnnn

SEQ ID NO: 26622 - DNA, 636 bp, Homo sapiens
  misc_feature: GYAE6OF01DJHKK.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggaggacagtcacactcacttgtgcttgagctctggctcagtctccactacactacctcccccagctggtaccagccacggaccccggcacgacctccacgcacgctcatcctacaacacaacgacactcgctctcgtcgggtccctgactccgtcttctctggttccctagtccgttagggaaactaaacgtctacgccctaccgaccctagtcccgggaccgggggccccagggccaaggattacggattagggagtggtaggtaatttacgttacgttggttcgtcgtacttacttaagtaggtacggggtcgtacgggttcggggttacggttttcgggggtttcgttaccggggacggggtaacggggaaccctaaacgggtccgttacgggtacccggtttaacgg

SEQ ID NO: 26623 - DNA, 231 bp, Homo sapiens
  misc_feature: GYAE6OF01A8LQ5.47.83.H06.1.454.CMB.1.raw
  modified_base (229)..(231): a, c, t, g, unknown or other
  misc_feature (229)..(231): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgccccctcggtcactctgttcccgccctcctctacgtgagctctgagcgggctggcaaggcgcatagnnn

SEQ ID NO: 26624 - DNA, 279 bp, Homo sapiens
  misc_feature: GYAE6OF01DKRF5.47.83.H06.1.454.CMB.1.raw
  modified_base (251)..(279): a, c, t, g, unknown or other
  misc_feature (251)..(279): n is a, c, g, or t
tcagagctcacgtacacgaccggtgctcgatttagatcacgtgcgtcggacggggggcccaaggcagatgatgagtgtgattattactcgtgtgctctatatgggccagttggcgttttgggtgttcgggcgagggaccaagcctgaccgtcttaggtcagcccaaggctcgcccccctcggtccactcttcgttccccacccctccgtctacgtcgacgcctcctgagccgggctggcaaggcgcatagnnnnnnnnnnnnnnnnnnnnnnnnnnnnn

SEQ ID NO: 26625 - DNA, 571 bp, Homo sapiens
  misc_feature: GYAE6OF01CF7RX.47.83.H06.1.454.CMB.1.raw
  modified_base (438)..(438): a, c, t, g, unknown or other
  misc_feature (438)..(438): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagcacgaccccgggccacgacctccacgcacgctcatctacaacacagacactcgctcttcgtcgggtcctgactcgcttctctcgttccatccttagggaacaagctcgccctcaccagtcggccggggcccaggcagntgatggagtgtagtatttattacgtgtgtcgcttcgttatagtgggtacgtagggttgggtcgggttttggggtcggtttcggggaccggggtaacgggacccgtaagggtccgttcggtacccggtttacgg

SEQ ID NO: 26626 - DNA, 234 bp, Homo sapiens
  misc_feature: GYAE6OF01BF9SH.47.83.H06.1.454.CMB.1.raw
  modified_base (228)..(234): a, c, t, g, unknown or other
  misc_feature (228)..(234): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgccccctcggtcactctgttcccaccctcctctacgtgagctctgagcggctggcaaggcgcatagnnnnnnn

SEQ ID NO: 26627 - DNA, 534 bp, Homo sapiens
  misc_feature: GYAE6OF01DOGPT.47.83.H06.1.454.CMB.1.raw
  modified_base (410)..(410): a, c, t, g, unknown or other
  misc_feature (410)..(410): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagccagaccccgggcagactccacgcacgctcatctacaacacagacactcgctcttctcggggtccctgatcgcttctctcggttccatccttgggaaacaagctgccctnaccacgtccggccggggcccaggcagatgatggagttgtagtatttattactgtgtgcttctatagtgggcgtaggtgggtggtttgggtgttcgggcgggtagggaccaggctggtccgttag

SEQ ID NO: 26628 - DNA, 584 bp, Homo sapiens
  misc_feature: GYAE6OF01AYC6O.47.83.H06.1.454.CMB.1.raw
  modified_base (364)..(364): a, c, t, g, unknown or other
  misc_feature (364)..(364): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtcgtcccgtggagggacagtcacactcacttgtgcttgagtctcgtggctcagtcctccactacatacctccccagcctggtaccagccacggacccccggcacgacctccacgcacgcctacactcctaacaacacacgaccactcnctctcgtcgggtccctgactcgtcttctctcggttcctgtccgtaggaactaagcctacgtccctacaccacgtccgggccggggccaggcagacgtgtacgtgtacgtgtagtattacgttacgtgtcgtgtctattagtagtgggtcgtgggttcgggttcgggttttgggtcggttcgggcgggtaacgggtacgaaggtccgtacggtccgtacgg

SEQ ID NO: 26629 - DNA, 234 bp, Homo sapiens
  misc_feature: GYAE6OF01DESH3.47.83.H06.1.454.CMB.1.raw
  modified_base (228)..(234): a, c, t, g, unknown or other
  misc_feature (228)..(234): n is a, c, g, or t
tcagagctcacgtacacgaccggtgctcgatttagatcacgtgcgtcgcggggcccaggcagatgatgagtgtgattattactgtgtgctctatatgggcagtggcgtttgggtgttcggcggagggaccaagctgaccgtcttaggtcagcccaaggctgccccctggtcactctcgttcccaccctcctctacgtgagctctgagcgggctggcaaggcgcatagnnnnnnn

SEQ ID NO: 26630 - DNA, 561 bp, Homo sapiens
  misc_feature: GYAE6OF01DL6MN.47.83.H06.1.454.CMB.1.raw
tcagagctcacgtacacgaccggtgctcgatttagatcacgtgcgtcgcgggggggaagcctgagaacacttagccttcatgagtgtccccgaccatggcctggatcgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagcacgaccccggccagacctccacgcacgctcatctacaacacagacactcgctcttcgtcgggtccctgactcgcttctctgttccattcctggaacaagctcgccctcaccagtccggccggggcccaggcagatgatgagtgtgtatttattactgtgtgcttctatgtgggctaggttggtcggtttggggtcggtttcgggcgggtagggaccgaaggtcgtacggtacccgttcgttaggaccgtacggaccccgtaagggcccttcccggtcccccccgtacgg

SEQ ID NO: 26631 - DNA, 232 bp, Homo sapiens
  misc_feature: GYAE6OF01E3GRX.47.83.H06.1.454.CMB.1.raw
  modified_base (223)..(223): a, c, t, g, unknown or other
  misc_feature (223)..(223): n is a, c, g, or t
  modified_base (229)..(232): a, c, t, g, unknown or other
  misc_feature (229)..(232): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggaggaccaagctgaccgtcttaggtcagcccaaggctgccccctcggtcactctgttccccgccctcctctacgtgagctctgagcgggctggcaaggcncatagnnnn

SEQ ID NO: 26632 - DNA, 538 bp, Homo sapiens
  misc_feature: GYAE6OF01DBGTP.47.83.H06.1.454.CMB.1.raw
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (422)..(422): a, c, t, g, unknown or other
  misc_feature (422)..(422): n is a, c, g, or t
  modified_base (508)..(508): a, c, t, g, unknown or other
  misc_feature (508)..(508): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtcccaccatggcctggatgatgcttctctcggactcttggtttgggacaggagtggattctcagactgtggtgacccaggacgccatcgttctcagtgtcccgtggagggacagtcacgactnacttgnggcttgngctntggctcagtctccactacatacctccccagctgtaccagcacgacccggcagactccacgcacgctcactctacaacgacagacactcgctctttcgtcgggtccctgactcgcgtttctctcggttccattccgttagggaactaacgctcgtccctcaaccgngtccgggcggggcccagggcagatgagtgagtgtagtactttagtactggtgtgcttctagtgtgggctaggtggtcggtttgggngttcgggcggtacgaccagctggccgttcg

SEQ ID NO: 26633 - DNA, 762 bp, Homo sapiens
  misc_feature: GYAE6OF01DI2CK.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtcgtccccaccatggcctggatgatgcttcctcctcggacttccgtttgggttttgggacaggagtggattctcagactggtggtcgacccgagggacgcctattccgttctcgaggtcggtcccggtggacgggacagtccactactcacgttggtggcttgagtcctctggcctctagtcctaccactactactaccctccccgaggtccttacggtacccacggccgaaccggtacccccggcacgaccctccgaacgccaccgtcctcgaactccgtaacaacaccgtagacctacctcgactttccgttcggtccggggtcctagtactccgtctttctcgtttcggttaccctacgttccggttacggaactaacgtccgttacccgacccttaccgaaccgtacggtcccggggaccgggggtcccagggtaccgtacgtacgttagacgttaggtacggtttaggtacgttaacttttaccgttaacggttgtttacgtacggttacgtttaccgtaggttacggtcgggtacggttacggggtttggggtttcgggtttttcggggtaccgggttcggggtaacccgggtaacggggtacccgaacgggttcccggttacggttcccggtttaacggg

SEQ ID NO: 26634 - DNA, 604 bp, Homo sapiens
  misc_feature: GYAE6OF01DXMO5.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtcgtccgtggagggacagtcacactcacttgtggcttgagtctctggctcagtctccactacactacctccccagctggtaccagcacgacccggcacgacctccacgcacgctacactacctaacaacacacgacactcgctcttcgtcgggtcctgactcgtcttctcgttcggttccacgttccgttagggaaacaacgtcctcgccctacaccgagtccgggccggggcccagggaccagactggagtcggagttgtagtatttagttacgtggtagtcgtccttacgttagtacgtggggtactagggttgggttacgggttttggggtcggttacggggacgggtaacggggtaacccaaggtcgtcggtaccggttacggg

SEQ ID NO: 26635 - DNA, 573 bp, Homo sapiens
  misc_feature: GYAE6OF01CBGGS.47.83.H06.1.454.CMB.1.raw
tcagagctcacgtacacgaccggtgctcgatttagatcacgtgcgtcgcgggggggaagcctgagaacacttagccttcatgagtgtccccaccatggcctggatgatgcttctcctcggactccttggttttgggacaggagtggattctcagactgtggtcgacccaggagccatcgttctcagtgtcccgtggagggacagtcacactcacttgtggcttgagctctggctcagtctccactacatacctccccagctggtaccagcacgaccccggcacgactccacgcacgctcatctacaacacagacactcgctcttcgtcgggtcctgatcgtcttctctcggttccacttccgtaggaacaaagctcgccctcaccacgtccggcggggacccaggcagagtgatgacgttgtgtatttagttactgtgtcgcttctaagtagtgggctaggtcgggttacggtttgggtcggttcggggccggtaagggaccgtaaggtctacggtaccggttacgttacggtccaccggtacccgaaggtccctcccggtcccccgttcggg

SEQ ID NO: 26636 - DNA, 557 bp, Homo sapiens
  misc_feature: GYAE6OF01A0KKP.47.83.H06.1.454.CMB.1.raw
  modified_base (375)..(375): a, c, t, g, unknown or other
  misc_feature (375)..(375): n is a, c, g, or t
tcagagctcacgtacacgaccggtgctcgatttagatcacgtgcgtcgcgggggggaagcctgagaacacttagccttcatgagtgtccccaccatggcctggatgatgcttctcctcggactccttggttttgggacatgagtggattctcagactgtggtgacccaggagccatcgttctcagtgtcccgtggaggacagtcacactcacttgtggcttgagctctggctcagtctccactacactacctccccagctggtaccagcacgaccccggcagactccacgcacgctcatctacaacacagacactcgctcttcgtcgggtccctgactcgcttctcgtcgttccatccgtagggaaacaagtccncgccctcaccgagtccggccggggcccaggccaagatgatgagtgtataattagttacgtgttgcgtcttctagtaggtgggtacagggttggtcggtttggggtcgttcgggacgggtacggaaccgtagcgtcgtaccgttacttacggcacggacccgaaggtcccgtcggtccccccg

SEQ ID NO: 26637 - DNA, 530 bp, Homo sapiens
  misc_feature: GYAE6OF01EMBMW.47.83.H06.1.454.CMB.1.raw
  modified_base (463)..(463): a, c, t, g, unknown or other
  misc_feature (463)..(463): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtccgtggagggacagtcacactcacttgtggcttgagctctggctcagtctccactacatactcccccagctggtaccagcacgaccccgggcagacctccacgcacgctcatctacaacacagacactcgctcttcgtcgggtccctgactcgtcttctctcggttccatccttagggaacaagtctgccctcaccacgtcgcggggcccaggcagatgatgagtgtgtattacttatgttgtnctctatgtggctaggttggtcggtttggtggttcggcgggtacgggaccgagcgtggaccgttacgg

SEQ ID NO: 26638 - DNA, 583 bp, Homo sapiens
  misc_feature: GYAE6OF01B3185.47.83.H06.1.454.CMB.1.raw
  modified_base (517)..(517): a, c, t, g, unknown or other
  misc_feature (517)..(517): n is a, c, g, or t
tcagagctcacgtacacgaccggtgctcgatttagatcacgtgcgtcgcgggggaaaaggccctgaggaaaacaacccagctgggaagcctgagaacacttagccttcatgagtcgtccccaccatggcctggatgatgcttctcctcggacttccttggttttgggacagggagtggattctcagactgtggtcgacccgaggagcctattccgttctcagtcgtcccgtggaggacagtcacactctacttgtgcttgagctcgtgctcagtctccatacatacctccccagtcctacggtaccagccgacgaccccggccacgaccgtcccacgccacgctacatacctaaccaacgacagacactcgctctcgtcgggtcctgtactcgtcttctcgtcgttcacgtccgtaggaaccagtcctcgaccctacaccgtacgccgggcggggaccaggcacgataggattggagttgtagtagtttactacgtgtgtctcttactagtgtcggngtgggtggttcgggtttggggtccgtacgggacgggacggtaccgtagtccgtcggttccgttacg

SEQ ID NO: 26639 - DNA, 533 bp, Homo sapiens
  misc_feature: GYAE6OF01CPNU3.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggtttgggacaggagtggattctcagactgtggtgacccaggagccatcgttctcagtgtcccgtggagggacagtcacactcacttgtgcttgagctctggctcagtctccactacactacctcccccagctggtaccagcacgcccggccagctccacgcacgctcatcacacacagacactcgctctcgtgggtccctgactcgcttctcgtcgttcatccgttggaaccaagctacgccctcgaccactcggccggggcccaggcagactgatgagtgtgtacttattatgtgtgcttctagtagtgggtcgtaggtggtacggtttgggtcggttcggcgggtacgggacaaggtcgtggtccgttacgg

SEQ ID NO: 26640 - DNA, 241 bp, Homo sapiens
  misc_feature: GYAE6OF01EDDBY.47.83.H06.1.454.CMB.1.raw
  modified_base (235)..(241): a, c, t, g, unknown or other
  misc_feature (235)..(241): n is a, c, g, or t
tcagagctcacgtacacgaccggtgctcgatttagatcacgtgcgtcgcggggcccaggcagatgatgagtgtgattattactgtgtgctctatagtgggcagtggcgtttgggtgttcggcggagggaccaagctgaccgtcttaggtcagcccaaggctcgccccctggtcactctcgttccccgcctcctctacgtgagctctggacggcggctggacgaacggcgacatgnnnnnnn

SEQ ID NO: 26641 - DNA, 680 bp, Homo sapiens
  misc_feature: GYAE6OF01B7NQV.47.83.H06.1.454.CMB.1.raw
  modified_base (403)..(403): a, c, t, g, unknown or other
  misc_feature (403)..(403): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtcgtcccgtggagggacagtcacactcacttgtggcttgagctcgtggctcagtcctccactacactacctcccccagcctcggtaccagccaccggaccccgggcacgcctccacgccacgctcatctaacaacacacgacactcgcttcgttcgtcgggtcctgactcgtcttctctcggttccncttcgtaggaactaacgtctacgtccctcaccgtacgtccgggcccggggaccaggccagacgttgacgtggtagtcggttagttaacgttttacgttacgttgttcggttacgttccgttacgttaagttacgggttacgggtacggtacggggttttcggggtttacggggttttttcggggggttacgggtttacccggggggtacccggggtaaaccggggttaacccggtaacggtcccgggtttaccggggtaaccccggttttaacgggg

SEQ ID NO: 26642 - DNA, 237 bp, Homo sapiens
  misc_feature: GYAE6OF01A2ADD.47.83.H06.1.454.CMB.1.raw
  modified_base (221)..(221): a, c, t, g, unknown or other
  misc_feature (221)..(221): n is a, c, g, or t
  modified_base (227)..(237): a, c, t, g, unknown or other
  misc_feature (227)..(237): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggaggaccaagctgaccgtcttaggtcagcccaaggctgccccctggtcactctgttccccgccctctctacgtgagctctgagcgggctggcaaggcncatagnnnnnnnnnnn

SEQ ID NO: 26643 - DNA, 622 bp, Homo sapiens
  misc_feature: GYAE6OF01DVH06.47.83.H06.1.454.CMB.1.raw
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
tcagagctcacgtacacgaccggtgctcgatttagatcacgtgcgtcgcgggggaaaaggccctgaggaaaacaaaccccagctgggaagcctgagaacacttagcattcatgagtgtccccaccatggcctggatgatgcttctcctcggactccttggttttgggacaggagtggattctcagactgtggtgacccaggagccatcgttctcagtcgtccgtggagggacagtcacactcacttgnggcttganctctggctcagtcctccactacatacctccccagctcggtacagcacggaccccggccacgacctccacgcacgctcactcaacaacacagacactcgctctcgtcgggtccctgactcgtctttctacgttcggttacctacgttccgttacgggaactaaaacgtcctacgaccctaccacccgtacggtccgggccgggggaccccgagggtccgaggagtagagtggtagtaggttagtacgtttattacgttgttgtcgtacctcgttagtacgtgggtcgtagggttcgggttcggggttttgggttcgggttccggggacgggtacggggaccgtaaacggtccgtcggttaacccggg

SEQ ID NO: 26644 - DNA, 247 bp, Homo sapiens
  misc_feature: GYAE6OF01BB8WI.47.83.H06.1.454.CMB.1.raw
  modified_base (230)..(230): a, c, t, g, unknown or other
  misc_feature (230)..(230): n is a, c, g, or t
  modified_base (237)..(247): a, c, t, g, unknown or other
  misc_feature (237)..(247): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctcgccccctcggtcactctcgttccccgccctcctctacgtgacgctctgaggcgggctggacaagggcnctatagnnnnnnnnnnn

SEQ ID NO: 26645 - DNA, 769 bp, Homo sapiens
  misc_feature: GYAE6OF01BFTLD.47.83.H06.1.454.CMB.1.raw
  modified_base (290)..(290): a, c, t, g, unknown or other
  misc_feature (290)..(290): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtcgtccccaccatggcctggatgatgcttctcctcggacttccgttgggttttgggacagggagtggattctcagactgtggtcgacccaggacgccattcgttctcgaggtcgtcccggtggagggactagtcacactcacgttggtggtcttggagtctcgtgctcacgtccnccactacactcctccccagtctcgtaccacgccaccggaccccggcacgacctccgacgccacgcctacactaccgaacaaccacgaacgacctacctccgtccttcgtttccgggtccgggtcctagtacctccgtcctttcgttacgttcgttaccctacgttaccgttaacgggaacctaaccgttcgtcccgtaccctaccgaacccgtcggtacccggggcccggggtacccgaagggtaccgaaggtacgtacggttaccggtaggtaaggtttacggttacgtttaaacgttttcgtttaacggtttcggttacgttacggttaccgtttacgttaaggttcgggttacggggtaccggttagggggtttccgggggtttacggggttttcggggttaccggggtttacccgggggaacgggtaaccggggtaaccgtaagggttccggttacccggttacccgggttacgg

SEQ ID NO: 26646 - DNA, 244 bp, Homo sapiens
  misc_feature: GYAE6OF01D40GI.47.83.H06.1.454.CMB.1.raw
  modified_base (238)..(244): a, c, t, g, unknown or other
  misc_feature (238)..(244): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctcgccccctcgtcactctcgttccccgccctcctctacgtgacgctctgaggcgggctggacgaacggcgacaatagnnnnnnn

SEQ ID NO: 26647 - DNA, 789 bp, Homo sapiens
  misc_feature: GYAE6OF01D8P71.47.83.H06.1.454.CMB.1.raw
  modified_base (747)..(748): a, c, t, g, unknown or other
  misc_feature (747)..(748): n is a, c, g, or t
  modified_base (750)..(750): a, c, t, g, unknown or other
  misc_feature (750)..(750): n is a, c, g, or t
  modified_base (754)..(754): a, c, t, g, unknown or other
  misc_feature (754)..(754): n is a, c, g, or t
  modified_base (756)..(756): a, c, t, g, unknown or other
  misc_feature (756)..(756): n is a, c, g, or t
  modified_base (759)..(759): a, c, t, g, unknown or other
  misc_feature (759)..(759): n is a, c, g, or t
  modified_base (761)..(761): a, c, t, g, unknown or other
  misc_feature (761)..(761): n is a, c, g, or t
  modified_base (763)..(763): a, c, t, g, unknown or other
  misc_feature (763)..(763): n is a, c, g, or t
  modified_base (765)..(766): a, c, t, g, unknown or other
  misc_feature (765)..(766): n is a, c, g, or t
  modified_base (772)..(772): a, c, t, g, unknown or other
  misc_feature (772)..(772): n is a, c, g, or t
  modified_base (775)..(776): a, c, t, g, unknown or other
  misc_feature (775)..(776): n is a, c, g, or t
  modified_base (778)..(779): a, c, t, g, unknown or other
  misc_feature (778)..(779): n is a, c, g, or t
  modified_base (781)..(781): a, c, t, g, unknown or other
  misc_feature (781)..(781): n is a, c, g, or t
  modified_base (784)..(784): a, c, t, g, unknown or other
  misc_feature (784)..(784): n is a, c, g, or t
  modified_base (786)..(787): a, c, t, g, unknown or other
  misc_feature (786)..(787): n is a, c, g, or t
tcagagctcacgtacacgaccggtgctcgattagatcacgtgcgtcgcgggggcatcacataacaaccacattcctcctctgaagaagcccctgggagcacagctcatcaccatggactggacctggaggttcctctttgtggtggcagcagctacaggtgtccagtccctggtgcagctggagcagtcgtggggctgaggtgaagaagccgtgggtcctcggtgaaggtctccgtgccaccggcccctgcagaccaccttcacgcacccttatacccttcgagtcgtggggtcgccgacgacgggcccgtagggacgaagggtcttggagtgggaggtggggtacggggttccgtcccttagttcgtttaggtaaacgaaacctaaaaccgtaccggacctaaaccgtaacgttaaacccgttacccggaacggggtaccgtaaacgggtaacggttacccgtaaaccgggttaaaccggttttaacccccgggggaaccggggtaaccccgtaaacgggtaaacccgtttaccccccgggggaaaaccccggggggtaccctaaaaccccgggttaaccgttttaacccccccgggttttaaccccgtaaaggggtttttaccgggggggtaaaacgggttttttttaccggggggaaaacccgggtttacccccggggttaaaaccccgggttaaccccccccggggttttttaaaggggggggaaaaaaccccccgggggggnngngacngnatntngngnngcgctntanngnngntgncnntg

SEQ ID NO: 26648 - DNA, 684 bp, Homo sapiens
  misc_feature: GYAE6OF01DOCO9.47.83.H06.1.454.CMB.1.raw
  modified_base (378)..(378): a, c, t, g, unknown or other
  misc_feature (378)..(378): n is a, c, g, or t
tcagagctcacgtacacgaccggtgctcgatttagatcacgtgcgtcgcgggggaaaggccctgaggaaacaaaccccagctgggaagcctgagaacacttagccttcatgagtgtcccaccatggcctggatgatgccttctcctcggactccttggttttgggacaggagtggattctcagactggtggtcgacccaggagcccattcgttctcgagtcgtcccgtggacgggacagtcacactcgacttggtggtcttggatctcgtggctcagtctccacttacactaccctccccagtcctggtaccaggccacggtccccgggcacgcctccacgccaccgctcactacctaacgaacacacgaccacgtcncctctttcgtcgggtccctgacttccgtctttaccgtctcggtttaccacgttacccgttaggaaacccaggtccctacgtccctacacccgtaggtacccgggcccgggggaccagggtaccaaggtactacggaagttacggtaacggtttcgtaacggtttaactttaccttaacggttggtacgttcgtacctttacgtggtaagtcggggtacgttaggttcggggtttccggtttgggggtccgttccggggaacgggtacgggtaaaccctacggtccgttacgggtcccgtttacggg

SEQ ID NO: 26649 - DNA, 622 bp, Homo sapiens
  misc_feature: GYAE6OF01CL6NH.47.83.H06.1.454.CMB.1.raw
  modified_base (249)..(249): a, c, t, g, unknown or other
  misc_feature (249)..(249): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactcctttggttttgggacaggagtggattctcagactgtaggtgacccaggagccatcgttctcagtgtcccgtggaggacagtcacactcacttgngcttgatctctggctcagtctccactacactacctcccccagtcgtacggtaccagaccgaacggacccccgggaccaacgacctacccacgccacgcctacactaccaacaacactagacactcgcttcgttcgtcgggtccctgactcgtcttctctcgttccagttccgtaggaacaagcctacgcctacacacgtccggccggggtcccaggccagtactgagtgtagtgtagttaatttacgttacgtggttagtctacgttacgttaagttacggtcggggtacgtagggttggggttcgggttttggggtacgggttccgggacgggtaaccgggtaacaaggtccgttcggtaacccggttacgg

SEQ ID NO: 26650 - DNA, 746 bp, Homo sapiens
  misc_feature: GYAE6OF01C0MXQ.47.83.H06.1.454.CMB.1.raw
  modified_base (232)..(232): a, c, t, g, unknown or other
  misc_feature (232)..(232): n is a, c, g, or t
  modified_base (643)..(643): a, c, t, g, unknown or other
  misc_feature (643)..(643): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtcgtccccaccatggcctggatgatgcttctcctcggacttcgttggttttgggacaggagtggattctcagactgtggtcgacccgaggacgccatcgttctcgagtcgttccggnggagggacagtcactactctacgttggtggcttaggacgtcttcgtcggctcgacgtcctacctactaactaacctacccgtacccccagtcgtacggtaccaacgaccgaccggaccccggacaacgaccctccgacgcacgctacactacctaacgaacactacgacactccgccttaccttcggtcgggtccctacgtacgttccgtctttcgtacgttcgttaccctacgttccggttaagggaaacctaacgttccgtacctaccccgttaccgaaccgtacggtccccggggaccggggaccccgaaggaccgagtaacgtgtacgttagggtacgttaggttacgttaattttacgtaacgtttggtaccgttagttcccgtaagtttaaagtggggttaccgngggtttaacgggttcggggtttaccgggttttgggggttacgggttacccggggaacgggtaaccgggtaacgtaggtccgtacggttaaccgggttaaccgg

SEQ ID NO: 26651 - DNA, 755 bp, Homo sapiens
  misc_feature: GYAE6OF01AOQRJ.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagtctggtaccagccacgccccggcacgctccacgcacgctcactcacacacacgacactcgcttctcgtcggggtcctgactccgtcttctcgttcggttacctacgttcccgtttaggggaaacctaaacggtcccgttaccggtacccccttaccgtaaccccgtaccgggtttccccggggccccgggggggtacccccgtaacggggacccgtaacgggtaacgttacgggaagtttacggggaaacggttttgggttacggttaacgtttttaacggttttacgtttgggtttacggttcgttacccgtttacgttaagtttacggttacgggggacgtttacggggtttcggggtttcggggttttttcgggggttcggggttttaccgggggaccgggggtaaacggggggtaaccctaaacgggttccggttacccgggttaaccggtttacccgggg

SEQ ID NO: 26652 - DNA, 526 bp, Homo sapiens
  misc_feature: GYAE6OF01A7MR6.47.83.H06.1.454.CMB.1.raw
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagcctggtacccagccacggaccccgggcacgacctccacgcacgctcatctacaacacagacactcgctcttcgtcgggtccctgactcgcttctctggttccatcctagggaacaagctcgccctcaccatccggccggggcccaggcagatgatgagtgtagtattagttacgtgtgtgctntatgtggntggtggtcggttgggtgttcggcggtaggaccagcgtcgcgtacg

SEQ ID NO: 26653 - DNA, 674 bp, Homo sapiens
  misc_feature: GYAE6OF01CDBLG.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccgttggttttgggacaggagtggtattctcagactgtggtgacccaggagcctatcgttctcagtcgtcccgtggacggcagtcacactcacttgtggtcttgagtctcgtggctctacgtctcctactacactacctccccccagtctggtacccagccgaccggacccccgggccacgacctcccgaccgaccacgcctactactacctaaccaaccaacgtacgaacctactcgtccttcgtttcgtccggggttccctggactccgtcttccttcgttcggttcctacgttaccggttacggtaaactaacgtcgaccgtaccctccaaccgtacggtcccgggtcccggggacccgacgacgcgaatgtagtgagtgtagtagttattacgttcgtgttcgccgttactagtacggtggtcgttacgggttgggtttacgggttttggggttcgggttcgggggtacccgggagggtaccccgtaaaggtcccggttaggtacccgtttacggg

SEQ ID NO: 26654 - DNA, 833 bp, Homo sapiens
  misc_feature: GYAE6OF01DB7B7.47.83.H06.1.454.CMB.1.raw
  modified_base (222)..(222): a, c, t, g, unknown or other
  misc_feature (222)..(222): n is a, c, g, or t
  modified_base (342)..(342): a, c, t, g, unknown or other
  misc_feature (342)..(342): n is a, c, g, or t
tcagagctcacgtacacgaccggtgctcgatttagatcacgtgcgtcggcgggggaaaagccctgaaggaaaacaaaccccagctgggaagcctgagaacacttagccttcatgagtcgtccccaccatcggcctggatgatgtcttcctccgtcggtaccttccgtttgggttttgggacagggagtggtattctcagtactggtggtcgacccgaggacncctattccgttctcgtaggtcgtcccggtgggacggactagtaccaacaccgtctacgtttggtcggtcttggactcctcgtggctactaccgtcctacctaacttaccaccttaccccncccccgagtccgtacggaacccacggcccgaacccgggacccccggaccaaacgtccctacccgaaccggcctaacctcctaccaacttaccaaaccgaacaaccgaacgtaccctaacgttcgtaccttccgtttcccgggtccgggttccctaggtacctccggtccttttccgcgtttcccggttacctacgtttaccgggtaacggtaaaccaacggttccctaaacccgtccccctaaacccgacccggtacccgggtcccgggggacccgggaacccgacgggtacaacggtagttagaacggtcggttgttaggttaagtaacttttaacggtacgttgggtcgtttacgtactttaacgtagtaccggggttcgggacggtttcgggggtttgggtttaccggggtttggggtccggggttaccggggaaccgggtaacgggacctaacggttccggttaaccggttacccgggtttaccggg

SEQ ID NO: 26655 - DNA, 823 bp, Homo sapiens
  misc_feature: GYAE6OF01DXD3J.47.83.H06.1.454.CMB.1.raw
  modified_base (257)..(257): a, c, t, g, unknown or other
  misc_feature (257)..(257): n is a, c, g, or t
  modified_base (319)..(319): a, c, t, g, unknown or other
  misc_feature (319)..(319): n is a, c, g, or t
tcagagctcacgtacacgaccggtgctcgatttagatcacgtgcgtcggcgggggaaaaggccctgaggaaaacaaaccccagctgggaagcctgagaacacttagccttcatgagtcgtccccaccatggcctggatgatgcttctcctcggacttccgttgggttttgggacaggagtggattctcagactggtggtcgacccgaggacgcctattccgttctcgtagtcggtcccggtggacgggacagtcacnctctacttggtgcttgagtctcgtggtctcacgtcctaccaactactactaccctacccccngtccgttacggtaacccacggacccgtaacccgggacccccggggaccaacggtacccctacccgaccgaccaccgtctactactacctaaccaaacacaacgacctaccgtcgtaccttcgttcggttccgggtcctagtaccgttccgtacctttcgttcgttccggtttacctaccgttaccggtaacgggaaacctaacggtcccttaccgtacccctaccgtaaccggtaccgggtaccccgggggcccgggggtaacccgtacgggaccgtaacggttaacgtagggtaacgttacgggtaacggtttaggttacgtttaacgttttaaacgttccggtttggttaaccgttcggttacctttacgttaggttacgggtacgggttacgttaggggtttccggggtttacgggttttcgggggttacccgggttacggggaccggggttaaacggtacccggtaaaggttcccgggttcgggtaaccggtttaccggg

SEQ ID NO: 26656 - DNA, 703 bp, Homo sapiens
  misc_feature: GYAE6OF01A3RIJ.47.83.H06.1.454.CMB.1.raw
  modified_base (171)..(171): a, c, t, g, unknown or other
  misc_feature (171)..(171): n is a, c, g, or t
tcagagctcacgtacacgaccggtgctcgatttagatcacgtgcgtcgcgggggggaagcctgagaacacttagccttcatgagtgtccccaccatggcctggatgatgcttctcctcggactccttggttttgggacaggagtggattctcagactgtggtgacccaggngccatcgttctcagtgtcccgtggagggacagtcacactcacttgtggcttgagctctggctcagtctccactacactacctccccagcctggtaccagcacgacccggcagacctccacgcaccgctcatcctaacacacagacactcgctacttcgtcggggtccctgactcgtcctttactcttcgggtttccctaagttccccgtttaaggggaaaccctaaaacggtcccttacggcccccttacaaccccgtaacggttcccgggacccgggggggtccccaagggaccctaacggtaactcgggaacgttacgggtaacggttaggttagtaacgtttaactttaccggttcggttcgtacggtccttaccgttagttacggtacggggtccgtaaggttcggggttacggttttcggggtcggttacggggtccggggtaacgggtaccgtaacggttcggtacccgtcccgttagggtacctaccggtaccgacggtccgttcggtccccccgtggttacccg

SEQ ID NO: 26657 - DNA, 792 bp, Homo sapiens
  misc_feature: GYAE6OF01EG7TC.47.83.H06.1.454.CMB.1.raw
  modified_base (194)..(194): a, c, t, g, unknown or other
  misc_feature (194)..(194): n is a, c, g, or t
  modified_base (491)..(491): a, c, t, g, unknown or other
  misc_feature (491)..(491): n is a, c, g, or t
  modified_base (632)..(632): a, c, t, g, unknown or other
  misc_feature (632)..(632): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtcgtccccaccatggcctggatgatgtccttctccgtcggtacttccgtttgggttttgggacagggtagtggtattcncaggtacttggtggtacgacccgaggacgcctacgttcgtttctcgtaggttcgtcccggtagggacggtacaggtaccacgtactcgtacgttggtgtctttagacgtctcgtggtcctctagtccctacctactacctacgtacccctcccccgaagtcccgtaccggtaaccaccgaccgaacccgggacccccggaccaccggtaccctcccgaccgcctacgtcctacgtaacttacccgaacaaacccacgaacacctaccgtcgttccttcgtttccggtccgggtcccngttactccgtttccttacgtcgtttaccgttacctaccggttaccggtaacgaaactaccgtcgtcccctaccgtacccaccggtccggcgggggtacccccgggacacgggactgtagacggtagtgaagtttacggttnttaaggttttaccgttaggttcgtagtttcgtacgttaattgggttacgggtacgttcgggtacgggggtttttgggttacggggttttggggtcccgggtaagggggaacccgggtaggttaaccccggaggtttacccggttcgttaacgggttaccg

SEQ ID NO: 26658 - DNA, 842 bp, Homo sapiens
  misc_feature: GYAE6OF01C7OS9.47.83.H06.1.454.CMB.1.raw
tcagagctcacgtacacgaccggtgctcgatttagatcacgtgcgtcgcgggggaaaagccctgaggaaaacaaacccagctgggaagcctgagaacacttagccttcatgagtcgtccccaccatcggcctggatgatgccttcctccgtcggtaccttccgtttgggttttcgggacagggtagtggtattctcagtactggtggtcgaacccgagggacgcctagttcgttctcgacggttcgtcccggtaggggacgggactagttccaactcctcctacttggtcggtcttgagtcctgtcggctcacgtcctaccactacactaccctccccagtcctacggtaaccacggcccgaaccgggacccccgggtaccaacgaccctacccgacgaccaccgtcctacacgtacctaacaacctaacacgtaccaccgttccgtcctttccgtttaccggtcggggttacccttacggtctttccgtaccttttccgttaccggtttaccggttacccttacgtttaacccgggttaacgggtaaaacctaacggtcccttacccggtacccctaaccgtacccgtacccgggtcccggggacccgggggtacccgaacggtcgtaacggtactacgggtaggtacggttaaggtacggtttaacgttagtttaacgtttacggttcggttacggttcgtcccgtttaagtacggttaacgggtgggtaccggttacggggtttgggtttacggggttttggggttacgggttcccgggggtaacggtaacccggggtaacgttacggttaccggtcccgggtttaaacgttcccgggg

SEQ ID NO: 26659 - DNA, 819 bp, Homo sapiens
  misc_feature: GYAE6OF01CYOWZ.47.83.H06.1.454.CMB.1.raw
tcagagctcacgtacacgaccggtgctcgatttagatcacgtgcgtcggcgggggaaaaggccctgaaggaaaacaaaccccagctgggaagcctgagaacacttagccttcatgagtcgtcccaccatggcctggatgatgcttcctcctcggtacttccgttgggttttgggacagggagtggattctcagactggtggtcgacccgaggacgcctacttcgttctctaggtcgtccggtgggagggacagtcaccactctacgttggtggtcttggacgtctcgtcggtctcgtacttcctacctactacctaacttacccctaccccgacggtccgtacggtacccgacggaacccgacccgggacccccggaccaaccgaccgacccgaccgcctacccgctacctaactacaaacaacaaccaacgaccactccgtccttccgttacgtccgggtacctggtaccgttccgttcctttccggttccgttaccgggttaccctacgtttaccgggttaaacgaaaccgtaaccgtcccgtacccgtaccctaccgtaaccggtcgggacccggggccggggtaacccaaggaccaaggtacgtaggtacgtagggtacggtagttagttaacgttttacgtacggttggttaccgttcgggtaccttaggttaccggtaagggttcgggtacgggtttacggggttccggggttttaggggttttcccgggggttacggggttaacccgggggtacggttaacccgggggaaacgttaccgggtccgttaaccggggttacccggtttaacggg

SEQ ID NO: 26660 - DNA, 694 bp, Homo sapiens
  misc_feature: GYAE6OF01BYK3M.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtcgacccaggacgccatcgttctcaggtcgtcccgtggagggacagtcacactcacttgtggcttgagctctggctcagtcctccactacactaccctcccccagtcctacggtacccagccgaccggacccccgggtcacgacctcccgacgccacgcctcactctaacaacacacgaccactcgctcttcgtcgggtcctgactcgtcttctcgttcgttcctacgttcccgttagggaaacctaacggtcctccgacccctaccgaccgtacggtcccggggcccgggggaccccacgggcctacggtacgtacggtagtggtaacggtggttacgttacttttaacgttacgttggttgtaccgttcgttacgttagttacggtcggggtacgtaggggtttcgggttacgggggttttcggggttacgggttaccgggggtacggggtaaccggggtaacccgtaaggtccggttaccgggtcccggtttaccgggg

SEQ ID NO: 26661 - DNA, 722 bp, Homo sapiens
  misc_feature: GYAE6OF01D0E8U.47.83.H06.1.454.CMB.1.raw
  modified_base (270)..(270): a, c, t, g, unknown or other
  misc_feature (270)..(270): n is a, c, g, or t
  modified_base (629)..(629): a, c, t, g, unknown or other
  misc_feature (629)..(629): n is a, c, g, or t
tcagagctcacgtacacgaccggtgctcgatttagatcacgtgcgtcgcggggaaagcctgaggaaaacaaacccagctgggaagcctgagaacacttagccttcatgagtcgtccccacatggcctggatgatgcttctccgtcggacttccgtttggttttagggacagggagtggatttcgcagtactggtcggtcgaacccgaggacgccagttccgttctacaggttcgtccggtggaacgggacagtcaccactctacgttggnggtcttgacgtcctcgtggctcgacgtcctccaacttacactacccgtcccccaagtccgtaggtaccaggccaccggtaccccgggacacggacctccaacggcaccgtctagactaccgtaacaacgacacgactcctacgtcttcgttcgtcgggtcctagcgttccgtctcgttcgtacgttcctaggttccgtaacggaacacgtccgtacgtacccgtacgaccggtacggtccggggcccgggacccgtaggaccgtaagtccgttacggattacgggtattcgggttaattaacgtttaacgttagtttcgtagttcgttaaccgttagtaacgtttggacggttaccggngggtttaccggggtttgggttttacgggcgggggtttacgtaaccggggaccgggttaactccggttaccggttccggtaaacccgggttcgg

SEQ ID NO: 26662 - DNA, 915 bp, Homo sapiens
  misc_feature: GYAE6OF01DRMM9.47.83.H06.1.454.CMB.1.raw
tcagagctcacgtacacgaccggtgctcgatttagatcacgtgcgtcggcggggggggaagcctgagaacacttagccttcatgagtcgtccccaccatggcctggatgatgtccttcctccgtcggacctccgtttggttttgggacagggagtgattctcgagacgtggtggtcgacccgaggacgcctattcgttctcaggttcgttccggtggacgggacagtccaccactcctacgtttggtggtctttagagtccttcgtcggcttacgtacgttcctacccaactacaaccttacccgtcccccgagtcccgtacggtaacccacggaccggtaacccgggaccccgggaacgaccgtaccccgtcccgaacccggacctaccgtccttactaccgttaccctaaaaccaaaccgaaccgaaccgtaaccttccccgtcgtaccgtttcccgtttcgggttcccgggttaccctagttacgttccgttcccttttaccgttcgtttcgttacccgtacgttaaccggttaacggaaaaccgtaacgtcccgttacctcccgtaccgtaaccgtaccggggtccccggggaccggggtaccccgaagggaacgtagtacggtaacggtaggttacgggtaaggtttggttaacgtttaacttttaagttccgtttaggttccgttcgttaccgttaagttaacggtttggggtaaccgggttagtttacggggtttggggttaccggggtttagggttaccggggtccgggaaaccggggttacgaaacccggttcggttacccggttaaacccgggtttcccgtttaccggggttaaccgtcccccggtaaaccgggtaacccccggtccggtttacccccgggtccccgtttaccccggtttacccg

SEQ ID NO: 26663 - DNA, 660 bp, Homo sapiens
  misc_feature: GYAE6OF01CJPXU.47.83.H06.1.454.CMB.1.raw
tcagagctcacgtacacgaccggtgctcgatttagatcacgtgcgtcgcgggggggaagcctgagaacacttagccttcatgagtgtccccaccatggcctggatgatgcttctcctcggactccttggtttgggacaggagtggattctcagactgtggtgacccaggagccatcgttctcagtcgtcccgtggagggacagtcacactctacttgtggcttgagctctgctcagtcctaccactacactaccctccccagtctcggtaccagaccgaccggaccccggccacgacctccgacgccaccgctctactcctaacaacacacgaccactcgccttcgttcgtcgggtcctgtactcgtcttctctcggttcctacgttacgttacgggaaactaacgtccgtaccgtccctaccgaacccgtacggtaccggggcccggggaccaacggcgaagtagcgtagtagtagttgttagttaactttatttcgtggtgttcgtacgtgttaagtcgggtggtcgttagggttcgggttacggtttcgggtcgggttcgggaccgggtaacgggaacgtaccgggttcgttacggtccggtacgttacggtccgaccggacccgtacggtcccgttaccccgggtcccgttcccgg

SEQ ID NO: 26664 - DNA, 761 bp, Homo sapiens
  misc_feature: GYAE6OF01CMVYY.47.83.H06.1.454.CMB.1.raw
tcagagctcacgtacacgaccggtgctcgattagatcacgtgcgtcgcgggggcatcacataacaaccacattcctcctctgaagaagcccctgggagcacagctcatcaccatggactggacctggaggttcctctttgtggtggcagcagctacgaggtgtccagtccctggtgcagctggagcgagtcgtggggctgaggtgaaggaacgccgtgggtccgtcgggtagaagggtcctccgtagccaccggtccccctgccacggactaacccttcacgacctaaccttacttaccttcagtcgtgggtacgaccgacgaccggtccccgtagggacgtaacgggtctttaggagggttcgggaaggttcgggggtaagggggtcccgttacccgttacgtttaccggtttacggtaaacgtaaaacccgtaaaccgtaaccggacccaacggtaaacggtaacccgtttacgggaacgggacccgtaaggtaaccgttaccgaaccgtaacgttaacccgggacggtaacgacggtaacgtaccccgtaacggggcctaaccgagttcccgtaccgtagtacgggtaacgtcggaacggccacgccggttaagaccggtacgtccgggtacggggaccgtaccgggtaacccttagttacgtccgttagggcgaccgggtaagaccgggtacccgttaattaaacgtttgacggtagtttcggtaccggttggtacgtcccgtaacgttcgttacgg

SEQ ID NO: 26665 - DNA, 736 bp, Homo sapiens
  misc_feature: GYAE6OF01B03H7.47.83.H06.1.454.CMB.1.raw
tcagagctcacgtacacgaccggtgctcgattagatcacgtgcgtcgcgggggcatcacataacaaccacattcctcctctgaagaagcccctgggagcacagctcatcaccatggactggacctggaggttcctctttggtggtggcagcagctacaggtgtccagtccctggtgcagctggagcagtcgtggggctggaggtgaagacgtccgtgggtcctcgggtgaacggtcctcctgccgaccggcccctggcaacgacctaccgttcacgacctaacctacttaccgttccgaacggtcgttagggggtacgaccggtaaccgaccgggtccccgtagggaaccgaaaggggtccgtttaggacgggttagggacggtcggggggtacgggttcccgtaccgttaagttccgtttaggtaacaaaccgtaaacgacgtacaacgaacgtaaccgtccgacgggctaaaggacgtacgaaccggtaacgttaccggacgaacgagtaacctcgggaacgggaccaacgtacgttaccctaccggtaagtacgggtacggttcgacggcacggccgttaggacgtacgttacgggacggggtaaccaccgggtaccgttaataccgttcgtaggtaccgggacggaagggtaccggtaccgttaaagtttaaccgtggtacgtaggtcgggttacggttacggtacgaaccctttacggtaggtttaaccgg

SEQ ID NO: 26666 - DNA, 666 bp, Homo sapiens
  misc_feature: GYAE6OF01BMPAB.47.83.H06.1.454.CMB.1.raw
  modified_base (241)..(241): a, c, t, g, unknown or other
  misc_feature (241)..(241): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtcgtccccaccatggcctggatgatgcttctcctcggacttcctttgggttttgggacaggagtggattctcagactggtggtgacccaggacgccatcgttctcagtcgtcccggtggagggacngtcacactctacttgtggtcttggagctctggctcacgtcctccactactactaccctcccccagtcctacggtaccagccgaccggacccccgggccaacggacctcccgaccgccgaccgcctaccactacctaacaaaccaccacgacctactccgtccttcgttcggtcggggtccctgtactccgtcttcttcgttcgttcctacgttacccgtaggaaactaacgtctccgccctaccaccgacggtccgggcccggggtacccgacggcgagacgtgtaacgtggtacgttggttacgtaacgttttacgttagttgtagtcgttactcgttagtacggtacgggtcgttgggttgggtcgggttttggggtcggttacgggacgggtacggtacgagtccgtacggtccggttacgg

SEQ ID NO: 26667 - DNA, 688 bp, Homo sapiens
  misc_feature: GYAE6OF01D858L.47.83.H06.1.454.CMB.1.raw
  modified_base (593)..(593): a, c, t, g, unknown or other
  misc_feature (593)..(593): n is a, c, g, or t
  modified_base (634)..(634): a, c, t, g, unknown or other
  misc_feature (634)..(634): n is a, c, g, or t
tcagagctcacgtacacgaccggtgctcgattagatcacgtgcgtcgcgggggcatcacataacaaccacattcctcctctgaagaagcccctgggagcacagctcatcaccatggactggacctggaggttcctctttgtggtggcagcagctacaggtgtccagtccctggtgcagctggagcagtcgtggggctggaggtgaagaacgccgtgggtcctcggtgaacggtcctccgtgccgaccggcccctgaccagacctaccgttacacgtcctacctatacccttcgacgtcgtgggtcgaccggacgaccggtccccgtaggaacgagggtcttggaggtgggagtcggggacgggttcctacccgttagttcgtttaggaacgtaaactaaacgtacgaccaacgaacgtaaccgttccgagggtacaaggtacgtacgaacgtacgtacccggcggaaccgagaccgtcccggaacgggacaaccgtacggttccctaccgtaggtaggtacgttcggaacgtcgacgccgttaggaacgtagtcgggacggggtaaccgtaccggtccgtaattaccgttagnggttcggaccggtagggaccggtaccgttaaagtttaacgnggttaggtagttcggggttcgtacgggtaccgtaccgttacgttcggttaccgg

SEQ ID NO: 26668 - DNA, 588 bp, Homo sapiens
  misc_feature: GYAE6OF01BXRMI.47.83.H06.1.454.CMB.1.raw
  modified_base (185)..(185): a, c, t, g, unknown or other
  misc_feature (185)..(185): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
tcagagctcacgtacacgaccggtgctcgatttagatcacgtgcgtcgcgggggcccaggcagatgatgagtgtgattattactgtgtgctctatatgggcagtggtcgtttgggtgttcggcggaggaccaagctgaccgttcttaggtcacgccaaggctcgcccctggtcactctcgtcccnccctctctacgtgagtctcgtgacggcggctggacgaacggcgactagtagctngtngcagtcgnctgatctgctctncgtgcaatggntaacgcttgaccgttanacgancgtacgcatcggagtcggatcgacgtagtacgctagtccnggtactcgtcgtgaacgtnttacggngtacgtacgtcgtcgtacgtcgtacgtacggtcgtacgtacgtacgtacgtacgtacgtcgtacgtacgtacgtacgtacgtactacgtacgtaccgtacggtacgtaccgtacgttaccgtaccgtacgtaccgtaccgtacggtacgtacgtacgtccgtacgtacgtacgtaccgtacggtccgttacgtacgtacgtacgtacgtacgtcgtcgtacgtacg

SEQ ID NO: 26669 - DNA, 637 bp, Homo sapiens
  misc_feature: GYAE6OF01D0QGC.47.83.H06.1.454.CMB.1.raw
  modified_base (144)..(144): a, c, t, g, unknown or other
  misc_feature (144)..(144): n is a, c, g, or t
  modified_base (246)..(246): a, c, t, g, unknown or other
  misc_feature (246)..(246): n is a, c, g, or t
  modified_base (553)..(553): a, c, t, g, unknown or other
  misc_feature (553)..(553): n is a, c, g, or t
  modified_base (626)..(626): a, c, t, g, unknown or other
  misc_feature (626)..(626): n is a, c, g, or t
tcagagctcacgtacacgaccggtgctcgatttagatcacgtgcgtcggcgggggaaaggccctgaggaaacaaaccccagctgggaagcctgagaacacttagccttcatgagtgtccccaccatggcctggatgatgcttcncctggactccttggttttcggactaggatggattctcagactgtggtgacccaggagccatcgtctcagtcgtccgtggacgggacagtcacactcacttgnggtcttgagtctctggctcagtctccatacactacctccccagctggtaccagccacggacccggacacggaccctcgacgcgtacgcctacgaactacctaacaaacgacaacgactaacgttcggacttcgttcggtacgggtaccctagtacgtcgttcttcgtcgtcggttaccagttccgtacgggaaactacgtcctaccgcctacgaacctcggtccggacccggggtaccacggtacgaggtactaggtacgtaggtaaacgttgttacgtaacgtttaagttaccggtgttaccggtnacgttaccgtatacgggtgtaccggtgttaggggttcgtttgggtcggttacggacgggtagacccgagtcgngtaccgtacgg

SEQ ID NO: 26670 - DNA, 702 bp, Homo sapiens
  misc_feature: GYAE6OF01B2O8T.47.83.H06.1.454.CMB.1.raw
  modified_base (280)..(280): a, c, t, g, unknown or other
  misc_feature (280)..(280): n is a, c, g, or t
tcagagctcacgtacacgaccggtgctcgatttagatcacgtgcgtcgcgggggaaaagccctgaggaaaacaaacccagctgggaagcctgagaacacttagccttcatgagtgtccccaccatggcctggatgatgctttctcctcggactccgttggttttgggacaggagtggattctcagactggtggtgacccagggacgcctagttccggttctcgaggttcgtcccggtgggacgggacacgttcacacctcacgttgtggacgttgagctntggctcagtcctccactacacttcctcccccagtcgtcgtaccagaccgaccgggacccccggcacgacctcccgaccgctaccgctacctactcctaaacaaccactacgaccacttcgcttccttcgtccggggtccctaggtactcgtcctttaccgtcttccgggttacctacgttcccgttaacgggtaaacctaagcccgtaccggttaccctacgacctaccgggtcccggggccgggggaccccctagggaccagacggttagacggttaggtcttagggttactaagtttacgttacgttcggtcgttctcgttacttaggtaggtcgggttagtcgggttcgggtttcgggtttgggttcggggtcgggacgggtacgggtaaccgaggttcgaaaggttcccggttaacgg

SEQ ID NO: 26671 - DNA, 751 bp, Homo sapiens
  misc_feature: GYAE6OF01DUL6U.47.83.H06.1.454.CMB.1.raw
  modified_base (663)..(663): a, c, t, g, unknown or other
  misc_feature (663)..(663): n is a, c, g, or t
  modified_base (700)..(700): a, c, t, g, unknown or other
  misc_feature (700)..(700): n is a, c, g, or t
tcagagctcacgtacacgaccggtgctcgatttagatcacgtgcgtcggcgggggaaaaggccctgaggaaaacaaaccccagctgggaagcctgagaacacttagccttcatgagtcgtccccaccatggcctggatgatgcttcctcctcggaccttccgttggttttgggacaggagtggattctcagtactgtggtcgaccaggagcctatcgtctcgagtcgtcccgtggaggacagtcacgactacacttggcgtcgttgactcgtcgtcggtcctcgtacgttcctaccaactaacacttaccctacccccctagtaccgtccgggtaaccacggacccgtaaccgggaccccccggggacaccggttaacccgcccgaacggtcccaccgtcctcctacctaacctaaaccaaccaaccgaccgaacctaccgtaccgtcttcccgtttccgggtccggggtcccttaggtacttcccgtcctttaccgttccggtttcgttcccgtaacgtttcccggttaacgggaaactaacggtccgtacccggttccccaactacccgccggtccggggccgggggaccccaggcgagacggtgacgtggtaagttcggtagttactttaacgttgtcggtgtcggtaccttacggttancgggtgggacgtggggtcgggtttcggtttacggggngggttcccgggacgggtacggacgttagtccggtacggttcccggttaagg

SEQ ID NO: 26672 - DNA, 804 bp, Homo sapiens
  misc_feature: GYAE6OF01CCSAL.47.83.H06.1.454.CMB.1.raw
  modified_base (162)..(162): a, c, t, g, unknown or other
  misc_feature (162)..(162): n is a, c, g, or t
  modified_base (380)..(380): a, c, t, g, unknown or other
  misc_feature (380)..(380): n is a, c, g, or t
  modified_base (519)..(519): a, c, t, g, unknown or other
  misc_feature (519)..(519): n is a, c, g, or t
tcagagctcacgtacacgaccggtgctcgattagatcacgtgcgtcgcgggggcatcacataacaaccacattcctcctctgaagaagcccctgggagcacagctcatcaccatggactggacctggaggtttcctctttgtggtggcagcagctacaggtntccagtccctggtcgccagcgtggacgcaggtcgtggggctggtagggtagaaacgaacgccgttgggtacccgtgggtaggaacgggttcctccgtcggaccgaccggcccctagaccgaataccctaccttccacgacctaccttaactaccttcgagtcgttgggtacgcgaccgaccggtcccaggacggaaccggtcgttaggacgtaggggngtacgggggtcggggtacctcccgttagtttacgttaggtaaccgaaacctaaaccgtaccacgtaacgtaacgtaaccgttaccgggacgggtacacggtacgtaccgtaacggtaccgttaaccggccgggtaaacncggtaaccgaccccgtaacgggaccacctacggttccctaacgtagttagggtacgtacggaaccgtcgtaacgcccgtaagggtaaccgtgaccgggttacggggacccgtaaggggttacccttaaagttaccgttaggttacggtcgggtaacccggtaacggggtacgggaaaccccgttttaaaggttaacttaacggggttaccgtaaagggttcggggtttcccggttagggttaaacccccgttccgtttaaaccgggtaccccgggtttttaccgg

SEQ ID NO: 26673 - DNA, 714 bp, Homo sapiens
  misc_feature: GYAE6OF01AUSZW.47.83.H06.1.454.CMB.1.raw
tcagagctcacgtacacgaccggtgctcgattagatcacgtgcgtcgcggggcatcacataacaaccacattcctcctctgaagaagcccctgggagcacagctcatcaccatggactggacctggaggttcctctttgtggtggcagcagctacaggtcgtccagtccctggtgcagctggagcagtcgtggggctggaggtgaagagccttgggtcctcggtgaacggtctcctgcaccggccctgcacgactccttcagccaccttatcccttcgagtcgtggtcgacgacgacggtccctaggacgaagggtcttggaggtgggaacgtggggtacggggtcctaccgttattcggtttaggaacgaacgtaaactcgacaacgtacggtaaccttcgacgggacagacgtcaaccggtacgttacccggacggaacacggtaccgacccggtaccgggaccaaccgtacggttacccgtcccgtaaaggttcggggttaacgtttacggaccggttaacgacgggtccccgtttaaggaacgggtacctttccggggtaacgggggtaacccgtaccgggtacccgtttaattaccgttacgggtccgtggaccgggtacggaaccggtaccccgtaagtttaaacgtcggttaggtaacggtttcggttacggttcggtaccgtaccccgtagttaaccggtttacgg

SEQ ID NO: 26674 - DNA, 227 bp, Homo sapiens
  misc_feature: GYAE6OF02GO3MY.47.83.H06.1.454.CMB.1.raw
  modified_base (226)..(227): a, c, t, g, unknown or other
  misc_feature (226)..(227): n is a, c, g, or t
tcagagctcacgtacacgaccggtgctcgatttagatcacgtgcgtcgcgggcccaggcagatgatgagtgtgattattactgtgtgctctatatgggcagtggcgtttgggtgttcggcggagggaccaagctgaccgtcttaggtcagcccaaggctgcccctcggtcactctgttcccgccctcctctacgtgagctctgagcgggctggcaaggcgcatagnn

SEQ ID NO: 26675 - DNA, 229 bp, Homo sapiens
  misc_feature: GYAE6OF02GAD0B.47.83.H06.1.454.CMB.1.raw
  modified_base (227)..(229): a, c, t, g, unknown or other
  misc_feature (227)..(229): n is a, c, g, or t
tcagagctcacgtacacgaccggtgctcgatttagatcacgtgcgtcgcggggcccaggcagatgatgagtgtgattattactgtgtgctctatatgggcagtggcgtttgggtgttcggcggagggaccaagctgaccgtcttaggtcagcccaaggctgcccctcggtcactctgttcccaccctcctctacgtgagctctgagcgggctggcaaggcgcatagnnn

SEQ ID NO: 26676 - DNA, 248 bp, Homo sapiens
  misc_feature: GYAE6OF02IFCY6.47.83.H06.1.454.CMB.1.raw
  modified_base (230)..(248): a, c, t, g, unknown or other
  misc_feature (230)..(248): n is a, c, g, or t
tcagagctcacgtacacgaccggtgctcgatttagatcacgtgcgtcgcgggcccaggcagatgatgagtgtgattattactgtgtgctctatatgggcagtggcgtttgggtgttcggcggagggaccaagctgaccgtcttaggtcagcccaaggctgccccctcggtcactctgttcccaccctcctctacgtgagctcgtgagcgggctggcaagggccgcatagnnnnnnnnnnnnnnnnnnn

SEQ ID NO: 26677 - DNA, 227 bp, Homo sapiens
  misc_feature: GYAE6OF02H4KBI.47.83.H06.1.454.CMB.1.raw
  modified_base (225)..(227): a, c, t, g, unknown or other
  misc_feature (225)..(227): n is a, c, g, or t
tcagagctcacgtacacgaccggtgctcgatttagatcacgtgcgtcgcgggcccaggcagatgatgagtgtgattattactgtgtgctctatatgggcagtggcgtttgggtgttcggcggagggaccaagctgaccgtcttaggtcagcccaaggctgccccctggtcactctgttcccacctcctctacgtgagctctgagcgggctggcaaggcgcatagnnn

SEQ ID NO: 26678 - DNA, 227 bp, Homo sapiens
  misc_feature: GYAE6OF02HTFTL.47.83.H06.1.454.CMB.1.raw
  modified_base (225)..(227): a, c, t, g, unknown or other
  misc_feature (225)..(227): n is a, c, g, or t
tcagagctcacgtacacgaccggtgctcgatttagatcacgtgcgtcgcgggcccaggcagatgatgagtgtgattattactgtgtgctctatatgggcagtggcgtttgggtgttcggcggagggaccaagctgaccgtcttaggtcagcccaaggctgcccctcggtcactctgttcccacctcctctacgtgagctctgagcgggctggcaaggcgcatagnnn

SEQ ID NO: 26679 - DNA, 230 bp, Homo sapiens; identical to SEQ ID NO: 26609
  misc_feature: GYAE6OF02GUFUR.47.83.H06.1.454.CMB.1.raw
  modified_base (228)..(230): a, c, t, g, unknown or other
  misc_feature (228)..(230): n is a, c, g, or t

SEQ ID NO: 26680 - DNA, 233 bp, Homo sapiens
  misc_feature: GYAE6OF02FTV8E.47.83.H06.1.454.CMB.1.raw
  modified_base (224)..(224): a, c, t, g, unknown or other
  misc_feature (224)..(224): n is a, c, g, or t
  modified_base (230)..(233): a, c, t, g, unknown or other
  misc_feature (230)..(233): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgccccctcggtcactctgttcccgccctcctctacgtgagctctgagcgggctggcaagggcncatagnnnn

SEQ ID NO: 26681 - DNA, 229 bp, Homo sapiens; identical to SEQ ID NO: 26602
  misc_feature: GYAE6OF02GOCAA.47.83.H06.1.454.CMB.1.raw
  modified_base (228)..(229): a, c, t, g, unknown or other
  misc_feature (228)..(229): n is a, c, g, or t

SEQ ID NO: 26682 - DNA, 229 bp, Homo sapiens
  misc_feature: GYAE6OF02HATSX.47.83.H06.1.454.CMB.1.raw
  modified_base (228)..(229): a, c, t, g, unknown or other
  misc_feature (228)..(229): n is a, c, g, or t
tcagagctcacgtacacgaccggtgctcgatttagatcacgtgcgtcgcggggcccaggcagatgatgagtgtgattattactgtgtgctctatatgggcagtggcgtttgggtgttcggcggagggaccaagctgaccgtcttaggtcagcccaaggctgccccctcggtcactctgttcccgccctcctctacgtgagctctgagcgggctggcaaggcgcatagnn

SEQ ID NO: 26683 - DNA, 229 bp, Homo sapiens; identical to SEQ ID NO: 26682
  misc_feature: GYAE6OF02F0FD4.47.83.H06.1.454.CMB.1.raw
  modified_base (228)..(229): a, c, t, g, unknown or other
  misc_feature (228)..(229): n is a, c, g, or t

SEQ ID NO: 26684 - DNA, 278 bp, Homo sapiens
  misc_feature: GYAE6OF02G9Z03.47.83.H06.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (237)..(238): a, c, t, g, unknown or other
  misc_feature (237)..(238): n is a, c, g, or t
  modified_base (240)..(278): a, c, t, g, unknown or other
  misc_feature (240)..(278): n is a, c, g, or t
tcagagctcacgtacacgaccggtgctcgatttagatcacgtgcgttcggcgggggcccaggcagatgatggagtgtgattattactcgtgtgcctctatatcgggcagtggcgtttgggtgttcggcggagggaccaagctgaccgtcttaggtcagcccaaggctgcccccctggtcactctgttcccgccctcctctacgtganctctgagcgggctggcaaggcgcatagnanntnnnnnnnnnnnnnnnnnnnnnnnnnnnnnnnnnnnnnnn

SEQ ID NO: 26685 - DNA, 525 bp, Homo sapiens
  misc_feature: GYAE6OF02HCZ0E.47.83.H06.1.454.CMB.1.raw
  modified_base (453)..(453): a, c, t, g, unknown or other
  misc_feature (453)..(453): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcacgaccccggccagacctccacgcacgctcatctacaacacagacactcgctctctgggtccctgatcgcttctctgtccatcctggaacaagctgccctcaccatcgcggggcccaggcagatgatgagtgtgtattattactgtgtgcttntatagtgggctaggtcggtcggtttgggtcgttcgggcgggtagggaccaaggtcgtacggacccgttacgg

SEQ ID NO: 26686 - DNA, 566 bp, Homo sapiens
  misc_feature: GYAE6OF02IDZSJ.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagcctggtaccagccacggacccccgggccacgacctccacgcacgctcatctacaacacagacactcgctcttcgtcggggtcccctgactcgtcttcctcttcggttcctagttccgttagggaaacaaaggcctcgccctcacccagtccggccggggcccagggcagatgatggagtgtgtattattacgttgtgtgcttatatagtggcgtaggttgggtcggttttggggtcgttcgggcgggtacgggaccaaggtctacggaccgttcgg

SEQ ID NO: 26687 - DNA, 529 bp, Homo sapiens
  misc_feature: GYAE6OF02HV6LU.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggcagactccacgcacgctcatctacaacacagacactcgctcttctcggggtccctgatcgcttctctgttccatcctgggaacaaagctgccctcaccatcgcggggcccaggcagatgatgagtgtgattattactgtgtgcttctatagtgggcaggttggtcggtttgggtggtttcgggcgggtacggggacccaaggtccgtggacccgttcgg

SEQ ID NO: 26688 - DNA, 622 bp, Homo sapiens
  misc_feature: GYAE6OF02GYUP6.47.83.H06.1.454.CMB.1.raw
tcagagctcacgtacacgaccggtgctcgatttagatcacgtgcgtcgcggggggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagcacgaccccgggcagacctccacgcacgctcatctaacaacacagacactcgctcttcgtcggggtccctgactcgtcttctcgttggttcccattccgttagggaaacaaacggtcctcgcccctcacccgacgtccgggccgggggccccagggccaagactggagtggagttggttgaatttattacgtgtgtgtccttactagtagttgggacgtaggttcgggtcggtttggggtcgttccgggacgggtacgggacccgtaaaggtccgttacggtaaccggtttcgttaacggttccgaccgggtaccccgtaaacgggtcccgttcccggtcccccgttacccggg

SEQ ID NO: 26689 - DNA, 233 bp, Homo sapiens
  misc_feature: GYAE6OF02HBYWA.47.83.H06.1.454.CMB.1.raw
  modified_base (229)..(233): a, c, t, g, unknown or other
  misc_feature (229)..(233): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgccccctcggtcactctgttcccaccctcctctacgtgagctctgagcgggctggcaaggcgcatagnnnnn

SEQ ID NO: 26690 - DNA, 233 bp, Homo sapiens
  misc_feature: GYAE6OF02JAIRZ.47.83.H06.1.454.CMB.1.raw
  modified_base (227)..(233): a, c, t, g, unknown or other
  misc_feature (227)..(233): n is a, c, g, or t
tcagagctcacgtacacgaccggtgctcgatttagatcacgtgcgtcgcggggcccaggcagatgatgagtgtgattattactgtgtgctctatatgggcagtggcgtttgggtgttcggcggagggaccaagctgaccgtcttaggtcagcccaaggctgcccctcggtcactctgttcccgccctcctctacgtgagctctgagcgggctggcaaggcgcatagnnnnnnn

SEQ ID NO: 26691 - DNA, 540 bp, Homo sapiens
  misc_feature: GYAE6OF02FW174.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagcagaccccgggccagacctccacgcacgctcatctacaacacagacactcgctcttctcggggtccctgatcgcttctctggttccatcctgggaacaaagctcgccctcaccatccggccggggcccaggcagatgatgagtgtgtattattactgtgtgctctatagtgggctaggtggtcggtttgggtggtttcgggacgggtacgggacccgaaggtccgtaggtacccgttcgg

SEQ ID NO: 26692 - DNA, 578 bp, Homo sapiens
  misc_feature: GYAE6OF02JVNT2.47.83.H06.1.454.CMB.1.raw
  modified_base (421)..(421): a, c, t, g, unknown or other
  misc_feature (421)..(421): n is a, c, g, or t
tcagagctcacgtacacgaccggtgctcgatttagatcacgtgcgtcgcggggggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctccccagcctggtaccagcacgaccccgggccagacctccacgcacgctcatcacaacacacgacactcgctcttctcgggtccctgactcgtcttctctcggttccatccgttaggaacaaagctcgccctcaccacgtccggcggggcccaggcagactgatgagttgngtattacgtattggtgtcgtcttacttacgttaggtcgggtactaggttgggtcggttttggggttacggttcgggacgggacggtaccgtaagtccgtaggtaacccgttgttacggtaccacggtacccgtaaggcccttcggacccccgttcgg

SEQ ID NO: 26693 - DNA, 571 bp, Homo sapiens
  misc_feature: GYAE6OF02F404C.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagcacgaccccgggccagactccacgcacgctcatctacaacacagacactcgctcttcgtcgggtccctgactcgcttctctcggttccatccgttagggaacaaagctcgccctcacccagtccggccggggcccaggcagatgatgagtgtagtatttagttacgtgtcgttcgtcttacgtatgtcgggactagggttcggttcgggttttgggtcggtttacggggcgggtacgggacccgtaaggtccggtacggtaccgtttacgg

SEQ ID NO: 26694 - DNA, 599 bp, Homo sapiens
  misc_feature: GYAE6OF02J19HN.47.83.H06.1.454.CMB.1.raw
  modified_base (247)..(247): a, c, t, g, unknown or other
  misc_feature (247)..(247): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtcccaccatggcctggatgatgcttctcctcggactccttggttttgggacaggagtggattctcagactgtggtgacccaggagccatcgttctcagtgtcccgtggagggacagtcacactcacttgnggcttgagctctggctcagtctccactacatactcccccagctggtaccagcacgaccccggccacgactccacgcacgctcatctacaacacacgacaccncnctctcggtccggtcngtactctctctcgttcgtcncgtcgtacggaaacacgtcnccgtcctaccaccgtacgtccggggccggtacccgacggactacgtacgtagcgtagtggtagtagttaatttacgttacgttagtcgtcgtcttacgttagttgcggtacggtaggttcggttcgggtttcgggttcggttcgggtacggggaaccggaaccgtaggtccgtaccgggtaccgtttaaccgg

SEQ ID NO: 26695 - DNA, 530 bp, Homo sapiens
  misc_feature: GYAE6OF02F1CB8.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcacgaccccgggccagacctccacgcacgctcatctacaacacagacactcgctcttcgtggggtccctgactcgcttctctgtccatccttggaacaagctgccctcaccagtcggccggggcccaggcagatgatgagtgtgatttatactgtgtgctctatagtgggctaggtggtcggtttgggtggttcgggcgggtacgggaccgaaggcgttaggaccgttcgg

SEQ ID NO: 26696 - DNA, 536 bp, Homo sapiens
  misc_feature: GYAE6OF02IO5Q8.47.83.H06.1.454.CMB.1.raw
  modified_base (458)..(458): a, c, t, g, unknown or other
  misc_feature (458)..(458): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagcagccccggccagactccacgcacgctcatctacaacacagacactcgctcttctcgggtccctgactcgcttctctcggttccatccgtaggaacaagctcgccctcaccagtccggcggggcccaggcagatgatgagtgtgtattatcgtgttgngtctcttatgtggctaggttcggtcggtttgggtgttcgggacgggtacgggaccaaggtcgtacggtaccgttacgg

SEQ ID NO: 26697 - DNA, 234 bp, Homo sapiens
  misc_feature: GYAE6OF02HQ2NR.47.83.H06.1.454.CMB.1.raw
  modified_base (227)..(234): a, c, t, g, unknown or other
  misc_feature (227)..(234): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggaggaccaagctgaccgtcttaggtcagcccaaggctgccccctggtcactctgttcccaccctcctctacgtgagctctgagcgggctggcaaggcgcatagnnnnnnnn

SEQ ID NO: 26698 - DNA, 554 bp, Homo sapiens
  misc_feature: GYAE6OF02GP3TX.47.83.H06.1.454.CMB.1.raw
  modified_base (356)..(356): a, c, t, g, unknown or other
  misc_feature (356)..(356): n is a, c, g, or t
  modified_base (437)..(437): a, c, t, g, unknown or other
  misc_feature (437)..(437): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccggccagacctccacgcacgctcatctacaacacagacactcgctcttcngggtccctgatcgcttctctgttccatccgttggaacaagctcgccctcaccctagtccgcggggcccaggcagatgatgngtgtgtattattacgtgtgtcgtctcttatagtggtcgtagggttcggttcgggttttgggttggttccgggcggggtacgggtacccgtaaggtcgttacggtacccgttaccggg

SEQ ID NO: 26699 - DNA, 253 bp, Homo sapiens
  misc_feature: GYAE6OF02GR7HX.47.83.H06.1.454.CMB.1.raw
  modified_base (232)..(253): a, c, t, g, unknown or other
  misc_feature (232)..(253): n is a, c, g, or t
tcagagctcacgtacacgaccggtgctcgatttagatcacgtgcgtcggcggggcccaggcagatgagtgagtgtgattattactgtgtgctctatatgggcagtggcgtttgggtgttcggcggagggaccaagctgaccgtcttaggtcagcccaaggctgccccctggtcactctgttccccgccctcctctacgtgagctctgagcgggcctggccaaggcgcatagnnnnnnnnnnnnnnnnnnnnnn

SEQ ID NO: 26700 - DNA, 589 bp, Homo sapiens
  misc_feature: GYAE6OF02G1DJZ.47.83.H06.1.454.CMB.1.raw
  modified_base (170)..(170): a, c, t, g, unknown or other
  misc_feature (170)..(170): n is a, c, g, or t
  modified_base (249)..(249): a, c, t, g, unknown or other
  misc_feature (249)..(249): n is a, c, g, or t
tcagagctcacgtacacgaccggtgctcgatttagatcacgtgcgtcggcgggggaaaagggccctgaggaaaacaaaccccagctgggaagcctgagaacacttagccttccatgagtgtcccacactcggcctggatgatgcttctcctcggactcctggtttggacnggagtggattctcagacctgtgtgacccaggagccatcgttctcagtgtcccgtggagggacagtcacacgtcacttgnggcttgagcttctggctcagtctccactacatactccccagcctggtaccagcagaccccggcagacctccacgcacgctcatctacaacacagacactcgctctctaggggtccctgactcgcttctctcggttccatccttagggaacaaatctcgccctcaccatccggcggggtcccagggtccagagtgagttcggaagtgttagtaactttagttaaccttggttacggtgccgttactaagtacgtgggtaccgtagggttacggtcggttttggggtcgtttccgggacgggtaccgggtaccgaaggtccgtacggtacccgtttaccggg

SEQ ID NO: 26701 - DNA, 565 bp, Homo sapiens
  misc_feature: GYAE6OF02GLWG8.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagcagaccccggccagacctccacgcacgctcatctacaacacagacactcgctcttctgggtccctgatcgcttctctgttccatccttggaacaagctgccctcaccacgtcggcggggcccaggcagatggatgagtgtagtattattacgtgttgtcgtctctagtagtgggtcgaagggttcgggttcggtttggggttcgggtttaccggggcgggtaacggggtaccgaagggtccgttacgggtacccggtttaccggg

SEQ ID NO: 26702 - DNA, 231 bp, Homo sapiens; identical to SEQ ID NO: 26623
  misc_feature: GYAE6OF02JBRWQ.47.83.H06.1.454.CMB.1.raw
  modified_base (229)..(231): a, c, t, g, unknown or other
  misc_feature (229)..(231): n is a, c, g, or t

SEQ ID NO: 26703 - DNA, 241 bp, Homo sapiens
  misc_feature: GYAE6OF02ITBL4.47.83.H06.1.454.CMB.1.raw
  modified_base (233)..(241): a, c, t, g, unknown or other
  misc_feature (233)..(241): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctcgcccccctggtcactctcgttcccaccctcctctacgtgagctctggaggcgggctggcaaggcgcatagnnnnnnnnn

SEQ ID NO: 26704 - DNA, 575 bp, Homo sapiens
  misc_feature: GYAE6OF02HZI9M.47.83.H06.1.454.CMB.1.raw
  modified_base (169)..(169): a, c, t, g, unknown or other
  misc_feature (169)..(169): n is a, c, g, or t
  modified_base (181)..(181): a, c, t, g, unknown or other
  misc_feature (181)..(181): n is a, c, g, or t
  modified_base (189)..(189): a, c, t, g, unknown or other
  misc_feature (189)..(189): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (438)..(438): a, c, t, g, unknown or other
  misc_feature (438)..(438): n is a, c, g, or t
tcagagctcacgtacacgaccggtgctcgatttagatcacgtgcgtcgcgggggaaaaggcccgtgaggaaaacaaacccaagctgggaagcctgagaacacttagcttcatgagtcgtcccaccatggcctggatgatgcttctcctcggactccttggtttgggacnggagtggattcncagactgnggtgacccaggagccatcgttctcagtcgtcccgtggagggacagtcacnctcacttgnggcttgagctcgtggctcagtctctactacatacctccccagctacggtaccagcacgaccccggccaacgacctccacgcacgcncactcacaacacagacacncgctctctcgggtcctgactcgcttctctcgtccatcctggaacaagctcgcctcacacgtcggcgggcccgagcagacagtacnggtagtgtgtattaactcgtagttcgtacgtctcgtataggtcggtataacgggttggttcgggtttacggggttcggttccgggtacggggtaacgggtaacccggtaacggtcgttaccggtaccggttaaccgg

SEQ ID NO: 26705 - DNA, 240 bp, Homo sapiens
  misc_feature: GYAE6OF02HNRGS.47.83.H06.1.454.CMB.1.raw
  modified_base (229)..(240): a, c, t, g, unknown or other
  misc_feature (229)..(240): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgccccctggtcactctgttcccaccctcctctacgtgagcctctgagcgggctggcaaggcgcatagnnnnnnnnnnnn

SEQ ID NO: 26706 - DNA, 551 bp, Homo sapiens
  misc_feature: GYAE6OF02FJWIP.47.83.H06.1.454.CMB.1.raw
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (445)..(445): a, c, t, g, unknown or other
  misc_feature (445)..(445): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggacgggacagtcacactcacttgtggcttgagctctggctcagtctccactacatacctccccccagcctgtaccagcagaccccgggcacgactccacgcacgctcactcacacacngacactcgctcttcgngggtcccngatcgcttctctcggtccacttccgtagggaaactaacggcctcgcccctacacccatccggccggggcccaggcagntgatgagtgtagtattaagttactgtgtcgctatatacgtgggctagggtggttcgggtttggttcggtcgggaccggtagggaccaggcgttcgtaccgttccgg

SEQ ID NO: 26707 - DNA, 559 bp, Homo sapiens
  misc_feature: GYAE6OF02GLDD1.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagccagacccccggccagacctccacgcacgctcatctacaacacagacactcgctcttcgtcggggtccctgactcgcttctctggttccatcctagggaacaagctcgccctcaccacgtccggccggggcccaggcagatgatgagtgtgtatttattacgtgtgtcgtctacttagtagtgggctagggttcgggttcggtttggggttcggttcgggacgggtacgggaccgaaggtccgttacggtaccgttcgg

SEQ ID NO: 26708 - DNA, 233 bp, Homo sapiens
  misc_feature: GYAE6OF02GQX6Z.47.83.H06.1.454.CMB.1.raw
  modified_base (228)..(233): a, c, t, g, unknown or other
  misc_feature (228)..(233): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcctaggtcagcccaaggctgccccctggtcactctgttcccgccctcctctacgtgagctctgagcgggctggcaaggcgcatagnnnnnn

SEQ ID NO: 26709 - DNA, 713 bp, Homo sapiens
  misc_feature: GYAE6OF02IK3FM.47.83.H06.1.454.CMB.1.raw
  modified_base (281)..(281): a, c, t, g, unknown or other
  misc_feature (281)..(281): n is a, c, g, or t
tcagagctcacgtacacgaccggtgctcgattagatcacgtgcgtcgcgggggcatcacataacaaccacattcctcctctgaagaagcccctgggagcacagctcatcaccatggacgtggacctggaggttcctctttgtggtggcagcagctacaggtgtccagtccctggtgcagctggagcagtctggggctgaggtgaagaagcctgggtcctcggtgaaggtctcctgcacggcccctgcagacaccttcagcacctataccttcagctgggtncgacacggcccctggacaagggcttgagtggagtggggacggggttcgtcccgttatcgttttaggtaagaaacctaaaacgtaccggacaacgaacggtaaacctttaccgaaggggaccaaggtacgtaccgaacgtaacgtttaacccggacggaaccgaacggaacgttaccccgaaccggggacctaacgacggttacccgtaccgtaagttacgggtagtttacggaacggtaccgaacgggtaccgttggaaacggtacgttaccgggtacgggggaacccgtaccgggtacccgtttaaattacgttttaaccgtcggttacggaccggaacggtaccgggtaccccgtaaagtttaaacgttaggttacggtaaggttcgggttaccggttgggttaccggaccctacgttacgttttaccgg

SEQ ID NO: 26710 - DNA, 522 bp, Homo sapiens
  misc_feature: GYAE6OF02FHODZ.47.83.H06.1.454.CMB.1.raw
  modified_base (451)..(451): a, c, t, g, unknown or other
  misc_feature (451)..(451): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggtttttgggacaggagtggattctcagactgtggtgacccaggagccatcgttctcagtgtcccgtggagggacagtcacactcacttgtggcttgagctctggctcagtctccactacatacctcccccagctgtaccagcagaccccggcagactcacgcacgctcatctacaacacagacactcgctcttctcgggtcctgatcgcttctctgttccatcgtgggaacaaagctgccctcaccatccgcgggggcccaggcagatgatgagtgtagatttattactgtntgctctagtagtggcgtaggtggtcggtttgggttgttcgggcggtacgggaccaaggctagtaccgtacg

SEQ ID NO: 26711 - DNA, 543 bp, Homo sapiens
  misc_feature: GYAE6OF02IVSVE.47.83.H06.1.454.CMB.1.raw
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (461)..(462): a, c, t, g, unknown or other
  misc_feature (461)..(462): n is a, c, g, or t
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
  modified_base (515)..(515): a, c, t, g, unknown or other
  misc_feature (515)..(515): n is a, c, g, or t
tcagagctcacgtacacgaccggtgctcgatttagatcacgtgcgtcgcgggggaaaggccctgaggaaacaaaccccagctgggaagcctgagaacacttagccttcatgagtgtccccaccatggcctggatgatgcttctcctcggactccttggttttgggacaggagtggattctcagtactgtggtnacccaggagccattcgttcnctagtcgtcccgtggagggacaggtcacactcacttgtgcttgngctctggctcagtctccactanactacctcccccagctgtaccagcacgccccgggcagctccacgcacgctnatctacaacacagacactcgctacttcgtcgggtcccagtactccgtcttctcgtcggtttccacttccgttaggaacaacgtctacggcctacacctacgtcggccgggtaccagcagctgacngntgtnnttatcgtcgtgtnctntagtgnggtactaggtcggtcggttggttcgttcggngggacggacctaggcttcgacgttacgg

SEQ ID NO: 26712 - DNA, 239 bp, Homo sapiens
  misc_feature: GYAE6OF02FOOTI.47.83.H06.1.454.CMB.1.raw
  modified_base (229)..(239): a, c, t, g, unknown or other
  misc_feature (229)..(239): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgccccctcggtcactctgttcccaccctcctctacgtgagctctgagcgggctggcaaggcgcatagnnnnnnnnnnn

SEQ ID NO: 26713 - DNA, 238 bp, Homo sapiens
  misc_feature: GYAE6OF02IEVJ4.47.83.H06.1.454.CMB.1.raw
  modified_base (222)..(222): a, c, t, g, unknown or other
  misc_feature (222)..(222): n is a, c, g, or t
  modified_base (228)..(238): a, c, t, g, unknown or other
  misc_feature (228)..(238): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgcccccctggtcactctgttcccgccctctctacgtgacgctctgagcgggctggcaggcncatagnnnnnnnnnnn

SEQ ID NO: 26714 - DNA, 575 bp, Homo sapiens
  misc_feature: GYAE6OF02GSKUO.47.83.H06.1.454.CMB.1.raw
tcagagctcacgtacacgaccggtgctcgatttagatcacgtgcgtacggacgggggaaaaggccctgaggaaaacaaaccccagctcgggaacgcctgagaacacttagccttcagtgagtcgtaccccgaccatggcctggatgatgcttctcctcggactccttggttttgggacaggagtggattctcagactgtggtgacccatgagccatcgttctcagtgtcccgtggaggacagtcacactcacttgtggcttgagctctggctcagtctccactacatacctccccagcctggtaccagcacgaccccggcagacctccacgcacgctcactcctaacaacacagaccactcgcttctcgtcgggtccctagctcgcttctctgtccatccgtaggaactaagctcgccctacacctagtccggccggggacccaggccagctagacgtggagtcgtgtaagtttacttacgtgttagtcgtacttactagttaggtgggtcgtaggttcgggtcggttttgggtcggttacgggacgggtagggacccaggtccgtcgtacccgg

SEQ ID NO: 26715 - DNA, 658 bp, Homo sapiens
  misc_feature: GYAE6OF02G7A5D.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactcctttggttttgggacaggagtggattctcagactgtggtgacccaggagccatcgttctcagtcgtcccgtggagggacagtcacactcacttgtggcttagagtctcgtggctcagtcctccactacactacctcccccagctaggtaccagccacggacccccgggccacgacctcccacgccacgcctacactcctaacaaccacacgacacctcgccttcttcggtcgggtccctgtactccgtcctttcgtccgtcggttccctacgttcccgttacgggaactaaaccttcgtcgcccctacgacctcgtcccgggccggggtcccacggactagatacggagtcggagttgtagttaatttacgtttactggttgtacgttcgttacttagtacggttacgggacgtgggttcgggttacgggttttggggttacggttccgggggtacgggtaccggggtaccgtaacggtcggttaccgttaccggtttaccgg

SEQ ID NO: 26716 - DNA, 237 bp, Homo sapiens
  misc_feature: GYAE6OF02FN8CE.47.83.H06.1.454.CMB.1.raw
  modified_base (232)..(237): a, c, t, g, unknown or other
  misc_feature (232)..(237): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctcgccccctcggtcactctcgttcccgccctcctctacgtgagctctggagcgggctggcaaggcgcatagnnnnnn

SEQ ID NO: 26717 - DNA, 796 bp, Homo sapiens
  misc_feature: GYAE6OF02HZ5V2.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgctttctccctcggacttccgtttggttttggacaggagtggattctcagactgtggtgacccaggagccatcgttctcagtcgtcccggtggagggacagtcacactcacgtggtgtcttgacgtctcgtggccttctacgtcctcctaactaccacttacccctaccccccgagtccgttacggtaacccacgaccgacccgggacccccgggaccaacggtaccctacccacgcccaaccgcctacctactaccctaacaaccacacgacctcctacgccttccgttcggtcgggtccctgtacttcgttcctttcgtcggtttccgttaccctacgtttacccggttaacgggaaaccgtaacgtcccgttacgtacccccttaccgaacccgtacccgggttacccgggggacccccggggttacccgaacggggtaccgtaaggtacgttaacgggtacgtacgggttaacgttcgggttaaagtttactttttaacggttcggttagtttcggttacgtacccgtttagttaggtaccgggttggggttaccgtggggtttacgggtttcggggttttcgggttagggttcccggggacggggtaaccgggaaccgttaccgggttcgtaccgggttacgtttaaccggg

SEQ ID NO: 26718 - DNA, 238 bp, Homo sapiens
  misc_feature: GYAE6OF02F99OM.47.83.H06.1.454.CMB.1.raw
  modified_base (201)..(201): a, c, t, g, unknown or other
  misc_feature (201)..(201): n is a, c, g, or t
  modified_base (229)..(238): a, c, t, g, unknown or other
  misc_feature (229)..(238): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctgcccccctggtcactctgttcccaccctcctctacgtganctctgagcgggctggcaaggcgcatagnnnnnnnnnn

SEQ ID NO: 26719 - DNA, 552 bp, Homo sapiens
  misc_feature: GYAE6OF02GBIW2.47.83.H06.1.454.CMB.1.raw
  modified_base (436)..(436): a, c, t, g, unknown or other
  misc_feature (436)..(436): n is a, c, g, or t
  modified_base (470)..(470): a, c, t, g, unknown or other
  misc_feature (470)..(470): n is a, c, g, or t
tcagagctcacgtacacgaccggtgctcgatttagatcacgtgcgtcgcggggaaaaggccctgaggaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggaggacagtcacactcacttgtggcttgagctctggctcagtctccactacatactcccccagcctggtaccagcacgaccccgggccagacctccacgccacgctcatctacaacacagaccactcgctcttcgtcgggtccctgatcgcttctctgttccatcctagggaactaagctgccctcacctagcggccggggcccagggcagangatgagtggttgtaatttattacgtgttgtcgtnttctagtagtcgggtcgtggttggttcggttttgggtggtttccgggcggtacgggaccacggtcgtacggtaccgttacgg

SEQ ID NO: 26720 - DNA, 629 bp, Homo sapiens
  misc_feature: GYAE6OF02I09VG.47.83.H06.1.454.CMB.1.raw
  modified_base (206)..(206): a, c, t, g, unknown or other
  misc_feature (206)..(206): n is a, c, g, or t
  modified_base (263)..(263): a, c, t, g, unknown or other
  misc_feature (263)..(263): n is a, c, g, or t
  modified_base (390)..(390): a, c, t, g, unknown or other
  misc_feature (390)..(390): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactcctttggttttgggacaggagtggacttctctagactgtggtgacccagganccatcgttctcagtcgtcccgtggagggacagtcactctcacttgtggcttgatctntggctcagtctccactacataccctccccagctacggtacccagcaccggaccccggcacgacctccgacgccaccgctcatcctaccaacacacgacacctctctcttcggtcggtcctgacttcncttctcgttctcctacgttccgtaggaacaacgtctcctccctacaccgtcggtccgggccgggacccgaggacgacgtagtgtaggtcgtaggttacgttagtaactttgttacggttgttcgtacgtgttaccgtaagttaggtacggtcggtagggtttgggtttacgggttcgggtttacgggtccggggtacgggtacgggacgtaacggttcggtaccggttacggttaccgg

SEQ ID NO: 26721 - DNA, 618 bp, Homo sapiens
  misc_feature: GYAE6OF02HO3OF.47.83.H06.1.454.CMB.1.raw
  modified_base (233)..(233): a, c, t, g, unknown or other
  misc_feature (233)..(233): n is a, c, g, or t
  modified_base (298)..(298): a, c, t, g, unknown or other
  misc_feature (298)..(298): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacngtcacactcacttgtggcttgagctctggctcagtctccactacatactcccccagctggtaccngcacgaccccgggcacgcctccacgcaccgctacactctaacaacacagaccactcgcctcgttcgtcgggtccctgactccgtctttctcgttcggttccacgttccgttagggaaacaaacgtccgtacgcccctacgaccacgttcccgggaccgggggcccacggaccaggtactgactaggtcgttagtagtagtttaagtacttaggtcgtatccgttagttacgtagtcgggtactaggtcgggttcgggttttagggtcgggttacgggacggtacgggacccgtaaggtcccgttaggtacccgttaacgg

SEQ ID NO: 26722 - DNA, 854 bp, Homo sapiens
  misc_feature: GYAE6OF02IQJUY.47.83.H06.1.454.CMB.1.raw
tcagagctcacgtacacgaccggtgctcgattagatcacgtgcgtcgcgggggcatcacataacaaccacattcctcctctgaagaagcccctgggagcacagctcatcaccatggactggacctggaggttcctctttgtggtggcagcagctacaggtatccagtccctggtgcagcgtggagcagtcgtggggctggaggtgaagaacgccgtggtcctacggtgaaggtcctccgtgcgacggcccctgcagacctaccgttcagcctaactactacccttcacgtcgttgggtacgaccggacgtaccgggacccccggtggggaaccgtaacgggggtcctttacgggaaggtttacgggacgggtagggggtaacgggggtttccgttaccccgtttaaggttccggttttagggtaaacgaaaccgtaaaaccggttaccggaccgtaaacccggtaaacggtaaaccgtttaccgggaacggggtaaccaaacgggtacgttacccgaaaccgggttaaaccgtttaacccggggacccgggtaaaccgtaaacgggtacccgttaacccgggaaacccggggtaccgtaaccgggttaacgttaccccgtaacccgttaaggttacggggtaagtttacgggaaccgtaccggtaccggtccgtaggtaacgttaacggtccggttaacgggggaaccgtaccgggtacgtttaacgttaacgtttacgtacgggttcggaccggtaacgggtaccgggtaacccgttaaagtttaaagtacgttagggtaacgttcggggtttaccggtacggttccggtacccttaacgtacgtttaacggg

SEQ ID NO: 26723 - DNA, 674 bp, Homo sapiens
  misc_feature: GYAE6OF02F9ZXX.47.83.H06.1.454.CMB.1.raw
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
  modified_base (536)..(536): a, c, t, g, unknown or other
  misc_feature (536)..(536): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagacttggtggtgacccaggacgccatcgttctcagtcgtccggtggaggacagtcacnctcacttgtggcttgagtctntggtctcacgtcctaccacttacactacctcccccagctcggtaccagcgaccggccccgggcacggacctccacgccacgcctacactacctacaaacacagaccactcgcttccgtttcggtccgggtccctagtactcgtaccttcgttccgtcggttccctacgtttaccggttaaggtaaacctaaacgtccgtccgtaccctaccgacctaacggtccgggaccgggggaccctaaggcctaagaccgtaggtaccgtgtaccggtnttagtacgtttacgttcgttaggtcgtacgttctacgttacgttgtacggggtcctaaggttcgggttacgggttttagggtcgggttaccgggtaccgggacggttaccgtaggtcccgtacggttccggttaccgg

SEQ ID NO: 26724 - DNA, 238 bp, Homo sapiens
  misc_feature: GYAE6OF02GPAYK.47.83.H06.1.454.CMB.1.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (230)..(238): a, c, t, g, unknown or other
  misc_feature (230)..(238): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggagggaccaagctgaccgtcttaggtcagcccaaggctcgccccctcggtcactctcgttcccgccctcctctacgtgngctcgtgagcggctggcaggcncatagnnnnnnnnn

SEQ ID NO: 26725 - DNA, 703 bp, Homo sapiens
  misc_feature: GYAE6OF02JMBA0.47.83.H06.1.454.CMB.1.raw
  modified_base (389)..(389): a, c, t, g, unknown or other
  misc_feature (389)..(389): n is a, c, g, or t
  modified_base (463)..(463): a, c, t, g, unknown or other
  misc_feature (463)..(463): n is a, c, g, or t
  modified_base (529)..(529): a, c, t, g, unknown or other
  misc_feature (529)..(529): n is a, c, g, or t
tcagagctcacgtacacgaccggtgctcgatttagatcacgtgcgtcgcgggggaaaaggccctgaggaaacaaacccagctgggaagcctgagaacacttagccttcatgagtgtccccaccatggcctggatgatgcttctcctcggactccttggttttgggactaggagtggacttctcagactgtggtgacccaggagccatcgttctcagtcgtcccgtgacgggacagtacaccactcactttgtggcgtttgagtcttcgtggtctcagttcctccactacactaccctcccccaagtcgtcgtaccacgccacggaccccgggccacgacctaccgccgcaccgcttacaccttacctaaccaacacacgtacacctccncttaccgttcgtcggggtccctagctcgtacttcctgtcgttcctagtccctttagggaaacctacgtccctcncctaccgtacctggacccggtccggggccccaaggaccgagtacgttacgacggtgtaacgggttntacgtttaagtttagttacgttggtttccgtacgtctttaacgttaaccgtgtcggggttaccgttggggttaccgggttttgggttttaacgggggttccgtttccggggggaaacgggttaccgggaaccgaacccggggtttacgtttccccgggttaaccgggtttccgg

SEQ ID NO: 26726 - DNA, 629 bp, Homo sapiens
  misc_feature: GYAE6OF02FXCQN.47.83.H06.1.454.CMB.1.raw
  modified_base (494)..(494): a, c, t, g, unknown or other
  misc_feature (494)..(494): n is a, c, g, or t
  modified_base (520)..(520): a, c, t, g, unknown or other
  misc_feature (520)..(520): n is a, c, g, or t
  modified_base (540)..(540): a, c, t, g, unknown or other
  misc_feature (540)..(540): n is a, c, g, or t
  modified_base (566)..(566): a, c, t, g, unknown or other
  misc_feature (566)..(566): n is a, c, g, or t
tcagagctcacgtacacgaccggtgctcgattagatcacgtgcgtcgcgggggcatcacataacaaccacattcctcctctgaagaagcccctgggagcacagctcatcaccatggactggacctggaggttcctctttgtggtggcagcagctacaggtgtccagtccctggtgcagcgtggagcagtcgtgggctgaggtagaagagccgtgggtcctcggtgaacggtctcctgccgaccggtccctgacacgacctaccgttcgacgcctaacctactacccttcaggtcgtagggcgtccgaccgaccggcccgtggaaccggaacgggtcttaggagtggaggtcggggtacggtccgttaccgttagttcgtttaggtaacgtaaactaaacgtacacgtaacgacgtaaccgtccgaaggcgtagtacgtacgaacgtacgttacccgggacgacgaacgacgtaccggacggtacactcgtaccncgtagttggtagtacgcgtcacgtcngtagctacggtcgggaaccncggtcttaagtacttacgtgtaccgngaccggtagtaacctagtaacgttcaggtcgttacggtcgttcgaccgtctagttactaccgg

SEQ ID NO: 26727 - DNA, 632 bp, Homo sapiens
  misc_feature: GYAE6OF02HKOBU.47.83.H06.1.454.CMB.1.raw
  modified_base (425)..(425): a, c, t, g, unknown or other
  misc_feature (425)..(425): n is a, c, g, or t
  modified_base (455)..(455): a, c, t, g, unknown or other
  misc_feature (455)..(455): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
tcagagctcacgtacacgaccggtgctcgatttagatcacgtgcgtcggcgggggaaaaggccctgaggaaaacaaaccccagctgggaagcctgagaacacttagccttcatgagtgtccccaccatggcctggatgatgcttctccttcggacttccgttggttttagggacagggagtggatttctcagactggtggtgacccaggacgccatccgttactcaggtcgtcccgtgggagggacagtcacactcacttgtggcttgagtctcgtggctcagtctccactacactacctcccccagcctcggtaccagccacggaccccgggcacgacctccaacgccacgctacatactaacaaccacaacgacactccgcttccgttcgtacgggtccctgactcgtcttctctcggttccngttaccgtagggaaacaagctcgcctcacncgtccgggcggggcccaggcagngtagntggtagtcgttagtagtttacttacgtgttggtctcttacgtagttagtcgggtacgttagggttcgggttagggttttcggggttaccgggttggggacgggggaacggtaacccgagggtcccgttacgggtacccgttttaacggg

SEQ ID NO: 26728 - DNA, 723 bp, Homo sapiens
  misc_feature: GYAE6OF02GOJQS.47.83.H06.1.454.CMB.1.raw
tcagagctcacgtacacgaccggtgctcgattagatcacgtgcgtcgcgggggcatcacataacaaccacattcctcctctgaagaagcccctgggagcacagctcatcaccatggactggacctggaggttcctctttgtggtggcagcagctacaggtatccagtccctggtgcagctggagcagtcgtggggctggaggtgaagaacgccgtgggtcctcggtagaacggtctccgtgccgaccggcccctgacacgacctaccttcacgacctaaccttactacccttcgagtcgtagggtcgacgacgtaccgggtccccagggacgaagggtcttggaggttagggaggttagggggtacgggttccgttcccgttagtttccggtttaggtaacgaaacctaaacgttaccggaccaacgtacgtaaccgtttaccggaagggcaaggtacgtaccgaaccggtacgttacccggacggtaacacggacgtacccgacgggacctacgtacgtccctaccgaggttacgggtagttacgacgtccgacgtcccgtaggaacgtacggtccgggtacggggacccgtaccggtaccgtaaattacggttacgtaggtcggacgtacggacccggtaaccgttaaagtttaacgagtttacggtacggttgggtttaccggtccgggtaccgacccggttacttaccggtttaaccgg

SEQ ID NO: 26729 - DNA, 692 bp, Homo sapiens
  misc_feature: GYAE6OF02GKU2T.47.83.H06.1.454.CMB.1.raw
  modified_base (184)..(184): a, c, t, g, unknown or other
  misc_feature (184)..(184): n is a, c, g, or t
  modified_base (549)..(549): a, c, t, g, unknown or other
  misc_feature (549)..(549): n is a, c, g, or t
tcagagctcacgtacacgaccggtgctcgatttagatcacgtgcgtcggcgggggaaaaaggccctgaggaaaacaaaccccagctgggaagcctgagaacacttagccttcatgagtgtccccaccatggcctggatgatgcttctcctcggactccttggttttgggacaggagtggattcncagactgtggtgaccgaggagccatcgttctcagtcgtcccgtggagggacagtcaacactcactggtgcttgagctcgtggctcagtcctccactacactacctccccagctggtaccagcacggaccccggcacgactccacgcacgcacatcaacacacagaccactccgctcgttcgtcggggtcctgtacgtccgtctttcgccttcggttacctacttaccggttaggaaaccgaaacgtcctaccgtccctaccaccgtacgtcccggggcccggggaccacgggcgtaggacgtagtaacggtggtacgttgttaagttacgtttaagttcgttaagggtttcgtacgttaccgttnttaacggttagggtacggggttaccggtaacgggttacggggtttcggggttttaacggggggtttccgggttaccggggtacgggggaaccggggtaacccgttaaccgggtcggtttacccggggtaacggtttacccggg

SEQ ID NO: 26730 - DNA, 757 bp, Homo sapiens
  misc_feature: GYAE6OF02JECTW.47.83.H06.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
  modified_base (385)..(385): a, c, t, g, unknown or other
  misc_feature (385)..(385): n is a, c, g, or t
tcagagctcacgtacacgaccggtgctcgatttagatcacgtgcgtcgcgggggaaaaggccctgaggaaaacaaaccccagctgggaagcctgagaacacttagccttcatgagcgtttttccccaccatggcctggatgatgctctcctcggactccttggttttgggacaggagtggattctcagactggtaggtgacccnggacgccatcgttntccagtcggtccgtggaggacagtcacnctcacttggnggtcttggagtcttcgtggtcctccgagttcctaccacttaccatacccctacccccagtcgtacgttacccgacggacacggtacccccgggtacaacggacctaccgacggaccaccgtccctaacncgtacctaaccgaaccaactacgacaccgtctccgttctttccggtacggggtttccccagtacttccggtctttaccttcgttaaccggtttcacctttaccggtacgggtaaacaaaccggtcgtacccgtcctaccccgaacccgttacgccggggcccggggtaacccgacggtccgaagtcgtagtaccgtaggtaaggtttcgttaaggtttactttaacgttccggttagttcgtcgtaaccgttacgttagtacggtagggttacggttgggttaaccccgggtttgggtttacggggtaccgggttacgggtaggggaacccggtaaccggtacggtccgtttaccggtaccggtttaccggg

SEQ ID NO: 26731 - DNA, 699 bp, Homo sapiens
  misc_feature: GYAE6OF02IZ0DY.47.83.H06.1.454.CMB.1.raw
  modified_base (324)..(324): a, c, t, g, unknown or other
  misc_feature (324)..(324): n is a, c, g, or t
tcagagctcacgtacacgaccggtgctcgattagatcacgtgcgtcgcgggggcatcacataacaaccacattcctccctctgaagaagcccctgggagcacagctcatcaccatggactggacctggaggttcctctttgtggtggcagctagctacaggtgtcccagtccctggtgcagctggagcagtcgtggggtctggaggtgaacggaagccgttgggtacccttcggtaggaacgggttcctccgtgccaccggcccctgcacgactaccttcacgacaacctactaccttcagcgtggtgccgacgccggtcccgnggaacgacggtcgtggaggtaggaggtacggggtacgggtaccgttccgtacgttaccgttaggtaacgaacgtaaacgtacacgaacgagtaaccgtcgaacggctaaggtactacgtaacgtaccgttaccggacgacgacgacgtacccgacggacaaccgtcgtaccgtaccgtacggttaggtacggttacgacgacgtacgtccgtagtacggtaacggtcggtacggggtaaccgtaaccgggtacgtttaacgttacgttaacgtacgggtgtacggacggtaaccgggtaccgtaaagttaggtacgtttacggacggtttaggttccgggtaaggttcccgtaacgtacccggttattaaccggg

SEQ ID NO: 26732 - DNA, 742 bp, Homo sapiens
  misc_feature: GYAE6OF02HNVIN.47.83.H06.1.454.CMB.1.raw
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
tcagagctcacgtacacgaccggtgctcgatttagatcacgtgcgtcgcgggggaaaagccctgaggaaacaaaccccagctgggaagcctgagaaccacttagccttcatgagtgtcccaccatgcctggatgatgcttctcctcggactccgttggttttgggactaggagtggattctctagactgtggtgacccaggacgccatcgttctcgagtcgtcccgtggaggcacgtcacgactactacgttgtggcttagngctcgtggctcgacgtctccaactacgctaccncccccgagtcgtacggtaccncgtaccgaccggtaccccgggccaagaccctaccccgacgcgtaccgccttcgaaccttcctaaaccaaccgtaccaacgaccctaccgtccgccttaccgtttcggtccggggtaccctagggtaccttccgtaccgtttcgttacgtccgggtttcctaccttccggttaagggtaaacctaacgtacctccgtacccgtacccgacccgtacggtacccgggcccggggtacccgttacgggaccgacggtacgtacgtaaggcgttaaggttcggttagtacgttttacgttaaccggttgttcccggttagtaccgttacgtttacggtacgttacgggtacggttaacggttcgggttacgggtttcgggttacgggtcggtacggaaccggtacgtacggtcgtacggttcgtaccggg

SEQ ID NO: 26733 - DNA, 739 bp, Homo sapiens
  misc_feature: GYAE6OF02JEZLT.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccgaggacgccagtcgttcctcgacgtcgtccgtggagggacagtcacgactctacttggtgcttgacgtctcgtggtcctcgtacgtcctaccaactaccactcccctacccccgagtcctacggtaaccacggaccgccggacccccgggaccacgaacccgtcccaccggtccaccgtccctcgaactcctaacaaccaacgacgaacctactacgcctttacgttaccgggtccgggttcctaggtactccgttctttcgtcgtttcgtaccctacgttcccgtacggaaacgtacgacctcgaccctaccgtaccgtaccggtccgggcccggggtaccggacggtacgacggacgtaggtacgttaggtaacggttggttaacgttagttaccgtttagttacgggttagtccgtacgttcgttaagttaggtacgggtcggttaacgggttggtttcggggtttagggtccgggtttaccgggtacggggtaacccgggacggttaacggtcccggttacgtaccggttaaccggg

SEQ ID NO: 26734 - DNA, 1042 bp, Homo sapiens
  misc_feature: GYAE6OF02IMLEF.47.83.H06.1.454.CMB.1.raw
tcagagctcacgtacacgaccggtgctcgatttagatcacgtgcgtcggcgggggggaagcctgagaacacttagccttcatgagtgtcccccaccatggcctggatgatgcttctcctcggacttccttggttttgggacagggagtggattctcagtactgtggtcgacccgaggacgccattccgttctctaggtcggtcccgtggggacgggactacgtccactacctacgtacgtttggtcgggtcctttggacgtccttccgtacgggccttacgtacgttcctacccgtaccttaacctaacccgttacccctaccccccaaggtcccgttaccgggtaacccgacggtacccgaacccgggaccccccggggacctaacggaccccttaccccggaaccggtccgaccccgggttccttaaccgtaaccttacccgtaaaccaaaccgtaaccgtacggtaaccctacccgttacccgtcgtttcccggtttcccgttaccggggttacccctttacggtaccgtaccttttccgttaccggttccggtttaccctacggttaaccggttacggggaaaaccgtaaccggtcgtacccgtccccgtaccgaaccggttaccggtcccgggggtacccgggaacccggtaaacggggaccgtaacggtacgtacggtacggttaacgggttacggtttaacggtttacggttttaaacttttaaacggtttaaccgggttttcgggtttaaccgtttcgggttaccctttaacgggtttaacggttaccggggttttacggggtaaccgtttacgggggttttcccggggtttaagggggtttttcggggggttaaccgggttaacgggggtaaccccggggggacggtaaacccgggttacgggttcccggtttaacccggggtttcccgggtttaaccggtttaccgggaaacccgttccccgggggtaaaacccttccggggtacccccggtttaccccgttcccccccgggtttaccgtttaacccccggg

SEQ ID NO: 26735 - DNA, 966 bp, Homo sapiens
  misc_feature: GYAE6OF02JW7MQ.47.83.H06.1.454.CMB.1.raw
tcagagctcacgtacacgaccggtgctcgatttagatcacgtgcgtcgcgggggaaaaggccctgaggaaaacaaaccccagctgggaagcctgagaacacttagccttcatgagtgtccccaccatcggcctggatgatgcttctcctcggactccgtttgggttttgggacaggagtggtattctcagcgtggtggtacgacccgaggagccattccgttctctaggtcgtcccggtagggacgggacgtacgtccgaccacctcgtaaccgttcggttggtccgtttagggacgtcgtttccgtcgggtaccttccgtaaggttccctaccctaacgtaacctacgtaccccgtccccccaaggtccgtacggtaccgacgccgaaccggtaccccgggacctacggacctcccaccggaccgtaccgtctacgtaaccttactaaccgaaacgtaccaacgacccgtacctaccgttaccttccgtttccgggttaccgggggtacccttacggtaccgttaccggttcccgtttcccgtccgtttaccgggtttacccctaccgtttaccccggttaaacggggtaaaaccgttaaccggtaccgttacccggtaccccgtttcccgaaacccggtttaccgggtaccccgggggcccggggggtaccctaaccgggttaccggtaaggtaccggttaaggtaccggttaaggtaccgggtttaggtaaccgtttaacggttttacctttaacgggtttcgggttaacccggttggttaacccgtttacgttaccggtttacggggtccggttaaccgggtttaacggggttttacccgggggggttttcgggtttttaaccggggggtttcgggttaaccccggggggtaaggggttaccccgggtaaacccggttacgggtacccggttaaccgggggtttacccccgtttaaccgggg

SEQ ID NO: 26736 - DNA, 273 bp, Homo sapiens
  misc_feature: GYAE6OF02HDNFU.47.83.H06.1.454.CMB.1.raw
  modified_base (142)..(142): a, c, t, g, unknown or other
  misc_feature (142)..(142): n is a, c, g, or t
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
  modified_base (234)..(273): a, c, t, g, unknown or other
  misc_feature (234)..(273): n is a, c, g, or t
tcagagctcacgtacacgaccggtgctcgatttagatcacgtgcgtcgcgggggcccaggcagatgatgagtgtgattattactgtgtgctctatatgggcagtggcgtttgggtgttcggcggaggaccaagctgaccgtnttaggtcagcccaaggctcgccccctggtcactctcgtcccaccctcctctacgngacgctcgtgacggccggctgggcaagggcncatagnnnnnnnnnnnnnnnnnnnnnnnnnnnnnnnnnnnnnnnn

SEQ ID NO: 26737 - DNA, 909 bp, Homo sapiens
  misc_feature: GYAE6OF02JQQ30.47.83.H06.1.454.CMB.1.raw
  modified_base (81)..(81): a, c, t, g, unknown or other
  misc_feature (81)..(81): n is a, c, g, or t
  modified_base (229)..(229): a, c, t, g, unknown or other
  misc_feature (229)..(229): n is a, c, g, or t
tcagagctcacgtacacgaccggtgctcgatttagatcacgtgcgtcggcgggggaaaaggccctgaggaaaacaaccccngctgggagcctgagaacacttagccttcatgagtcgtccccactatcggcctgggatgatgtcttctccgtcggtacttccgtttgggttttacgggactagggtagttcggtatttctcgaagtctgggtacggtcgacccagggcncctacgtccgttctacgtaggtccgttccggtagggacgggtactaggtaccactacgttcgtactttcgggtacggtccgtttaggacgtccgtttacggtacgggtcctaccggtaacggttacccttaccctaaactaaaccgttaccgtaacccctacccccggtacggtaccgttaaccgggtaaccccgaacggtaccccggaaccccgggtaaccccccggggtaacaacggttaccccgtaacccgacccggtaacctaacccgggttcccttaaccggtaccttaaccggtaaaccgtaacctacgaaaccggtactacccgttccgaaaccgttttccgggttaccgggtttaccgggtcccttaaacgggtcctttccggtccgtttccgttacggtttaccgttcccgtaaccgttaccggtaaacggtaaacgtaccgtacgtcccgaccgttacgacccgttcgggtacccgggtccggggaccctaggtcaaccggttagccggtagttacggtaggtttacgacgtttaagtccgtttaaggtgtcgttaacctcggtttatacgggtcgtacgggttggtaccggttaggggttcggttaccggggtaggttaccggggacggttaccggaacggttccgtaccggttacgttaccggtacgg

SEQ ID NO: 26738 - DNA, 498 bp, Homo sapiens
  misc_feature: GYAE6OF01D08BA.41.45.E01.1.454.CMB.1.raw
  modified_base (308)..(308): a, c, t, g, unknown or other
  misc_feature (308)..(308): n is a, c, g, or t
  modified_base (334)..(334): a, c, t, g, unknown or other
  misc_feature (334)..(334): n is a, c, g, or t
tcagtctatactatcacgaccggtgctcgatttagtgagtcagtaagggaaaggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttatggtaccagcagaagcagcccaggccctgtgttggtgatgtataaagacagtgagaggccctnagggatccctgagcgattctctggcncagctcaggaacagtagtcacgttgaccatcgagtggagtccgaggcagaagacgaaggctagactattattgtacaagcagtagacagcagtgtcttagtcggtgtcggcgggacagcgtgaccgtctaggcacgccaaggctcgccccgtgctcgtcgtccg

SEQ ID NO: 26739 - DNA, 508 bp, Homo sapiens
  misc_feature: GYAE6OF01C3XV4.41.45.E01.1.454.CMB.1.raw
  modified_base (475)..(475): a, c, t, g, unknown or other
  misc_feature (475)..(475): n is a, c, g, or t
  modified_base (500)..(500): a, c, t, g, unknown or other
  misc_feature (500)..(500): n is a, c, g, or t
tcagtctatactatcacgaccggtgctcgatttagtgagtcagtaagggaaaggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggccctgtgttggtgatgtataaagacagtgagaggccctcagggatccctgagcgattctctggcgcagctcaggaacagtagtcacgttgaccatcagtggagtccaggcagaagacgaggctgactattattgtcaagcagtagacagcagtggtccttagtcgggtgttcggcgggggaccaggctgaccgtccgtaggtcngcccgaaggctcgccccctggtccnctcgtccg

SEQ ID NO: 26740 - DNA, 508 bp, Homo sapiens
  misc_feature: GYAE6OF01CZK05.41.45.E01.1.454.CMB.1.raw
  modified_base (310)..(310): a, c, t, g, unknown or other
  misc_feature (310)..(310): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggccctgtgttggtgatgtataaagacagtgagaggccctnagggatccctgagcgattctctggcgccagctcaggaacagtagtcacgttgacatcagtgagtcaggcaagaagacgagctgactattatgtacaagcagtagacagcagtgtcttagcgggttgtcgggcggggacaacgcgtgaccgtcgtaggtcacgcccgaaggctacggccccgtgtccacgtcgtacccg

SEQ ID NO: 26741 - DNA, 542 bp, Homo sapiens
  misc_feature: GYAE6OF01ARPCL.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgttattggtaccagcagaagccagcccaggcccctgtgttggtgatgtataaagacagtgagaggccctcagggatccctgagcgattctctggcgccagctcaggacagtagtcacgttgaccatcagtggatccgaggcagaagacgaggctagactagttattgtcaagcagtagacagcagtgtaccttagtcgggtgttcgggacggggaccaaggcgtaggacccgttccgtagggtccgacggccccgtaaagggcctaccggcccccgtacggtccctacgttccgttcccg

SEQ ID NO: 26742 - DNA, 525 bp, Homo sapiens
  misc_feature: GYAE6OF01DKPXZ.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagccaggccctgtgttggtgatgtataaagacagtgagacggcctcgagggatcccgtgagcgattcgtctggcgccagctcacggaacagtagtcacgttgacctagtcagtgagtcaggcagaagacgaggctgactattatgtacaagcagtagacagacagtcggttacttagtcgggtgttcgggcggggacaggcgtacgaccgtcgtaggacgtcgaccgtaacggcgtccgccccgtggtccactcgttcccgg

SEQ ID NO: 26743 - DNA, 517 bp, Homo sapiens
  misc_feature: GYAE6OF01DJELW.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggccctgtgttggtgatgtataaagacagtgagaggccctcgagggatccctgagcgattctctggcgccagctcgaggaacagtagtcacgttgaccatcagtggagtccaggcagaagacgaggctagactattattgtacaagcagtagacagcagtgttccttagtcgggttgttcgggcggggacaagcgtgaccgtcgtaggcacgaccgaaggcctcgcccctggtccaccgtcttcccg

SEQ ID NO: 26744 - DNA, 523 bp, Homo sapiens
  misc_feature: GYAE6OF01BZGXK.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtcccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctgcgcagctcaggaacagtagtcacgttgaccatcgagtggacgtccgaggcaagaagacgaggctgacttattattgtcaagcagtagacagcagtgtcttagtcgggtgtcgggcggggacgaggtctggaccgtccgtaggtcacgcccgaaggccttcggcccccgtggtcctccgtcgttcccg

SEQ ID NO: 26745 - DNA, 541 bp, Homo sapiens
  misc_feature: GYAE6OF01COB0L.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctgggagatgaattgccaaggcaatttgttattggtaccagcagaagcagcccaggccctgtgttggtgatgtataaagacagtggaagtacgggccctcgagggatccccgtgagcgtattctcgtggcgcagctcagacagtagtcacgttgaccatcagtggagtcaggacaggaagacgaggctaggacttattagtgtcaagcagtaagacagctagtacggtcttagtcgggttgtcgggcggggaacacggctagccggtacgtaggtcaggccccgaaggccgtaccggtccccctagggcctaccgtcttaccccgg

SEQ ID NO: 26746 - DNA, 593 bp, Homo sapiens
  misc_feature: GYAE6OF01C0768.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttcctccccctcctcactctctgcacaggctctgaggccgcctatgaggtgacacagccacactcggtgtcagtgtccccaggacagacgccaggatcacctgctctggagatgaattgaccaaaggctaattttgtttattggtaccagcagaagccagccaggccctgtgttggtgatgtaataaagacagtgagaggccctcgagggactcccgtgagcgtattctcgtcggcgaccaggctcgaacggaacaggtagtacacggtttacgaccctatacgaggtacggagtaccgaggcagaagacgagctagactattagtgtagagctagtagacgagactaggtcggtacttacgtcgggttgttacggggaccggggtacaacggtcgtaggtaccgtccggttaggacctacggacccgaaaggtcccgtacccggtcccccgtaccggttacctacccgtccgtttaccccgg

SEQ ID NO: 26747 - DNA, 804 bp, Homo sapiens
  misc_feature: GYAE6OF01BFKFL.41.45.E01.1.454.CMB.1.raw
  modified_base (123)..(123): a, c, t, g, unknown or other
  misc_feature (123)..(123): n is a, c, g, or t
  modified_base (218)..(218): a, c, t, g, unknown or other
  misc_feature (218)..(218): n is a, c, g, or t
tcagtctatactatcacgaccggtgctcgatttagtgagtcagtaagggaaagggggtaggggtccgaaggaggcagaacttcgtcgggtgtcgtaccaccagtaggcccctggactcccctntacctttcctccccccttccttccactctcctgcgactacggctctcgacggccgaccttagtgtaggtcgacacgacgcccaccaccttcggtnttcacgtcgtaccccgaggacagaccggcccaggactcgacctggcctacgtggaagtattgtaagttgaccctaaggtctaaacttttggtttaactacggtaaccaacgtcgaacgaaaggcccaacgacccgacggtccccttggttacgtttcggtgtaagttagtaagttaaaacgacgtaacggttaggaacggaccggtaccccttacggaacgggtaacttcccccgtaaggaccgtacgttaacgtttccgtcggtacggaccggtccgtaacgtccgtacgaaacggtaaacgtagttacgtacgtacgttcgaaccctagtccgaaggtcgaacgttcccgaagggcctaagaacggaacgtaggtaccgttacggtaacctttaagttttactttacgttacgaacgtaccgtaaggtaccgtaaccgaacgtacgtaacggtttccgtaccgttttaacggtccggggttggttaccgggacggggaaccgtagtccgttacggtaaccgtacgttacgtcggcgtacccgaagggtccctaccggccccgttaggtccctacgttcctcccg

SEQ ID NO: 26748 - DNA, 529 bp, Homo sapiens
  misc_feature: GYAE6OF01BBF1C.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggccctgtgttggtgatgtataaagacagtgagaggccctcgagggatccctgagcgattctcgtggcgccagctcgaggaacagtagtcacgttgaccatcagtggagtccaggcagaagacgagctgactattatgtacgaagcagtagacagcaggtggtccttagttcgggtggtttccgggacgggggacctaaggcgtacggaccgtcgtaggtcacgcccgaaggctcgcccctggctaccgtcgttacccg

SEQ ID NO: 26749 - DNA, 991 bp, Homo sapiens
  misc_feature: GYAE6OF01BUC6U.41.45.E01.1.454.CMB.1.raw
tcagtctatactatcacgaccggtgctcgatttagtgagtcagtaagggaaaggggtgggtccaagggacggaacagaacctctgggtgtactccaccatggcctggatccctctaccttctcccccgtccttcaccttcgtctcgcaccttaggtcttcgtggaggccgcctaatggaggtcgaaccaccaggtcccaactacgtacggtagtccaggtgtccccagggacaggaacggccgaggagtccacctggctacgtggacgatgaaagttcgcctaagggtacctaatttttcggttttaagttacgggttaacctaggtacctaaggtaaacgaccctaacgggtccccaacgggccccctgggttaccggtttggggtaggaagttcggttaagtaaaaacggtaccgtaaggtttgggaagggaacgggtcccctacggtaacggggtaccttaccccggtaggtaacggaccggttaacttaccgtacggttacgggtccgacccaaggtaccgttaacgaacggggaaacgtaaggttaacggtaccgtaccggttttaccggaaaccttacgttacgaacgggttacgggtaacggttaccccgaaggggacctaaacggggaaacggtaaccgggaacgggtaccgttaagggtaaccctttaagtttaaacggtttaccgggttaaaccgtaaacgggtaccggtaaagggtttaacgaaccggtaacggtaccgttaaacgggtttcggggtttaaaccccggttttaaggttacccgggggggttcgggttttaacccgggggacggggggttaaacccgttaacggggtccggttaaccggggtaccccgggttaaccggggttaaccgggtaaccggtaccggtaacccccgggtaagggttaccggtttacccgggttcccccgggttaccgggttcccgttaaccccggttcccggttttacccccgggg

SEQ ID NO: 26750 - DNA, 510 bp, Homo sapiens
  misc_feature: GYAE6OF01DQ98N.41.45.E01.1.454.CMB.1.raw
  modified_base (311)..(311): a, c, t, g, unknown or other
  misc_feature (311)..(311): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttatggtaccagcagaagccagcccaggccctgtgttggtgatgtaataaagacagtgagaggccctnagggatccctgagcgattctctggcgccagctcaggaacagtagtcacgttgaccatcagtggagtccaggcagaagacgaggctgactattattgtcaagcagtagacagcagtggtcttagtcgggtgttcgggcggggacagcgtgaccgtctaggtcacggcccaaggctcgccccctggtccacgtcgttcccg

SEQ ID NO: 26751 - DNA, 545 bp, Homo sapiens
  misc_feature: GYAE6OF01D5IB9.41.45.E01.1.454.CMB.1.raw
tcagtctatactatcacgaccggtgctcgatttagtgagtcagtaagggaaagggggtgggtccaggaggcagaactccgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaattttgtttattggtaccagcagaagccagcccaggcccctgtgttggtgatgtataaagacagtgagacggccctgagggatcccgtgagcgattctcgtggcgccagctcgaggaacagtagtctacgttgacctatcgaagtggagtccgaggacagaagacgaggctagactattattgtacaagcagtagacagacaggttggtaccgttagtcgggtggttcgggcgggggaccagcgtgaccgtcgtacggtcacggcccgaggcctccgtcccctacggtcctactcgtcgttaccccc

SEQ ID NO: 26752 - DNA, 525 bp, Homo sapiens
  misc_feature: GYAE6OF01B8WFG.41.45.E01.1.454.CMB.1.raw
  modified_base (286)..(286): a, c, t, g, unknown or other
  misc_feature (286)..(286): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
tcagtctatactatcacgaccggtgctcgatttagtgagtcagtaagggaaaggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaaatttgtttatggtaccagcaagaagccagcccaggccctgtgttggtnatgtaataaagacagtgagaggccctgagggatccctgagcgattctcgtggcgccagctcgagaacagtagtcacgttgacctatcagtggacgtaccgaggcaaggaagacgaggactgactattagtgtacaagnagtacganagacgagtgtcttagtcggtgttcgggcggggacaggcgtgaccgtcgtaggcacgcccgaaggcctcgccccgtggtccacgtcgttacccg

SEQ ID NO: 26753 - DNA, 602 bp, Homo sapiens
  misc_feature: GYAE6OF01C707N.41.45.E01.1.454.CMB.1.raw
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctcttgagatgaattgccaaggctaatttgttattggtaccagcagaagccagcccaggccctgtgttggtgatgtaataaagacagtgagacggccctagagggactccctgagcgattcnctggccnccagctcaagaacagtagtctacgttcgacctatacgagtcggtacgtccgaagggtacaagaaggacgaggactagacttagttagttgacaagcagtagacgaagacgtaggttcgttaccgttagtcgggttaggttaccggggacgggggtaacctaacggccgttacggtacccggtaccgtaaggtccgtacggaccccgtaaggcccgttaccggaccccccgttacggtacccaccgttcccgttaccccgg

SEQ ID NO: 26754 - DNA, 541 bp, Homo sapiens
  misc_feature: GYAE6OF01DDZC4.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagagccagcccaggccctgtgtggtgatgtaataaagacagtgagaggccctgagggatccctgagcgattctcgtcggcgccagctcgaaggacagtagtcacgttgaccatcaggtgacgtccgagcgagaacgacgagcgtgacttatagttgacaagcagtacgacaagctagttcgtccgttaggtcgggtgttcggggacggggtacaggcgtagaccggttcgtagggtcacgacccgaggcccgtccgacccccgtggtcctacgtccttcccgg

SEQ ID NO: 26755 - DNA, 530 bp, Homo sapiens
  misc_feature: GYAE6OF01CNUOE.41.45.E01.1.454.CMB.1.raw
  modified_base (412)..(412): a, c, t, g, unknown or other
  misc_feature (412)..(412): n is a, c, g, or t
  modified_base (423)..(423): a, c, t, g, unknown or other
  misc_feature (423)..(423): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggccctgtgttggtgatgtataaagacagtgagaggccctcagggatccctgagcgattctctgcgccagctcaggaacagtagcacgttgaccatcagtgagtccgagcaagaagcgagctagactagttatgtacaagnagtagacaganaggtggtccttagtcgggtgttcgggcggggaccaaggcctaggacccgtcgtaggtccaacggcccgaaggccgtcgcccccgtacggtcctccgtcgttccccgg

SEQ ID NO: 26756 - DNA, 511 bp, Homo sapiens
  misc_feature: GYAE6OF01B4WSA.41.45.E01.1.454.CMB.1.raw
  modified_base (471)..(471): a, c, t, g, unknown or other
  misc_feature (471)..(471): n is a, c, g, or t
  modified_base (500)..(500): a, c, t, g, unknown or other
  misc_feature (500)..(500): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagccccaggcccctgtgttggtgatgtataaagacagtgagaggccctcagggatccctgagcgattctctggcgccagctcaggaacagtagtcacgttgacccatcagtggagtccaggcagaagacgaggctgactattattgtcaagcagtagacagcagtgtcttagtcggtgtcggcggggacagctgaccgtcgtaggtcncgcccaaggccgtcgcccccgtcggtccncctcgtccccg

SEQ ID NO: 26757 - DNA, 506 bp, Homo sapiens
  misc_feature: GYAE6OF01AHV27.41.45.E01.1.454.CMB.1.raw
  modified_base (311)..(311): a, c, t, g, unknown or other
  misc_feature (311)..(311): n is a, c, g, or t
  modified_base (477)..(477): a, c, t, g, unknown or other
  misc_feature (477)..(477): n is a, c, g, or t
  modified_base (497)..(497): a, c, t, g, unknown or other
  misc_feature (497)..(497): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggccctgtgttggtgatgtataaagacagtgagaggccctnagggatccctgagcgattctcgtggcgccagctcaggaacagtagtcacgttgaccatcgagtggagtcaggcagaagacgaggctagactattagttgtacagcagtagacagacagtggtccttagtcgggtgttcggcggggacagcgtgaccgtcgtagtcncgccagctcgcccctggtcncgtcgtccg

SEQ ID NO: 26758 - DNA, 570 bp, Homo sapiens
  misc_feature: GYAE6OF01BTMQK.41.45.E01.1.454.CMB.1.raw
  modified_base (221)..(221): a, c, t, g, unknown or other
  misc_feature (221)..(221): n is a, c, g, or t
  modified_base (520)..(520): a, c, t, g, unknown or other
  misc_feature (520)..(520): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctgganatgaattgaccaaggctaattttgttattggtaccagcagaagccagcccaggccctgtgtggtgatgtaataaagacagtgagacggccctgagggactcccgtagacgcgtattctcgtggccgtccagcctacgaggaactaggtacgtcacgtttgaaccatcgagtggacgtccgaggacaggaacgacggaggctagaacttattagttgtacaagcgagtagacagactaggtgtacgttagtcgggttggttcgggacgggggtaccaggcgtacgtaccgtccgtaggcncgacccgaaggccgtcccgccccgttcggcctaccgttccgttaccccgg

SEQ ID NO: 26759 - DNA, 674 bp, Homo sapiens
  misc_feature: GYAE6OF01D9E1Y.41.45.E01.1.454.CMB.1.raw
  modified_base (221)..(221): a, c, t, g, unknown or other
  misc_feature (221)..(221): n is a, c, g, or t
  modified_base (329)..(329): a, c, t, g, unknown or other
  misc_feature (329)..(329): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacgccaggatcacctgctctgganatgaattgaccaaggctaattttgtttattggtaccagcagaacgccagcccaggccctgtgttggtgatgtaataaagacagtgagacggccctcgaggactcccgngagtcgattcgtcgtcggccgccgagtccgtacgaacggaaacgtaggttacgtacgtacggtttacgaacctagtacgaggtaggacgtccgaacgggacgaaggaaacggaacggaggtacgtacggtaacttaagtttacgttacgtacgaaacgtacgtaaggtacgaacgaggtacgtaggttcggttacgtttaggttcggggttacgggttacggggaccgggggtaaccgtaacggtccgtacgggtacccggttcgttacgggtaccgtacggacccggtaacggtcccgtacccggtcccccggttacggtcccgtaccgttccggtttccccgg

SEQ ID NO: 26760 - DNA, 613 bp, Homo sapiens
  misc_feature: GYAE6OF01EF7E4.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgttattggtaccagcagaagccagcccaggccctgtgttggtgattgtaataaagacagtgagaggccctcgagggactcccgtgacgcgattctctggcgccagctcgaaggaacgtagtagtcacggttacgaccatcaggtggacgtcgaggacagaacgacgaggcgtagacttattattgtacgtaagcagtacgacgagacgtaggtcggttaccgtttaaggttcggggttaggttaccggggaccggggggtaacctaagggtccgtaggtaccccggtaccgtacgggtaccgtacggtaccccgaaaggtcccgtacccgtccccccggttacggtcccgtaccgttccgttacccccggg

SEQ ID NO: 26761 - DNA, 717 bp, Homo sapiens
  misc_feature: GYAE6OF01DC1RP.41.45.E01.1.454.CMB.1.raw
  modified_base (330)..(330): a, c, t, g, unknown or other
  misc_feature (330)..(330): n is a, c, g, or t
tcagtctatactatcacgaccggtgctcgatttagtgagtcagtaagggaaagggggtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctggagatgaattgccaaaggcaatttgttattggtaccagcagaagcagcccaggccctgtgttggtgatgtataaagacagtgagaggccctgacgggatccctgagcgattcnctggcgccagctcgaggtaacagtacgtctacgttggaacccagtacgaggttaggacgtaccccgaagggccgaaaggaaacggtacggaagggtaccgttaggtaaccttaagtttaacgttcggttaaccgaaaggtacgtaacgggtttaaacggacgtaaagggtcccgtaaagggtttacggggtttcccctttaaaggttcggggggttttacggtttccggggggacgggggggtaaaccctaaagggcccggtttacggaaccccgggttacccgggtaacgggttacccggaacgggaccccccgtaaaagggccccgtttacccggacccccccgttccggggttaaccctaacccgttccccgtttaaccccggg

SEQ ID NO: 26762 - DNA, 602 bp, Homo sapiens
  misc_feature: GYAE6OF01EWYOW.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaattttgtttattggtaccagcagaagccagcccaggccctgtgttggtgatgtataaagacaggtgagacggccctcgagggactcccgtgagcgattctcgtcggcgccagctcaggaacagtagtacacgttcgaccatcaggtggacgtccgaggcgaagaagacgaggctagacttattagttgtacaagtacagtagacgagtacgtaggttcggttaccgttaggttcggggttacggttcgggggaccgggggtaaccaacggtcgtacggtaacccggttccgtagggtaccgacggtaccccggaaggtcccgttaccggccccccttacgggtccctcgttcccgttcccccgg

SEQ ID NO: 26763 - DNA, 604 bp, Homo sapiens
  misc_feature: GYAE6OF01EGOWG.41.45.E01.1.454.CMB.1.raw
  modified_base (290)..(290): a, c, t, g, unknown or other
  misc_feature (290)..(290): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgaccaaggctaattttgtttattggacctagcagaagccagcccaggccctgtcgttggtnatgtataaagacagtgagaggccctgagggactccgtgagcgtattcgtctaggcgccagctcgaggaacagtagtactacgttgaccatcaggtggacgtacgaggtacgaaggaaggacgacggtcgtagtaactagtttagttgtacgaaggctaaggtacgacgagacgtaggtcggttaccttaggttcggggttagggttccgggacgggggtaaccacggtcgtacggtaccggttccgtaggtccgacggaccccgtaaggtcccgtaccgcccccgttacggtacctaccgtccgttacccccgg

SEQ ID NO: 26764 - DNA, 537 bp, Homo sapiens
  misc_feature: GYAE6OF01B9AJS.41.45.E01.1.454.CMB.1.raw
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgttattggtaccagcagaagccagcccaggcccctgtgttggtgatgtaataagacagtgagaggccctgagggntcccngagcgattctcgtcgcgccagctacgaggaacaggtacgtcacgtttgacccatcaggtggagtccaggcaagaagacgaggctgactattattgtcaagcaagtagacgagcgagtacggttccttagtcgggttggtccgggcgggggtaccaaggcgtacggccgtccgtaggcgacgcccgaggcctcgcccccgtgtccgctcgttcccg

SEQ ID NO: 26765 - DNA, 670 bp, Homo sapiens
  misc_feature: GYAE6OF01EYFBN.41.45.E01.1.454.CMB.1.raw
  modified_base (222)..(222): a, c, t, g, unknown or other
  misc_feature (222)..(222): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctgganatgaattcgaccaaggtctaagttttgtttattggtaccagcaagaacgccacgcccgacggtcccctgttcggttggtgtagttagtaagtaaaagactaggtgaaggacggcccgtagacgggtactcccgtggacgtcgtattccgtcgtacggccgaccgacggccttacgaacggtaacgaagttacgtaccgtaccgtttacgacctatacgtaggttacggacgtccgaggcaaggaacgacgaggctagacttattattagtacaagtcgtaagtacgacgtagacgtaggtacggttaccgttaggttcgggttaggttccggggtaccggggaacctaacggtccgtacgggtaacccggttccgtaacgggtactaccgggaccgtaacggtcccgtcccggtacccccgttaggtcccttccgtccgttacccccg

SEQ ID NO: 26766 - DNA, 537 bp, Homo sapiens
  misc_feature: GYAE6OF01BWM35.41.45.E01.1.454.CMB.1.raw
  modified_base (430)..(430): a, c, t, g, unknown or other
  misc_feature (430)..(430): n is a, c, g, or t
tcagtctatactatcacgaccggtgctcgatttagtgagtcagtaagggaaagggggtgggtccaggaggcagaactctgggtgtctcaccatggcctggatccctctatttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggccctgtgttggtgatgtataaagacagtgagaggccctgagggatccctgacgcgattctcgtggccgccgagctcgaggaacagtagtctacgttgaccatcagtggagtccgaggcagaagacgaggctgactattagtgacaagctagtagacngactaggtgtaccgttagtcgggttggttcgggacggggtacaaggctaggaccgtccgtaggtcacgaccgacggcgtccggccccctggtcctcgtcttacccgg

SEQ ID NO: 26767 - DNA, 645 bp, Homo sapiens
  misc_feature: GYAE6OF01EMFA3.41.45.E01.1.454.CMB.1.raw
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (288)..(288): a, c, t, g, unknown or other
  misc_feature (288)..(288): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctcngganatgaattgaccaaggctaattttgtttattggtaccagcagaagccagcccaggccctgtgttggngatgtataagacaggtgaggcggccctcgagggactcccgtgacgcgtattccgtcgtcggccgccgagccgtcgaagggaactacggtacgtccgtacggttcgaaccgtatacgaggtggtacgtaccgaggacgaaggaaacgacggacggtacgtaggaacttagtttagttcgtacgaacgtcgaaggtagaacgagacgtaggtcggttaccgttacggttcggggttcggttacggggaccgggggtaccgaacggtccgtaccggtacccggtccggttaacggtccgaccggacccgtaacgggcccgtccggtccccccgttacggtccctacgtcccgttaccccg

SEQ ID NO: 26768 - DNA, 754 bp, Homo sapiens
  misc_feature: GYAE6OF01DOP7V.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctcccctcctcactctctgcacaggctctgaggccgcctatgaggtgacacagccacactcggtgtcagtgtccccaggacagacgcaggatcacctgctctggagatgaattgccaaggctaatttgtttattggtaccagcaagaagccagcccaggccctgtgttggtgatgtaataaagacagtgagacggccctcgagggactcccgtagacgcgtacttcgtcgtcggccgccgaagccgttacgaaaggtaaaccgtaggttaacgtaccgtaaccggtttacggaaaccctagttaccgaggttacgggtacgtacccggaaggaccgaaaggaaacggtaccggaacgggtacgtacggtaaccgtttaaagtttagtttacgtacgtaacggacctaaggttaacgaccgaaaggtccgtaagggttccgggtttaacccgtttaagggttaccgggggtttaacggtttccggggggtaaccgggggggtaaaccctaagggtcccggttacgggtaaccccgggtttacccgtaacggggttacgtaacccggtaccccggaacgggtacccgttacccggtacccccccggttccgggtacccgtaaccgttccccgggttaccccggg

SEQ ID NO: 26769 - DNA, 686 bp, Homo sapiens
  misc_feature: GYAE6OF01AOZ6U.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgaccaaggctaattttgtttattcggtaccagcgaagaagccacgcccacggccctgtgttggtgatgtataaagacagtgagacggcctcgagggactcccgtgacgcgtattctcgtcggcgccagcgtacgaaggtaacagtacgtacgtacgttcgacctatacgagtggacgtaccgaggtacgaaggaacgacggacgtacgtacgacttagttagttgtacaagactaaggtacgaacgtacgacgtacggttacgttaccggtttacgtcgggggtttacgggttaccggggtaccggggggtaaaccgtacgggtacccgttaccgggttaaccccggttccgggttacgggtaacccgtaaccgggtaccccgaaaccggggttaccccgttcccgggtaccccccgttacgggttacccctaacccgggtttccctttacccccggg

SEQ ID NO: 26770 - DNA, 524 bp, Homo sapiens
  misc_feature: GYAE6OF01B01ZJ.41.45.E01.1.454.CMB.1.raw
  modified_base (427)..(427): a, c, t, g, unknown or other
  misc_feature (427)..(427): n is a, c, g, or t
  modified_base (511)..(511): a, c, t, g, unknown or other
  misc_feature (511)..(511): n is a, c, g, or t
tcagtctatactatcacgaccggtgctcgatttagtgagtcagtaagggaaagggggtgggtccaggaggcagaactctgggtgtctcaccatggcctgaatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggcccctgtgttggtgatgtataaagacagtgagaggccctcagggatcccgtgagcgtattcgtctggccgccgagctcaggaacagtagtcacgttgaccatcagtgagtccaggcagaagacgaggctgactagttatgtacaagcagtaganagcagtcggtcttgtcgggtgtcgggcggggacagtctaggaccgtcctaggccagcccgaaggccgtccgccccgtcggtccncgtccgttcccgg

SEQ ID NO: 26771 - DNA, 673 bp, Homo sapiens
  misc_feature: GYAE6OF01AUBXI.41.45.E01.1.454.CMB.1.raw
tcagtctatactatcacgaccggtgctcgatttagtgagtcagtaagggaaagggggtgggtccaggaggcagaactctgggtgtctcaccatgacctggatccctctacttctccccctcctcactctctgcacaggctctgaggccgcctatgaggtgacacagccacactcggtgtcagtgtccccaggacagacggccaggatcacctgctcgtggagatgaattgccaaggctaattttgtttattggtacctagcagaagccacgcccacggcccctgtgttcggtgatgtaataaagacagtgaggacggccctacgagggactcccgtggagcgtattcgtcgcggcgccagcctacgaacggaactaggtacgtccgtacgttacgacctatacgtaggtggtacgtacccgagggacgaaggtaacgacggtacgggtaccgtagtaacttaagtttaagtcgtaacgtaaagtccggtaagttaaccgaagtacggaacgtagggttacggtttaccgtttacgggtcggggtttacgggttacccggggacgggggtaaccacggtcggttaccggtaccggttaccgtagggtaccgtaccggtacccgaacggtcccgttacccgcccccggtacgtcccgtaccgttccgttaccccg

SEQ ID NO: 26772 - DNA, 596 bp, Homo sapiens
  misc_feature: GYAE6OF01D48DE.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttatggtaccagcagaagccagcccaggccctgtcgttggtgattgtaataaagacagtgagaggccctacgaggactccctggaagtcgacttctcgtcggcgccagctacgaggaaacagtagcgtacgttgaaccatacagtaggacgtccgaggcaaggaagacgaggactgacttattagttgacgaagcaagtagacagaccgagttcgggttacctttagtcggggttgttccggggacggggaaccgaaggtccgtacggaccgttaccggtaggaccgtacgaccccggaaggcccgttccggtaccccccgttaccggtaccctaccgttccgttaccccggg

SEQ ID NO: 26773 - DNA, 670 bp, Homo sapiens
  misc_feature: GYAE6OF01BQK4M.41.45.E01.1.454.CMB.1.raw
  modified_base (290)..(290): a, c, t, g, unknown or other
  misc_feature (290)..(290): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgccaaggctaagttttgtttattggtaccagcagaagccagcccaggccctggtgttggtnatgtaataaagactagtgagacggccctcgagggactcccgtagacgcgtattccgcgtggccgcgaagtccgtcgaaggaactaggtacgtacgtaacggttcgaactacgtacgaggttacgggacgttacccgaaggacgaaggaaagtacggaggtactaggaacttaagtttagttacgtacgtaaacgactaaggtacgaagtacgacgttaggtaccggtttaccgttaagggttccggggttacgggttacgggggaccggggtacgaacggtccgtaccggtaaccggtccgttaagggtccgaaaccggacccggaaggcccgttacccggcccccgttacgggtccctaccggttcccgtttacccccg

SEQ ID NO: 26774 - DNA, 620 bp, Homo sapiens
  misc_feature: GYAE6OF01CJRW8.41.45.E01.1.454.CMB.1.raw
  modified_base (349)..(349): a, c, t, g, unknown or other
  misc_feature (349)..(349): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgaccaaggctaagttttgtttagttggacctagcagaagccagcccacggccctgtgttggtgatgtaataaagacagtagagacgcctgagggactccgtgacgcgtatctcgtgcgcngctcgaagacgagtacgtcacgttacgaccagtacgaggtacggacgtaccgagacgagaaggacgaggactgactagttattagtacaacgacaagtacgagacgtacgtaggtacggttaccgttaggttcgggtcgggttaccggggaccgggggacctaacgggtccgtacggacccggttaccggtacggtaaccgtccggacccgtacggtacccgttccccggtacccccgtaccggttacccaccggtttcccgttcccccgg

SEQ ID NO: 26775 - DNA, 834 bp, Homo sapiens
  misc_feature: GYAE6OF01CHREE.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctctcactctctgcacaggctctgaggccgcctatgaggtgacacagccacacgtcggtgtcagtcgtccccaggacagacgccaggactcacctgctcgtggatatagtaattcgaccgaaggtcttaagttttgtttattacggtaacagactaaggaacgccgaacgcccgacggtcccgtggttcggttaggtgagttacgtaaagtaaacgacgtaggttaggaacggtaccggtacccgttaggaacgggtacttaccccggtaggacggtaccgttaacgtttctaccggttcggacccgaccgtacgtacccgttacgaaacgggtaaccgtaaggttaacggtaccttaaacgggtttacgaacctaagttacggtaacgggtacgggtaaccgtaccggtacgggaacgtaaaacgggaaacggttaaccgggacgggtaaccgttacgggtaactttaaggttttaacgtacggttaacgaaacgtacgtaaacggtaacgaacggtaacgtacggtaacgggtttccggttacccgtttaggggtccggggtttacgggtcgggggtaaccggggtaaccctaaaggtcccggttaacgggtaccccggtttacggtaacgggtacccgtaaccggtacccggaaacgggttcccgtacccggtaccccggttacggtacccttaccgttccgtttaacccccg

SEQ ID NO: 26776 - DNA, 619 bp, Homo sapiens
  misc_feature: GYAE6OF01CA4GD.41.45.E01.1.454.CMB.1.raw
  modified_base (107)..(107): a, c, t, g, unknown or other
  misc_feature (107)..(107): n is a, c, g, or t
  modified_base (221)..(221): a, c, t, g, unknown or other
  misc_feature (221)..(221): n is a, c, g, or t
tcagtctatactatcacgaccggtgctcgatttagtgagtcagtaagggaaagggggtgggtccaggaggcagaactctgggtgtctcaccatggcctggatccctntacttctccccctctcactctctgcacaggctctgaggccgcctatgaggtgacacagccacactcggtgtcagtgtccccaggacaggacggccaggatcacctgctctgganatgaattgccaaggctaatttgttatggtacagcagaagccagcccaggccctgtgttggtgatgtataaagacagtgagaggccctgagggctcccgtgagcgtacttctcgtggcgccagcgtacacggaacaggttagtcgtacgttacgaccctagtaccgagggtcggacggtaccagggtacaaggtaaggacggaggcgttagaacttagtttagttacgtacgtaagacgtagtaagacagactaggtcggttaccgttagggttcgggttacgggttaccggggacgggggtaaccaggtcgtacggtacccggttcgtacgggtaccgacggtaccccgaaggtcccgtacccggtcccccgtacggtcctaccgttcgtttccccgg

SEQ ID NO: 26777 - DNA, 643 bp, Homo sapiens
  misc_feature: GYAE6OF01BGAL3.41.45.E01.1.454.CMB.1.raw
  modified_base (178)..(178): a, c, t, g, unknown or other
  misc_feature (178)..(178): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtntcagtcgtccccaggacagacggccaggatcacctgctcgtggagatgaattgaccaaaggctaagttttgttaattggtaaccagcaagaagccagcccgaggccctgtgttggtgatgtataaagacagtgagaggccctgagggatcccgtggacgcgtattcgtcgtggccgtaccaggtcctacgaaggaaaccgtagtacgtacacggtttacgacctagtacgtagtaggacgtaccgaggacgaaggaacgacggacggtctagtaacttatttagttagtacgaagtcgtagtaagacgaggacgtaggtacggttacgttaggttcgggttaggttaccggggacgggggtaaccaaggtccggtacggtacccggtacggttacgggtacgaccggacccgtaacgggcccgtacccggtcccccgtacggtccctaccgttccgttaccccgg

SEQ ID NO: 26778 - DNA, 652 bp, Homo sapiens
  misc_feature: GYAE6OF01B6KPP.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgaccaaggctaagttttgtttatggtaccagcagaagccagcccacggccctgtgttggtgatgtaataaagacgagtggagacggccctgagggactccctgacgcgtattctcgtcggcgccagctcaacggaacagtacgtcgtacgttcgacctatcgaggtggacgtccgaggacgaaggaacggacggaggctaggacttagttatcgtacaaggtacaggtaacgacgaggtactaggttcggttaccgttaggttcggggtacgggttccggggaccgggggaccgtaacgggtccgttaccggtacccggttccgggttaagggtacccgtacgggtaccccggaacgggtccccgttaccccggtcccccccggttagggttccccgtaacccgtttcccggttaacccccgg

SEQ ID NO: 26779 - DNA, 752 bp, Homo sapiens
  misc_feature: GYAE6OF01EJB00.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacaggacgccaggatcacctgctcgtggagatgaattgaccaaggtctaattttgttattcggtaccagcaagacgccacgccacgccctgtgtgtttgattgtaataaagactaggtgaggacggccctacggagggtactcccgtagacgcgtacttcgcgtcggccgcagcctacgaaggacctagtacgtactacgttacgaccagtacgaggttacggacgtacccggaaggaccggtaaagggaaacggtaaccgggacgtacggtaacgttaacgtttaagtttacgtttaacggtacgaacgggttaccgtaaggttaacaacggtaaggaccgtttaggttccgggtttaaccgtttacggggttccggggttacggggttacccgggggacgggggaaacccgttaacgggttacccgggtaccggttaaccccgggttcgttaacggggtaccgtaaccccgggaccccggtaaacgggcccgtttacccccgggtacccccccggttaggttaccccggttacccggtacccggttttccccccggg

SEQ ID NO: 26780 - DNA, 754 bp, Homo sapiens
  misc_feature: GYAE6OF01EI0MN.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctcccctctcactctctgcacaggctctgaggccgcctatgaggtgacacagccacactcggtgtcagtcgtccccaggacagacggccaggatcacctgctctggagatgaattgccaaggctaattttgtttattggtaccagcagaacgccagcccaggccctgtgttggtgatgtaataaagacagtgaggacggccctcgagggactcccgtgacgtcgtattctcgtggccgccgacgcctacgaacggtaacagtacgtcacggtttacgaacctagtacgaggtacggtacgtacccgaagggaccgaagggaaacggaaccggaacgggtacgttacggtaacctttaagttttaacgtttacggttaacgaaacggtaccgtaaggttaaccggaacgtaacggtaccgtaacgggttacggggtttacccgtttaacgggttccgggggtttaccgggttacccggggggacccgggggggtaaaccgtaacgggtcccggttaaccgggttaccccgggttacccggttaacggggtacccgaaccgggaccccggtaaacgggtcccggttaccccggtacccccccggttaccgggttacccctcccggttccccgtttacccccggg

SEQ ID NO: 26781 - DNA, 594 bp, Homo sapiens
  misc_feature: GYAE6OF01C16TQ.41.45.E01.1.454.CMB.1.raw
  modified_base (222)..(222): a, c, t, g, unknown or other
  misc_feature (222)..(222): n is a, c, g, or t
  modified_base (580)..(580): a, c, t, g, unknown or other
  misc_feature (580)..(580): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctgganatgaattgaccaaggctaattttgtttattggtaccagcagaagccagcccaggcccctgtgttggtgatgtaataaagacaggtggagacggccctcgacggggacttcccgtgacggcgtacttctcgtcggcgccaagcgtacacggaacaggtacgtcgtaccgttcgaccatcgaggtggacgtccgaggacgtaggaacgacggagtcgtgtaactatttattgtacaagcagtaacgacgagctaggtcggttaccgttacgtacgggttcggttcgggaccggggaccgtaggcctaggacccgtcggtacggtcgcgccgaacggtcgtacccggacccctccggtccnccgttcgtaccccg

SEQ ID NO: 26782 - DNA, 725 bp, Homo sapiens
  misc_feature: GYAE6OF01B6HRR.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatggaggtgacacagccacactcggtgtcagtcgtccccaggacagacggccaggatcacctgctctggagatgaattgaccaaggtctaagttttgtttattacggtaaccagtacaagtaacgaccacgccccgacggtcccctaggttggttggtcgaagttacgtaagttaaaggaaccgtaggttaggaacggacgggtaccccttacggaagggtaccgttcccgtaggacggtacgttacttacgtcgtcggccgccgacgtaccgtacgaacggaaacctaaggtacgtaccgtacggtttacgaaccgtacgttacgtaagggttccgggacgttaccgaagggaccgtaaaggaaacggtacgacgggtacctaaggtaactttaagtttagttacgagaacgtactaggtaacgagtacgagtacggttacgtccgttaggtacgggttcggttacgggggaccgggtacgtagtccgtacggtaccgtacggtaggacccggtacgacccgtacgcccgttaccggtacccccgtaccgtacgtcccgttcgttaccccgg

SEQ ID NO: 26783 - DNA, 739 bp, Homo sapiens
  misc_feature: GYAE6OF01EZW1U.41.45.E01.1.454.CMB.1.raw
  modified_base (107)..(107): a, c, t, g, unknown or other
  misc_feature (107)..(107): n is a, c, g, or t
  modified_base (221)..(221): a, c, t, g, unknown or other
  misc_feature (221)..(221): n is a, c, g, or t
tcagtctatactatcacgaccggtgctcgatttagtgagtcagtaagggaaagggggtgggtccaggaggcagaactctgggtgtctcaccatggcctggatccctntacttctccccctcctcactctctgcacaggctctgaggccgcctatgaggtgacacagccacactcggtgtcagtgtccccaggacagacggccaggatcacctgctctgganatgaattcgaccaaggtctaagttttgttttattggtaccagcagaagccaagcccaggccctgtcgttggtgagttgtaataaagacaggtaggaggacggccctcggaacgggtactccccgtggacgtacgtattccgtcgttcggccgaccacgtactacgaacggaacgtaggtacgtacgtacggttacgaacctagttaccgaggttacggacgttacccggagggtaacgaaacgggaaacggaacgggtaacggtaccgtaggtaacctttaaggtttaagtttacgtacgtaacggtacgtaacggttaagaacgaacggtcggtaacggttccgggtttaccgttaggttcggggtttacgggttaccgggggtaaccgggggaaccgttaacggcggtttaaccggtaccggttacccggtagggtaccgtaaccgggaccctaacgggacccgttaccccggcccccggttacggaccccgttacgtcccggtttaaccccccgg

SEQ ID NO: 26784 - DNA, 607 bp, Homo sapiens
  misc_feature: GYAE6OF01AVFKX.41.45.E01.1.454.CMB.1.raw
  modified_base (222)..(222): a, c, t, g, unknown or other
  misc_feature (222)..(222): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctgganatgaattgccaaggctaatttgtttattggtaccagcagaacgccacgcccacggccctgtggttggtgtatgtaataaagacgagtgagtacggccctagacgggatcccgtagacgcgattcctgtcggccgccagctacagaacagtcgtcacgttcgaccagtcgagtcggagtccgaggacgaaggaagacggacggtcgtagtacttagtttatacgtacgaagtcgaaggtacgaacacggactagttgggttaccttaggttcgggtcggttaccggggacggggtaccaaggttccgacggtacccggtccgttaaggtcgaccgacccgaacgtccgtcccgaccccgttaccggcctaccgttcccgttcccgg

SEQ ID NO: 26785 - DNA, 679 bp, Homo sapiens
  misc_feature: GYAE6OF01DRFQI.41.45.E01.1.454.CMB.1.raw
  modified_base (222)..(222): a, c, t, g, unknown or other
  misc_feature (222)..(222): n is a, c, g, or t
  modified_base (265)..(265): a, c, t, g, unknown or other
  misc_feature (265)..(265): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacaggacggcaggatcacctgctctggganatgaattgaccaaggctaattttgttattcggaccagcaaganccagcccacggccctgtgttgtgatgtaataaagcagtgagcgcctgaggatcccgtgagcgtattcacgtggacgccagcctacgaaggaaactacggtacgtccgtacgttacggaaccctaacgtacgtaggtacgggtaacgttacccgaacgggacgaaacgggtaaacggaaccggaacggtaaccgttcggtaaacctttagttttaagttacgtttaacgaacggttaaccgaacggttaacgacgaacgtacgtaacgttcgggtttaacccgttaagggtttcggggtcggttaccgggggtaacggggtacccgtaggtccggtacgtaccggttccgtacgggtacaccggacccgaacgccggttaccgcccccggttacgccttaccgtcggttccccgg

SEQ ID NO: 26786 - DNA, 656 bp, Homo sapiens
  misc_feature: GYAE6OF01EKFKS.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtcccaggacagacggccaggatcacctgctctggagatgaattgaccaaggctaattttgtttattcggtaccagcagagccacgcccaggccctgtgttggtgattgtaataaagacaggtgaggacggccctgagggctccctagagtcgattccgtgtcggcgccgagcctacgaaggaacctagttacgtacacggtttcgaacctagtaccgaggttcggacgtccgaagggtcgaaacggaaggaaccggaaggtcgttacggtaattagtttacgttacgtactaacggcgtaaggtacgaacaggactaggttcggttaccgtttaaggtcggggttacggtccgggggaccgggggtacctaaggccgttacggtacccgttaccggtagggaccgtacccgacccggtacgggtccgtaccccggtccccggttaggtaccctacgttcccgttaccccgg

SEQ ID NO: 26787 - DNA, 768 bp, Homo sapiens
  misc_feature: GYAE6OF01EXY6M.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctcccctctcactctctgcacaggctcgtgaggccgcctatggaggtcgacacgacgccacacgtcggtgtcgagtcgtacccgaggacacggacggccaggctccgaccgtgctcgtggaagtacgtagtaacgttcgaccgaaggacttaagttttgtttaagttcggtaaccgagacgaacgaacgccgaccgcccgaccggtccgttggttggttggtagtagttagtaaacgtaaacgtacgtaggtaggacggaccggtccgtacggacggtaccgtccgtaggtacgtacgtacgttcgtcgtcggccgaccgacgtacgtaacgaacggtaacgtaacgttacgtacgtacgttacacgtacgtacgtacgtacggacgtacggaggacgaaggaacggacggacggtacgtacgttactttaagttacgttacgtaacgtaacgtaacgtaacgtacgtaacgacgtacggttacgggttacgtttaccggttacgggttcgggggttacgggtaccgggggaaccgggtaaccggtacggtaccggtaaccggtaccggttaccgggtacggtaccgacccggtaaccggtacggtaccccgtccccggtacccggttacgttacccgtccgttcccggttacccg

SEQ ID NO: 26788 - DNA, 706 bp, Homo sapiens
  misc_feature: GYAE6OF01BXQBQ.41.45.E01.1.454.CMB.1.raw
  modified_base (107)..(107): a, c, t, g, unknown or other
  misc_feature (107)..(107): n is a, c, g, or t
  modified_base (224)..(224): a, c, t, g, unknown or other
  misc_feature (224)..(224): n is a, c, g, or t
tcagtctatactatcacgaccggtgctcgatttagtgagtcagtaagggaaagggggtgggtccaggaggcagaactctgggtgtctcaccatggcctggatccctntacttctcccctctcactctctgcacaggctctgagccgctatgaggtgacacagccacactcggtgtcagtcgtcccaggacaggacggccaggtactccgacctgcctcgtgganatagtaattcgaccgaaggtctaagttttgtttatcggtacagtcaaggagccagcccgacggccccttggtcggttggtgattagtaacgtaagacgagtgacggacgtcccgtagagggtacctccgtggacgtcgtacgttcgtcgtcggccgcgtacgtctacgacggtaacgtagttacggtactacggttacactacgtacgacggtcggcgttaccgacggtggaacggaacggaccgtagggccttaggacgtttaacgtttacgttaggtacctaagtccggtaaagttacgaacgacgacgtttacgggttacgtaccggttttaacgtgggggttttaccgggacgggggtaccggggtaactaacggttcggtaacccggtaccggtcccgggttaaggacccgccggtacccggtaagtccccggtaccggtcccccgttaggttacccctccgtccgggttacccccg

SEQ ID NO: 26789 - DNA, 748 bp, Homo sapiens
  misc_feature: GYAE6OF01COZ8M.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgaccaaggctaatttgtttattggtaccagcagaacgccacgcccgacggcccctgttcggttggtgacttaggtaataaaagtacaggtagacggacggccctacgaagggactcccgagacgcgattcgtcgtggcgccagtctacgaacggaactaggtaacgtctacgttacgacctagtacgaggtagggacgtccggaaggaccgaaaggaacggacggacggtctacggtaacttagttttagttaccgacgtaacgcgtaacggtaacgtaccgaggtacgtaggttaccgggtttacccgtttaacgggttccgggggtttacgggtttccggggggaaccccgggggggtaacctaacgggtacccgtttacgggaaaccccggtttccggtaaaccggggttacggtaaccccgggaaccccgggtaaacgggttccccggtaccccggttacccccccgggttaccggtttacccggttaaccccgttcccggttttaccccccggg

SEQ ID NO: 26790 - DNA, 777 bp, Homo sapiens
  misc_feature: GYAE6OF01DKOG2.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacgccaggactcacctgctctggagatagaattgaccgaaggctaattttgtttatcggtacagcaagagccacgcccacggccctgtggttaggtgagtgtaataaagacgaggtgacggacggccctacgacgggtctaccgtagacgcgtattctcgtcggccgccacgcctacgaacggaactaggttaacgtcgtacggttacgacctagtaccgtagggtacgggtacggttaccgaacgggaccgaaagggaacggaaaccgggtacgggtactaacgggtactttaacggttttaacgtttcggtaccgtaaacggtacgtaaggttaaacggaaccgtaaggtacggttaaccgggtttaccgggttaccgttttaaggggttccgggggtttacgggtttacccggggggggtaaccggggggaaaccttaacgggggtaccgttaccgggtaacccggtttacccggttaacggggtaccggtaaaccggaaccccggaacgggttacccggtccccggttacccccggtcccgggtttacccacccggttttcccgttacccccccggg

SEQ ID NO: 26791 - DNA, 724 bp, Homo sapiens
  misc_feature: GYAE6OF01CD56K.41.45.E01.1.454.CMB.1.raw
  modified_base (222)..(222): a, c, t, g, unknown or other
  misc_feature (222)..(222): n is a, c, g, or t
tcagtctatactatcacgaccggtgctcgatttagtgagtcagtaagggaaagggggtgggtccaggaggcagaactctgggtgtctcaccatggcctggatccctctacttctccccctctcactctctgcacaggctctgaggccgcctatgaggtgacacagccacactcggtgtcagtcgtccccaggacagacggccaggatcacctgctcgtgganatagaattgaccaaggctaatttgtttatcggtacagcagaacgccacgcccacggccctgtgttggtgatgtaataaagacagtgagacgcctagacggtactcccgtagacggtcgtacttctcgtcggccgcgacgtcctacgaacggaactaggtacgtaccgtacggttacaacctagtacgacgggtaggtacgtaccggaggtacgaagggaacgacggaacggtacgtacgtaacttagtttaacgttacgtaacgaaggtctaaggtacgaacgtacggtacgttacggttacgggttttaccgttaacgggtttccggggttacggggtttacccgggggaaccggggggtaaaccgtaacgggtccgtaccgggttacccggttaccggttacgggtacccgaaccgggtacccgggtaaacggttccccggtaccccggttacccccgggttaccggttacccgttcccggtttcccgtttccccccggg

SEQ ID NO: 26792 - DNA, 767 bp, Homo sapiens
  misc_feature: GYAE6OF01CA3SM.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctcccccctcctcactctctgcacaggctctgagccgcctatgaggtgacacagccacactcggtgtcagtctccccaggacaggaccggccaggtactccacctgctcgtagggaatagtagtaattcgacccgtaaggcttaaagtttttgtttagttacgggaccacggacaagaacgcccaacggcccccgtaacgggtccccttggttggttcggtgtagttaggtaataaaacggacgtaggtacggaaggtacggtacccctacggaacgggtacttaccccgtaggtacggacggttaacttttccgtacggtacggtcccgaccgtagtcccgttagaacggtaaacgtacggttaacgtaccgtacggttaccgaacctacgtacgtaggtacggtacgtacccgaggacgaaggaacggacggacggtctacggttacgttaagtttagttacggtataacgtacgtaagtacgacgaaggtcctaggttccgggttacgttacgggttcgggtttacgggtccggggaccgggggtacgtacggtaccgtaccgggaccgttccgggagttaccggacggtacccggaacgggtcccgtacccggtacccccgtaccggtaccgtcccgttcgttaccccccg

SEQ ID NO: 26793 - DNA, 628 bp, Homo sapiens
  misc_feature: GYAE6OF01DO2KE.41.45.E01.1.454.CMB.1.raw
  modified_base (288)..(288): a, c, t, g, unknown or other
  misc_feature (288)..(288): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctcgtggagatgaattgccaaggctaatttgttagttggtaccagcagaagccagcccaggccctgtcgttggtnatgtataaagacagtgagaggccctgacgggtactccctgacgcgtacttctcgtcggccgccaacggctacgaaggtaacaaggttacgtacgtacggttcgaaccgtagtaccgaggtcgggtaacgttcccgaagggtaccgaagggaaacgacggaaggtcgtacgtacgttaattagttacggtacagacctagtaagacaagtcgaggttcggtctttacgtcgggttggtccgggacggggaaccgaagtcgtacggaccgtaccggtaggtccgaccggacccgaaggtcccgtcgaccccccgttcggtccctaccgttccgttaccccgg

SEQ ID NO: 26794 - DNA, 670 bp, Homo sapiens
  misc_feature: GYAE6OF01DL2BR.41.45.E01.1.454.CMB.1.raw
  modified_base (307)..(307): a, c, t, g, unknown or other
  misc_feature (307)..(307): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgacggccgcctatgaggtgacacagccacacgtcggtgtcagtcgtaccccaggacaggacggccgaggctcacctgctcgtggagtactgaattcgaccgaaggtacttaagttttgtttattcggtaccagcaagacgcacgccgacggtccctgtcgttggngatgtaataaagacgtagtgacgcggacctggaacggtacctccgtgacgcgtattctacgtggccncgntccgtacgaagaacgtgtacgtcgtacgtcgactgtacgagtcgacgtcgaagacgaaggaacgacgacggtctaacgtattaacgtttatcgtacgaagaacgtagtacgaacgcgtagtacggtttacggtaccgtttacggttcggggttaccgggtcgggggtaacccgggtacgtacggaccggttggtaaccccggttcgtacggaccgtacccggaaccggttacccggtcccggtacccggtcccccggttaggtcccttacccgggtcccgtttaacccccggg

SEQ ID NO: 26795 - DNA, 771 bp, Homo sapiens
  misc_feature: GYAE6OF01CYJ0Z.41.45.E01.1.454.CMB.1.raw
  modified_base (171)..(171): a, c, t, g, unknown or other
  misc_feature (171)..(171): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacncgtcggtgtcagtcgtccccaggacaggaccggaccaggatccacctgctcgtaggagtagtagtaattcgaccgaaggacttaagttttggtttagttcggtaacagtcaagaacgccaacgcccgaccggcccttggtcggttggagtagtagtaagtaaaacgtacgaggtaggtaacggaccggtccccgtaggtaacggggacttcccgtaggacgtacgtacgttccgtcgtcggccgaccgtacgaccgttacggaaaacggaacgtaacggttaacggtaccgtaacggtttaccgaaccgtaagtaccgagggttacgggtacgtaccgaacgggactaaaggggaaacgcgggtaacggtaccgttaggtaacttagttttaacgtttggaacgtaagtaaccgaaggttaacgaaccgaagtcggtaacggtttacgttacgtttagggttcgggttacggggttaccgggggtacccggggaaaccgtacggtaccgtacggtacccggttacggtacgtaccggtaacggacccgtaacggtcccgtaccccgtaccccggtgtaccctcggtttccgtacccccgg

SEQ ID NO: 26796 - DNA, 1076 bp, Homo sapiens
  misc_feature: GYAE6OF01DL7VC.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttcctcccccctcctcactctctgcacaggctctgaggccgcctatggaggtgacacagacccacacgttcggtgtacaggtcgtacccccgaggaccaggaccggccagggactccaccgtgctcgtagggagtatcggtaattcgaccgaaggtacttaattttgttttaagttcggttaaccaggacgaaggaacgacccgaacggacccgaccgggtccccgtggttacggtttacgggtagtaagttgtaaagtaaaagacgtaagtaggagaccggtaccctaggacgggtacctacccgtaggaacgtaccgttacgttccgtttaccgacggtacccggaccgacggtacccgtacggtaaaccggtaaacgtaacggttaacggtttaacccgtaaacggtttacccggaaaacccgtacgtttaaccgggtaacggggttaccgggtaacccggtaacccggtaacggggtaaccgggaaacgggttaaaccggggaaccgggtaaccgggtaacccgggttttaaacgggtaaaccctttttaaagttttaaccgggtttaagggttaacccgaaaccgggttaaccgttaaagggaaacccgtaaacggtccgggtaaccggttaacgggttttaacccggggtttacccgggttttaaaccggggtttcgggggggtttaaccccggggttttaaccgggggggggaaaccccccggggggttaaaacggtaaaccgggttaccccgtttaaacccggggggttaccccccgggtttaaaccgggtttaaccccggggaaccggtaccccccggggttaaacccccgggttaaaccccggggttacccccgggtttaaaccccccccggggttcccccccccgggttaaacccggggtttaaaccccccgttccccgggtttttaaccccccgtttttaaccccccccggggg

SEQ ID NO: 26797 - DNA, 594 bp, Homo sapiens
  misc_feature: GYAE6OF01B2MAE.41.45.E01.1.454.CMB.1.raw
  modified_base (544)..(544): a, c, t, g, unknown or other
  misc_feature (544)..(544): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgaccaaggctaattttgtttattggtaccagcagaagccagcccaggccctgtgttggtgatgtataaagacagtgaggacggccctgagggctccgtggagcgattctcgtggccgccagctacgaaggaacagtagtctacggttcgacctatacgagtggacgtaccgaggacgaaggaacgaacggaggctagaacttagtttattcgtacgaagtacgtaggtaacgaacgagccgtaaggttcgttacctttagggtcggggtttcggtcggggacggggaccaggtctacggtccgtacgtcggtacnccggaccgtaaggcccgtaccggcccccgtggtcctccgtccttccccgg

SEQ ID NO: 26798 - DNA, 740 bp, Homo sapiens
  misc_feature: GYAE6OF01C35P0.41.45.E01.1.454.CMB.1.raw
  modified_base (168)..(168): a, c, t, g, unknown or other
  misc_feature (168)..(168): n is a, c, g, or t
tcagtctatactatcacgaccggtgctcgatttagtgagtcagtaagggaaagggggtgggtccaggaggcagaactctgggtgtctcaccatggcctggatccctaactacttcctccccctcctcactctctgcacaggctctggacggccgcctagtggaggtanacacacgaccacacgtcggtagtcgagtcgtaccccgaggacgacggaccggccaagggactaccaccgttggctcgtaggagagtagtaagttcgaccgaaggtacttaagttttaggtttagttcggaccagacaacggaacgaccgaccgacccgtaccggtcccgttaggtggttaggtagtagtaggttaaacgaaagtacgtaggtaggacggaccggtcccgtaggacggtacgtacccgaggtacggtacgtacgttcgtacggtcggaccgaccgtaacgtcgtaacggaaacggtaaccgtacggtacgtacgtacgtaacgtacgtaacgtacggaagggttacggaccgtacggaagggacgaagggaacggacgggagtacgtaaggtaactttagttacgttagtaacgaggtacgaagtaccgaagtacgtacggttacggttacgttacggtacgggttcgggtacgggtacggggacgggactacggccgttagccggtagtacgacgtaccgaccgacgccgtcccgtaccctcggacctcgtccgttacccgg

SEQ ID NO: 26799 - DNA, 751 bp, Homo sapiens
  misc_feature: GYAE6OF01B1OBM.41.45.E01.1.454.CMB.1.raw
  modified_base (107)..(107): a, c, t, g, unknown or other
  misc_feature (107)..(107): n is a, c, g, or t
  modified_base (220)..(220): a, c, t, g, unknown or other
  misc_feature (220)..(220): n is a, c, g, or t
  modified_base (287)..(287): a, c, t, g, unknown or other
  misc_feature (287)..(287): n is a, c, g, or t
  modified_base (352)..(352): a, c, t, g, unknown or other
  misc_feature (352)..(352): n is a, c, g, or t
tcagtctatactatcacgaccggtgctcgatttagtgagtcagtaagggaaagggggtgggtccaggaggcagaactctgggtgtctcaccatggcctggatccctntacttctccccctctcactctctgcacaggctctgaggccgcctatgaggtgacacagccacactcggtgtcagtcgtcccaggacagacggcaggactcactgctcgtgganatgaatcgaccgaagctaatttgttatcggtaccagcagacgcacgccgacggcccttgtgttggtnagtagtaactaagacgagtagacgacggcctacggaggactcccgtagacgacgtacttcgtcgnggccacgtacgctacgaacggaacgtacgtacgtaccgtacgttacgaccagttacgagggtacggacgtaccgagggaaccgtaaggaaacggacgggtaagggtacttaacggtaacgttttaacgtttaagtttaccgggtaacgtaaacgtaccggttaaggtaaggtaaccgtaggtaacccggttaagggtttacccgggtttaccgtttaacggggttaccgggggttcgggtttaacccgggggacggggtaacctaacgggttcccggttaaccggtacccggttaaccggtacgggttccgtaacccgggtaacccgtacgggttacccccgtccccggttacccccggttaccggtttacccgtacccgtttccccgttacccccggg

SEQ ID NO: 26800 - DNA, 806 bp, Homo sapiens
  misc_feature: GYAE6OF01C4290.41.45.E01.1.454.CMB.1.raw
  modified_base (218)..(218): a, c, t, g, unknown or other
  misc_feature (218)..(218): n is a, c, g, or t
  modified_base (350)..(350): a, c, t, g, unknown or other
  misc_feature (350)..(350): n is a, c, g, or t
tcagtctatactatcacgaccggtgctcgatttagtgagtcagtaagggaaagggggtgggtccaggaggcagaactctgggtgtctcaccatggcctggatccctctacttctccccctctcactctctgcacaggctctgatgccgcctatgaggtgacacagccacactcggtgtcagtcgccccaggacagacggcaggatcactgctctgganatgaattgaccgaaaggctaaagtttttggtttaattcggtaccagcagaacgccaacgcccgacggtccccgtggttgttggtgattaggtaataaaagacaagtgagacggccctagaagggactcccgngacggggtctaactttcgcgttcgggccgacccgaaggtaccctacggaaagggaaaccgtaaggtttaacgttaccctaaaccggggttttacaaaccccgtaagttacccgtaagggttacgggaaccggtttacccgaacgggaccgaaaagggaaaacgggaacccgggttaagggaccgttaagggtaaacccttttaaagtttaacgttttgtaacccgaaaggttaccgaaaggtttaaacgaacgaacggtccgtaaagggtttcggtttacccgttaagggttcggggttaccgggtttaccgggggaccgggggggtaaccaaacgggtccgttacgggtaaccccgggttaccgttaacggggtccgaaccgggtaccccgtaaacggggtcccgttaccccgggtaccccccgggttaccgggttaccaacccgttttccccgg

SEQ ID NO: 26801 - DNA, 745 bp, Homo sapiens
  misc_feature: GYAE6OF01DA9IO.41.45.E01.1.454.CMB.1.raw
  modified_base (180)..(180): a, c, t, g, unknown or other
  misc_feature (180)..(180): n is a, c, g, or t
  modified_base (343)..(343): a, c, t, g, unknown or other
  misc_feature (343)..(343): n is a, c, g, or t
tcagtctatactatcacgaccggtgctcgatttagtgagtcagtaagggaaagggggtgggtccaggaggcagaactctgggtgtctcaccatggcctggatccctctacttcctccccctcctcactctctgcacaggctctggacggcccgcctagtggaggtgacacacgaccaacncgtcggtgtcgagttcgaccccgaaggacaggaccggacgaggactcgacgtcgactcgtaggagtatagtattcgaccgaaggtcttaaagttttgtttagttacggtacctaagacaacggacgccgaccgcccgtacggtcccgttaggtggtttggtanaggttacgtaaagaaagtcgaggtaggacggaccggtaccgacggtaacgggtcctccggtaaggcgtacgtaccgtttcgtcggtcgaccgacgtacgccgttaacggaacgtaacggtagttaccgtacgtacggttaaccacgtaaacgtcggtacgggtcggtaaccggttcggaacgggtacgaaaggtaaccggacggacggtaacgttaccgtaatttaaacggttcgtaacggaacgacgtacggaacgtacgtacgaacgtgtacggtacggttcgtacgggtcgggtggaccggggtacggactggacggttaccgacggttccgtagggcctaaccggccggacgtcccgttacccggtcccgtacgtcccgttccgtaccccggttcccg

SEQ ID NO: 26802 - DNA, 1012 bp, Homo sapiens
  misc_feature: GYAE6OF01ALKX2.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggccctgtgttggtgatgtaataaagacagtgagacggccctcgaggggactccccgtggacgcgtaactttcgtccgttcgggccgtcccgaggccttaccgaacgggtaaaccgtaggttaacggttacccgtaaccgggttttacggaaccccgtaacgttacccgtaacgggttacggggtaacggtttaccccggaacggggtaccgaaacgggaaaacgggtaacccggggtaacggggtcccgttaacggggtaacccgttttaaacggtttttaaacgttttacgggttaaaccgtaaaacggggtaaccgttaaacggggttaaaccggtaaacccggtaaacgggtaacccggttaaacgggggttttaccgggggttttaacccccggttttttaaacgggggtttaccccggggggtttttaaccgggggttttaaccccgggggggggtaaccccgggggggggggttaaaacccccgttaaaaccggggggtttaccccgggtttaaccccggggttaaacccccccgggggtttttacccccgggtttaaaccggggggtttaacccccggttaaaccccggggtaaacccccccgggttaaaaacgggggttccccccggtttaacccccgggggtaccccccccccccgggtttttaccgggggtttaacccccccggttaaacccccgggtttttcccccgggttttaacccccccccggggg

SEQ ID NO: 26803 - DNA, 828 bp, Homo sapiens
  misc_feature: GYAE6OF01E1ON5.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctctcactctctgcacaggctctgacggccgcctatgaggtgacacagccacactcggtgtcagtcgtcccaggacaggacgcaggactcaccgtgctcgtaggagtagtagtaacttcgaccgtaaaggtacttaagtttttgttttaagttacggtaaccgacgtacgtaacgaacggacccgaacggaccccgtaaccgggtccccgtttgggttggtttcgggtacgttaagtttacggtaaaacgtaaaacggaccgtaaggttacggaacgggtacccggtcccgtaacggtaacgggtaccttcccggtaggtacggtaccgttacgttccgtcggttcggaccgtaccgtacggttaccgtacgaacgggtaaacgtaacggttacgtacccgttaacggttacgtaacctacgtacgtaacggttcggaccgtacgacggaacgtaacgggaacgtaacggtacgggtacttacgtaacgtttagtttagtacgttacgaacgagtaacgtaagacgtaggtactacgggttacgttaccgtttaggggtcgggtttaccggggtacggggaccgggtaaacgtccggtaccggacggtttacccggtcggtaccggtacccgtaacgggaccccgtaacggccccgttaccggggttacccccctacgggtttcccttcccggttcccgttaacccccgg

SEQ ID NO: 26804 - DNA, 912 bp, Homo sapiens
  misc_feature: GYAE6OF01BHU2J.41.45.E01.1.454.CMB.1.raw
  modified_base (181)..(181): a, c, t, g, unknown or other
  misc_feature (181)..(181): n is a, c, g, or t
tcagtctatactatcacgaccggtgctcgatttagtgagtcagtaagggaaagggggtgggtccaggaggcagaactctggggtgtctcaccatggcctggatccctctacttctccccctctcactctctgcacaggctctgacggccgcctagtgaggtgacacagccacacgtcggtntcagtccgtccccgaggacacggaccggccgaggactccaccgtgtcctacgtaggaatacgtagtaacgttcgaccgtaaggtacttaagttttcgtttacgttacggtaccgagtacgacggaaccgccgacgacccgaccggtccctggttcgttaggtactagttagtaaacgtaacggacgtaggtacgaacggtaccggtacccgtacggaacgggtaccttcccggtaggaacggttacgttaaccgttccgtccggttacggccgtaccgacggtacctacggaaacgggtaacgtacggtacgtaccggtacgttaccgaacgtcgtaacggtacgggttacggtaccgtaccggacgtaaacggaacgggtaaaaccggtacgggacgttaaccgtacggttaacgtttacgtttaacggtacggtaaccgtaagtacggtaaacgggttacgaacccgtacggtaacggtttaaccggttccggggttttacccggttaggggtttacccggggggttaagggttcccggggggggaaacccggtaacccggttaaccggttacccggggtaacccgggttaaccccgggtagggttttacccggaaccccgggtaaccccggtaaccccgggtacccgggttccccccggttaaccccgggttaccccggttaccccgggtttaaccccttcccgggttaacccctttcccccccgggg

SEQ ID NO: 26805 - DNA, 756 bp, Homo sapiens
  misc_feature: GYAE6OF01C9VRL.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacacgtcggtgtcagtcgtccccaggacaggacggccaggatccacctgctcgtggagtatagtaattcgaccgaaggtcttaagtttttagtttatttcggaaccagcgaagaacgccaacgcccgacggtcccttggtcgttggtagtagtagtaaagtaaacgacgagtaggacggtacggtcccgtaggacgggtaacttcccgtaaggacgtacgtacgttcctcggtcggccgtaccgaacggtccgtacggaacggtaaccgtaggtaaccgtccgttaacgttacggaacctacgtacgtacgggttacgggtaaccgtcccggaaagggtcgaaagggaacggtaacggacggtacgtacgttaactttagtttaacgttacgaacgtaacgtacgtaaggtagacgagtacggtacggttcggttacgttcgggttcgggttacggggtccgggaacggggtaaccgtacggtcggtaccggtaccggtaacggtacggtaccgaccggaaccggtccggtacccgttccccggtacccccggttaggtaccccgtcgtttccccggttaacccccgg

SEQ ID NO: 26806 - DNA, 851 bp, Homo sapiens
  misc_feature: GYAE6OF01D6GJ5.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttcctccccctcctcactctctgcacaggctctgaggccgcctagtggaggtgacacacgccactacgtcggtgtcagtcgtaccccgagacacgcggaccaggtactccaccgtgcctcgtggagtatagaagttcgaccgtaaggcttaagtttgtttacgttcggtaacctagcgaaggaacgacccgacgtaccccgtaccgggtccccgttagggtttcggttacggttacggtacgtttaaggttaaagttaaaccggaccggttaaggggtacggaaaccggggtaccgggtaccccgtaacggtacggggttaacccctcccggtagtaacggtccgttaaccgtttcgtccggtcggcccggtacctcgtccgttacgaaacggttaaacgtacggtaaccggtccttaaccgttaccgtaaccgtacggtacggtacgtacgggtacgtacccggaaggtaccgaaacggggttaacgaccggtaacggtcgtaaccggttttaacgttacgttttaaacgttcgttaacgtaacgtaacgtagggtaaaccgacgttaacggccgtttaaacggtccggttaaccgttttacgggtcggggtttacgggtccggggaaccgggtaccgaggttcccgtacggtcccggttaagttacccggacgtacccggaccgaccgggttaccctcccggtacccgttaacggtccctaccggttcccgttccccgg

SEQ ID NO: 26807 - DNA, 702 bp, Homo sapiens
  misc_feature: GYAE6OF01CYGOG.41.45.E01.1.454.CMB.1.raw
  modified_base (392)..(392): a, c, t, g, unknown or other
  misc_feature (392)..(392): n is a, c, g, or t
  modified_base (518)..(518): a, c, t, g, unknown or other
  misc_feature (518)..(518): n is a, c, g, or t
tcagtctatactatcacgaccggtgctcgatttagtgagtcagtaagggaaagggggtgggtccaggaggcagaactctgggtgtctcaccatggcctggatccctctacttcctccccctcctcactctctgcacaggctctggagccgcctagtgaggtgacgacacgccacacgtcggtgtcagtcgtaccccgaggacacggaccggccgaggtactccgacctgccttcgtggaagagtagtaagttcgaccaaggtacttaagtttcgtttagtcgacagcaagtacgccacgccccgtacggcccgttgtaggttcggtagtagtagtaacgtaaagacgagtacggacgaccggccctggacggtactccgtgacgcgttatcncgtggccaccgtagcgtacggaagtaacgagttacgtcgtacggtacgtacgtactcggttacggagtaccggtacgaggacgaggtaaacgacggagtacgtatacgttatacgttgaccgtaanacgaacgttacgacgtagtaccggtagttaacgttccggttagggttcgggttacgggtcgggaccggggtaactacgggtccgtaccggttaaccggtaggtacccggttacgaccggacccggttaaccggcccgttccccggaaccccgttccggttacccctcgttcccgttaacccccg

SEQ ID NO: 26808 - DNA, 612 bp, Homo sapiens
  misc_feature: GYAE6OF01CURUJ.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgagccgcctatgaggtgacacagccacactcggtgtcagtgtccccaggacagacggcaggatcacctgctctggagatgaattgaccaaggctaatttgtttattggtaccagcagaagccagcccaggcccctgtcgttggtgatgtaataaagcagtgagacggccctgagggactccctgagcgtatctcgtggcgccagctacgaggacagtacgtcacgttcgacctagtcaggtggtacgtcccgaaggcgaaaggaacgacggaaggtcgtgtaacttatttacgttgactaaggctaagtaaggactaaggctaaggttcgttaccgttagtcggggttcggttccgggaccgggggaaccaaggtccgtacggtacccgttccggtaggcccgtaacggaccccgtaagggtcccttaccggccccccgttaggtacccaccgttcccgttacccccggg

SEQ ID NO: 26809 - DNA, 682 bp, Homo sapiens
  misc_feature: GYAE6OF01BIB40.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctggacggccgcctatggaggtgacacagccacactcggtgtcagtcgtccccaggacaggacggccaggactccacctgctcgtggagatagaattgaccgaaggtctaattttgtttacttggtaccagcaagaacgccacgcccgacggccctgtggttggtgtatagtaataaagacagtgaggacgcctacggacgggtactccgtgagtcgtacttctcgtcggcgccagcctacgaacggaactaggttacgtaccgtacgtacgaacctatacggaggtcggacgtaccggacggacgaagggaacggacggtacgtacgttagtacgtttagttacgttcgtacgtaagtacgtagtacgaacgagtaccgttacgggtcggtttaccgttagggttccggggttacgggtaccgggggaccggggaacctacggtaccggttcggtacccggtaccgttacgggaccgtacccggaccggtacggtcccggtacccgtaccccggtcgtcccgtaccgttccgttcccccgg

SEQ ID NO: 26810 - DNA, 687 bp, Homo sapiens
  misc_feature: GYAE6OF01CQPQU.41.45.E01.1.454.CMB.1.raw
  modified_base (108)..(108): a, c, t, g, unknown or other
  misc_feature (108)..(108): n is a, c, g, or t
  modified_base (136)..(136): a, c, t, g, unknown or other
  misc_feature (136)..(136): n is a, c, g, or t
  modified_base (142)..(142): a, c, t, g, unknown or other
  misc_feature (142)..(142): n is a, c, g, or t
  modified_base (163)..(163): a, c, t, g, unknown or other
  misc_feature (163)..(163): n is a, c, g, or t
  modified_base (178)..(178): a, c, t, g, unknown or other
  misc_feature (178)..(178): n is a, c, g, or t
  modified_base (352)..(352): a, c, t, g, unknown or other
  misc_feature (352)..(352): n is a, c, g, or t
  modified_base (477)..(477): a, c, t, g, unknown or other
  misc_feature (477)..(477): n is a, c, g, or t
tcagtctatactatcacgaccggtgctcgatttagtgagtcagtaagggaaagggggtgggtccaggaggcagaactctgggtgtctcaccatggcctggactccctntacttcctcccctctcactctctgcaanggctgngaggccgtctagtgagtgacncagccatacgtggtntccagttcgacccgaagggacacggccgacgaaggtctccgaccttggcctacggtaggagtactcggtaagttcgacctaaggtacttagttttacgtagttcggaactacggccgaaagtacgactaacgacccgtaacgtccgtggttacggtaggtagtatcggttaaanaaacggtcgtaggtgaacgaaccggtccgtaggaacggtactccggtaagcggtactaattcggacgtaggcccaagactacgagtaaagacgtaggtacgtacgacgttaggaactacggtacnggtacgtacgtacaggtacaacggtacgtacgaacgtacgtataactttagtacgtacgtaacgaagtacgtaacggtacgacgtaacggacggttaggtacgttaccgtaggtacgggtgggtacggtacgggtaacctagtcgtaacgtccgttacgaagtccgtacgaaccgagtccgtacccgtaccgtggaactccgtgtacccg

SEQ ID NO: 26811 - DNA, 782 bp, Homo sapiens
  misc_feature: GYAE6OF01AB1PZ.41.45.E01.1.454.CMB.1.raw
  modified_base (253)..(253): a, c, t, g, unknown or other
  misc_feature (253)..(253): n is a, c, g, or t
  modified_base (541)..(541): a, c, t, g, unknown or other
  misc_feature (541)..(541): n is a, c, g, or t
  modified_base (593)..(593): a, c, t, g, unknown or other
  misc_feature (593)..(593): n is a, c, g, or t
  modified_base (616)..(616): a, c, t, g, unknown or other
  misc_feature (616)..(616): n is a, c, g, or t
tcagtctatactatcacgaccggtgctcgatttagtgagtcagtaagggaaagggggtgggtccaggagcagaactctgggtgtctcaccatggcctggatccctctaccttctcccccctcctcactctctgcacaggctctggacggccgcctatggacggttgacacacgccactacgtcggtcgtcaggtccgaccccgaaggacacggaccgggcctaacgggtctacccaccgttcgcttcgagggngtataggtaattcggacccgaaaggtactttaagtttttcgtttacgttacggtaaccacgacgaacgaaccgccgaaccggcccgacccggtcccgttaggttcggtcggtatagttaaggtaacgtaagacgtggttagacggccggtaccctaggtacggacgtccgtacggtacgacgttaccttccgtcggtcggcctcgaacgtcgtaacgaggtaacgtaggtacgttaccgtacggtacaaccgtgtaacgtagggttacgtaccggtacggaccggtanaaaggtaaccgggagtacgtacgtagttaactttaggttcgtaaccgttaanaccggtaacgtaagtcccggagngtttaccggagttttaccccgggttcttaggggttaccgggttcgggggtaaacccgggtcggaaacccgtagtcccggtaccggttaccgtaccggtgtaaccgaccgggccttaaccggcccgttacccggtcgttacccgccgttcccgtaccggtttccccg

SEQ ID NO: 26812 - DNA, 926 bp, Homo sapiens
  misc_feature: GYAE6OF01DB959.41.45.E01.1.454.CMB.1.raw
  modified_base (107)..(107): a, c, t, g, unknown or other
  misc_feature (107)..(107): n is a, c, g, or t
tcagtctatactatcacgaccggtgctcgatttagtgagtcagtaagggaaagggggtgggtccaggaggcagaactctgggtgtctcaccatggcctggatccctntacttctcccctcctcactctctgcacaggctctggaggccgcctagtgagggtgaaccacgaacgcccacacgttccgggtgtaccaggttccgtcccccgaagggaccaggaccggccaagggcttcccacccgttggtcctacgtgggaacgtagtagtaacttcggacccgaaaggtcttaagtttttgtttacgttcggaccgagacaacggaacggacccgaccgtccccgaacggtccccgttggttcggttaggtacgtgtttacgtaagtaagtacggtagtacggacggacggtcccgtaggacgggtaccgttcccgtaggaccgtcgtaacgttcccgtaccgtcgggtaccgaccgtacgtacccgtacggaacgggtaaaccgttaggtacggtaacccgtaacggtttaaccggaaccttaccgttacggtaacggggtacggttaaccgtaccggaaacgggttacgaaacggggtaaaccgtacgggaacggttacgtaccgtaacgtttaacggtttaggtaccgttaacgaacggtaacgtacgggtaacctaacgggtaaccgtacggttacggtttaacgggtacccgggttttacgggtttaccgggggttacgggggtttacccgggggaacgggggtacccgtaacggtcccggtaaccggtacccccgggtttcggtaaccccggggttacgtaacccccgggaccccggttaaccggtcccccggttaaccccggtaccccccggtttacgggaccccctttacccccgggttcccggtttaaccccccccgg

SEQ ID NO: 26813 - DNA, 721 bp, Homo sapiens
  misc_feature: GYAE6OF01DRVJE.41.45.E01.1.454.CMB.1.raw
  modified_base (232)..(232): a, c, t, g, unknown or other
  misc_feature (232)..(232): n is a, c, g, or t
  modified_base (316)..(316): a, c, t, g, unknown or other
  misc_feature (316)..(316): n is a, c, g, or t
  modified_base (393)..(393): a, c, t, g, unknown or other
  misc_feature (393)..(393): n is a, c, g, or t
  modified_base (539)..(539): a, c, t, g, unknown or other
  misc_feature (539)..(539): n is a, c, g, or t
  modified_base (702)..(702): a, c, t, g, unknown or other
  misc_feature (702)..(702): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgagcccgctatggaggtgacacacgccaacacgtcggtgtcagtcgtaccccaggacacggacggccaggactccaccgtgctcgtgganatagaattcgaccgaaggtcttaagtttgtttattacggtacagtcaagacgccacgcccgacggtccctggtcggttggtagngttagtaagtaaagagaggtagacggcggtccgtagacggacttccgaggagtacgtacgttctcgtcggccgacgngtaccgcgaagtaaacgtggtacgtacgtaacgtcgtaaccgtagtacgtggtaaggtacgccgaacggtagaacggtaacggaacgggtacgacgtgttaagtacttttagtacgtacaacggtactaacggtaagctaacgggngttaacgttcggggtttaccgttaaggggtttcccggggttaggggttaccgggggaccggggtaaccctaggggtacccgttaacgggtcccgggttacccggtaaggtcccgtaacgaccccgggttaacggcccgtcccggttaccccgtaggttccccncgtttacccggtacccccg

SEQ ID NO: 26814 - DNA, 781 bp, Homo sapiens
  misc_feature: GYAE6OF01B8Y9T.41.45.E01.1.454.CMB.1.raw
  modified_base (179)..(179): a, c, t, g, unknown or other
  misc_feature (179)..(179): n is a, c, g, or t
  modified_base (226)..(226): a, c, t, g, unknown or other
  misc_feature (226)..(226): n is a, c, g, or t
tcagtctatactatcacgaccggtgctcgatttagtgagtcagtaagggaaagggggtgggtccaggaggcagaactctgggtgtctcaccatggcctggatccctctacttcctccccctctcactctctgcacaggctctgacggccgctatgaggtgacacagccacacgtcggtntcagtcgtccccgagacaggaccggcaggactcactgctgtggagtntagtaatcgaccgaagtcttaagtttgtttagttcggaccacgagaagacgccgacgacccgacggtccccgttggttcggtttggtacgtaagttagttaaagtaaacgacgtaggtaggaacggacggtcccgtaggacgggactacccggtgacgcgttagtctcggtgccgacgcgtaccgtacgaacggaacgtagtacgtacgtcggttaacgtacctacgtacgtaggtacggtacgaccggacggaacggaaggaaacggaccgggtacgtaaccgttaagtactttaagttactttacggaacgtacgacgtaggttaaacgaacggtcggacggttaggttaacccggtttcggttaaaaccgggttcgggggtttccggggtaccggggggaaaccggggttaaccgtacgggtcccggtaaccggtacccgggttttaacgtccgggggtaacccgtaaccgggttacccggtaaaccgggtcccggttaccccggaccccggtttaccggccccgttacccgtttccccggttaaccccccg

SEQ ID NO: 26815 - DNA, 885 bp, Homo sapiens
  misc_feature: GYAE6OF01EZ8L1.41.45.E01.1.454.CMB.1.raw
  modified_base (177)..(177): a, c, t, g, unknown or other
  misc_feature (177)..(177): n is a, c, g, or t
  modified_base (312)..(312): a, c, t, g, unknown or other
  misc_feature (312)..(312): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgagccgcctatgaggtgacacagccacactcggtntcagtcgtccccaggacagacggccaggatcacctgcctcgtggatatgaattcgaccaaggcttaagttttagtttagttacggtaccaggcaaggaacgccacgcccgacggtcccctggttggttcggagtntttaaaacgggtaaacgtaaacgtaactaggtacggtaacggtaccgggtaccccgttacggtaccgggtaacgttaccccggttacggtaacggtaccggtaacgtttccgttccgttccgggtacccggacccgtaacggtaccgttaccgtaacgggtaaaccgtaacggttaaccggttacccggtaaccggttaccgtaacccgtaacgtaccgtaacgggttacgggtaacgggtacccggtaacgggtaccggtaacggtaaaccggtaaccgggtaacgggaaccgttacggtaaccgtttaacgtttaacgtttaacggttaccgtaaacggtaccgtaacggtaacggtaaccgtaacggtaccggtaaccggttaacgggttacccggtttaacggttaccgggggttacggggtttaccggggtacccgggggggtacccggtaaacggacccgttaccggtaacccgggtacccggttaaccgggttacccgtaacgggtaccccggtaaccgggtaccccgttaccggtcccccccgttaccccgggttcccgtacccg

SEQ ID NO: 26816 - DNA, 947 bp, Homo sapiens
  misc_feature: GYAE6OF01AEUPU.41.45.E01.1.454.CMB.1.raw
  modified_base (562)..(562): a, c, t, g, unknown or other
  misc_feature (562)..(562): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggttgacacacgccacacgtcggtgtcaggtcgtccccagggacacggacggccaggactccgtacctgcttcgtgggaagtatgaagttcgccgaaaggtacgttaagttttacggtttttagttcgggttaacccagtaccgaaggaaaccgtccccgacgacccggtaacccgggtccccttttaggggtcgggtttaggggttagtaacggtttagttaaaaccggtttaaaaggaccgtaagggtaacggacggggtaacccggggttaccccccgtttacgggaaaccggggtttaacccgcccccgttaagggaccggtttaaacgggtaccgtttttaccgtccggggacgggttaacccccgccttaacggggttaccccacggggtaaaccgggtntaacggttaaaccggggtcgtttacccggtaaaccggtttacgaaaccgtacgttacgggtacgtacgggtaccgttaacggcggtaacggaaccgggaaagtaaccgggtacggtacgtacggttaacttacggtttacttacggtaccgtaagtacgtacgggtaaccgtagtaacggttacgtacgggttacgttaccggttaacggttacgggggttcggaacccgggggtaccgggggaaccgtacgggttacccggttaccggggttaacccggttaccgggacggttaaccggtttcccggaaacccggggtacccggtttacccggtaccccgggtccccgggtaaccccgttcccgttcccggtttaccccccggg

SEQ ID NO: 26817 - DNA, 903 bp, Homo sapiens
  misc_feature: GYAE6OF01DBZ1G.41.45.E01.1.454.CMB.1.raw
  modified_base (107)..(107): a, c, t, g, unknown or other
  misc_feature (107)..(107): n is a, c, g, or t
  modified_base (135)..(135): a, c, t, g, unknown or other
  misc_feature (135)..(135): n is a, c, g, or t
tcagtctatactatcacgaccggtgctcgatttagtgagtcagtaagggaaagggggtgggtccaggaggcagaactctgggtgtctcaccatggcctggatccctntacttctccccctctcactctctgcacnggctcgtaggacggccgccttatggacggttcgacacgacgacctacacgttcgggtgtcagttccgtaccccgagggaacacggaccggtaccagggactccgaaccttgccttcgtggacgtatagaattccggaccaggtacttaagtttgtttagttcggaacctagtcgaaggtaaccgccgacggtaccccgaacggtccccgttaggttccggtttagggtacgtagttacggttaaaacggtaaacgtaaccgtaagggttacggaacggttaaccggtccccgttacggacgggttaccgtccccgttaggaccgggtacttacgttccgtcgtccgggtaccgtaccgacggtacttaccgaagggtaacgacggtttaccgtaccgttaacggttaccgaacgttacgtacgggttacgggaacgggttccttacccggaacggtaccggtaaacggtaaacgggtaccggtaaggttacgtaccggtagtttaaacggttttacttaccggtcgttaaacggttaacgaacggtttaacgaccggttaacgcggtttaacggttaccggggttacttttaaccgggtttcgggttccggttaacccgggggggtaacggttaacccggtacgggaccgtttaacccgggaccgggttaaccgtacgtaaccccgggacgggtaccccgtaacgggttaccccgccccgttaaccccgggtttagggtaccctttccgttacccgggtttacccccg

SEQ ID NO: 26818 - DNA, 775 bp, Homo sapiens
  misc_feature: GYAE6OF01C3AX3.41.45.E01.1.454.CMB.1.raw
  modified_base (138)..(138): a, c, t, g, unknown or other
  misc_feature (138)..(138): n is a, c, g, or t
  modified_base (505)..(505): a, c, t, g, unknown or other
  misc_feature (505)..(505): n is a, c, g, or t
tcagtctatactatcacgaccggtgctcgatttagtgagtcagtaagggaaagggggtgggtccaggaggcagaactctgggtgtctcaccgagtggcctggatccctctacttctccccctcctcactctctgcacnggtctcgtggacggccgcctagtgaggtgacacgacgccactacgtcggtgtcagtcgccccgaaggacaggccggaccaaggtactcccaccgtgctcgtaggtagattagtaacgtcgaaccgtaaggtcttaagtttgtttagtcggtaacagtcaaggacgacgaccgacccgaccggtcccttaggtggttaggtacgtagttaacgtaaacgttaaaacgacgtaggttacgacggtaaccggtcccgtagggaacggtacttccccggaggtcgacggttactccgtacggccggtacgaccgtagaccgtcgaaacggtacgtacgtacggtactacggtaactacgagtcgtaacggngggtaaccgtccggacggtacgacggaaacggtcgaaggttactacgtacgtttaagttcgttaggaacaccggtaatacggaacctacggagtcccgtaaggttccgtttacgttcgggtacggttaccggggttacgggaccggggtaacgttaaccggcgttaccggtcccggttacggtaccgggacgtacccggtaccccggtagtcccccgggtccccttaaccccgggttccgtaacccggtacttttccccgggttaccccc

SEQ ID NO: 26819 - DNA, 796 bp, Homo sapiens
  misc_feature: GYAE6OF01EVJWC.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctctcactctctgcacaggctctgaggccgcctatgaggtgacacagccacactcggtgtcagtcgtccccaggacagacggccaggatcacctgctctggagatagaatttcgacccgaaggtactaattttgtttattggtaccagctaagaacgccacgcccgacggtccctgtgttggtgtagttagtaagtaaagacgagtggacggtacggccctacgtagggactcccgtaggacgtacgtactttccgcgtacgccgtccgacgtccacgagtaacgagttacgtacgacgttcgacctataccggtaggttggacgttcccgaggtacgaaggaacgaacggtacggcgttaacgtacttaaggttaacgtttagtaaacgaacgtacgtaacggttacgaacgtaggtacgttagggttacccgggtttacggttttaaccgggttaccggggggtttaggggttacccgggggggaaccggggggttaacccggtaaccggttaacccgggttaccggggttacccccggtttaacccgggttaacccggggttacgaaaccccgggtaccccccggtaaaacgggttcccccggtaaccccgggttcccccccggttaacggggtttaccccccgtcccgttttccccgggtttaccccccccggg

SEQ ID NO: 26820 - DNA, 925 bp, Homo sapiens
  misc_feature: GYAE6OF01A56VY.41.45.E01.1.454.CMB.1.raw
  modified_base (107)..(107): a, c, t, g, unknown or other
  misc_feature (107)..(107): n is a, c, g, or t
  modified_base (115)..(115): a, c, t, g, unknown or other
  misc_feature (115)..(115): n is a, c, g, or t
tcagtctatactatcacgaccggtgctcgatttagtgagtcagtaagggaaagggggtgggtccaggaggcagaactctgggtgtctcaccatggcctggatccctntacttccnccccctctcactctctgacacaggctctgacggcccgccgtatggaggtcaccacgacgcccaacgtacgttcggtagtaccaggttacccgaccccgaagggaaccgacgggacccgggaccaaagggtcttacccgaacccgttggtcccttacgggttaagggaatagtagttaaaacgttcggaacccgtaaggttaacttttaagttttttcggtttaacggtttccggaaaccgtaacggtacggtaaaccggtaaccggacccgaacccggaccccggtaccgggttacccggtttgggtttacgggttacggtacggttaagttaaggtaaacgttaaaacgaccgtagggtaacggtaacggtacccggtacccggtaacgggtaaccgggttaccccgttacggtacggtaccggttacgttaccgttcccggttaccggaccggtacccgtacgtaccggtaccgtaacggaaacggttaaccgtaacggtaccgttaccgtaaccggttaccgtaaccgtacggtaacggtaacggtaccggtaccggtacggaaccgggtaacggaaacggaacgggtacgtaacggtacgtaagttaacgtttaacgttacgtaagtaacgaacgttacggtaacgacgtacgtacggtacgttacggttcggttacggtagggttaccgggtacggggtaccgggtacggtacgtacgtccggtacggtccggtacggtacgaccggtacggaccgtccggttacccggtcccgttacccggtacgttcctccgttcccgtcccg

SEQ ID NO: 26821 - DNA, 789 bp, Homo sapiens
  misc_feature: GYAE6OF01D5GT5.41.45.E01.1.454.CMB.1.raw
  modified_base (163)..(163): a, c, t, g, unknown or other
  misc_feature (163)..(163): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (767)..(767): a, c, t, g, unknown or other
  misc_feature (767)..(767): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctggaggcccgcctatggaggtnacacgagccacactcggtgtacagtcgtccccgaggacaggacgacctaggatcacctgactcgngganatgaattcgacccgtaagggacttaagttttagtttaagttcggtaaccgaggacaaggtaaacgaccaacggccccaacgggtcccgtggttacggttggtagtagttacggtaaataaaacgtacggtaaggttacggaaggaccgggtaccccttaggaacggggtaaccttcccgtaaggacggtactacgttttaccggcgtacgggtacccgaaccgtagtacccgttacgaaaggggtaaaccctaagggttacgtacctaaccggtttaccggaaccctaaggtccgtaaggtcggggtaacgtaccggaacgggaccgtaaaggaaacggtacgggaacggtacgttactaacgttaatttacgttaggtaccgtaaggactaagggtaacgaacgaacggtataccggtacgttacggtttaacggttcgggtacgggttaccggggaaccgggggtaacctaggacgtaccggttacccggtccgtaggtacgcggtaccgaacggtcccgtacccgtacccgngtacccgtccgtcgttaccccg

SEQ ID NO: 26822 - DNA, 908 bp, Homo sapiens
  misc_feature: GYAE6OF01AJAYW.41.45.E01.1.454.CMB.1.raw
  modified_base (163)..(163): a, c, t, g, unknown or other
  misc_feature (163)..(163): n is a, c, g, or t
  modified_base (184)..(184): a, c, t, g, unknown or other
  misc_feature (184)..(184): n is a, c, g, or t
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
tcagtctatactatcacgaccggtgctcgatttagtgagtcagtaagggaaaggggggtgggtccaggaggcagaactctggggtgtctcaccatggcctggatccctctacttcctccccctcctcactctctgcacaggctctgacggccgctatgaggtnacacacgccacacgtcggtcnctaggtccgtcccgaggacacggaccggccgaaggactcaccgtgtcctacgtgggagtatagaacgttcgaccgtaaggtacttaagttttcgtttagtcggtaccacgtacgaagaacnccgacgcccgaccggtcccgtggttcgttggtacgtagtaagtaataaacgganaggtaggacggtaccgtcccggtaggacggtccttccgaggtcggtacttacgtccgttaccggtcggaccgccgtacggtacctaaacggaacggaaaccgtttacggtaaccgtccggttaacgggttaccaaccgtagttaaccggtacggggtaccggtacggtacccggaagggtaacggaaacgggaaaacggtccgggtaaggtaccggtttaaccgtaacgtttaggttttaacctacgggtaaccgtaacggtacctaagggtaaccgtaaccggacggtacccggtttaaacggggtttccggtttaaaccccgggtttaggggttacccggggggtttacccgggggtaacgggggggtaaccccggggttaaagacccggtttacccgggggtacccgggttacccggggtaaccgggttacccggtaacccggacccgggttaacccccggttaacccgggtcccggtttaaccccccggccccgggttttaaccccggtcccgtttacccggtttcccccggttttaccccccgg

SEQ ID NO: 26823 - DNA, 729 bp, Homo sapiens
  misc_feature: GYAE6OF01CETID.41.45.E01.1.454.CMB.1.raw
  modified_base (209)..(209): a, c, t, g, unknown or other
  misc_feature (209)..(209): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgacggccgcctatgaggtgacacagccacactcggtgtcagtcgtccccaggacagacggccaggancacctgcctctggagatgaattggaccaaggctaatttgtttattggtacctagacagaacgccaagcccacggccctgtcgtggtgagtagtaataagcagtgagcggcctagacgggactccgtagacgtcgtacttacgtcgtcggccgtacgacgaccgtagaacgggttaaaccaggttaacgtaccttaacggttacggaacctactacggtagggtaggtacgttacccggaggtaccgaaacggaaggtaaccggacgcgtaacgtaacggttacttaagtttaggacgtaaaggcgtaaaggttacgaccgtaggaccgttaacggttccgggttaacgtttcgggtacggggtttccgggtacgggggtaacccggggggttaacaaccgggttcgtaacgggttaccccgggtcgttaacgggtacccggtacggaaccccggttaacgggtcccgttaccccgggtacccccgggttcccgtaacctcccggttcccggttacccccg

SEQ ID NO: 26824 - DNA, 737 bp, Homo sapiens
  misc_feature: GYAE6OF01D8WX2.41.45.E01.1.454.CMB.1.raw
  modified_base (84)..(84): a, c, t, g, unknown or other
  misc_feature (84)..(84): n is a, c, g, or t
  modified_base (107)..(107): a, c, t, g, unknown or other
  misc_feature (107)..(107): n is a, c, g, or t
  modified_base (172)..(172): a, c, t, g, unknown or other
  misc_feature (172)..(172): n is a, c, g, or t
  modified_base (178)..(178): a, c, t, g, unknown or other
  misc_feature (178)..(178): n is a, c, g, or t
  modified_base (462)..(462): a, c, t, g, unknown or other
  misc_feature (462)..(462): n is a, c, g, or t
  modified_base (574)..(574): a, c, t, g, unknown or other
  misc_feature (574)..(574): n is a, c, g, or t
  modified_base (583)..(583): a, c, t, g, unknown or other
  misc_feature (583)..(583): n is a, c, g, or t
tcagtctatactatcacgaccggtgctcgatttagtgagtcagtaagggaaagggggtgggtccaggaggcagaactctgggtntctcaccatggcctggatccctntaccttctccccctctcactctctgcacaggtctacgtggacggccgactagtggagtcgacacncgccanacgttcggtagcgtagtccgtacccgaggacaggaccggccaaggtactccgaccgtgtacctcggtaggtagtactaggtaacgttccgaaccggtaagtatttaaagttttgttaagttccgtaccgagtaccgtaacggaacgtacccaaccggtcccgaccggtcccgttaggtcggttaaggtgtagttagttaaagtaacgacgaggtaggacgggtaccggaccgtaggacggtacctcgtagcgttcgtacgtttaccgtcgcggaccgtcgacgngacgtaaccgtaggtaccgtaacgtaccggtacttaccgaccgtacgtaggtacggtcggacggttacgacggacggtaagacgtacggtatcgtatattagtagtacgtanaccggttanacggtagactaggtacggttacggtcgggtttacgtcgggggtttacgggtacgggtccggggtacggtaccgttacggccggttaaccgtccggttaccggtagcgtccgacccgtgccccgttacccgcgtacgtccgtccgtcgttccccg

SEQ ID NO: 26825 - DNA, 719 bp, Homo sapiens
  misc_feature: GYAE6OF01ARWOU.41.45.E01.1.454.CMB.1.raw
  modified_base (132)..(132): a, c, t, g, unknown or other
  misc_feature (132)..(132): n is a, c, g, or t
  modified_base (142)..(142): a, c, t, g, unknown or other
  misc_feature (142)..(142): n is a, c, g, or t
  modified_base (154)..(154): a, c, t, g, unknown or other
  misc_feature (154)..(154): n is a, c, g, or t
  modified_base (355)..(355): a, c, t, g, unknown or other
  misc_feature (355)..(355): n is a, c, g, or t
  modified_base (425)..(425): a, c, t, g, unknown or other
  misc_feature (425)..(425): n is a, c, g, or t
  modified_base (570)..(570): a, c, t, g, unknown or other
  misc_feature (570)..(570): n is a, c, g, or t
  modified_base (702)..(702): a, c, t, g, unknown or other
  misc_feature (702)..(702): n is a, c, g, or t
tcagtctatactatcacgaccggtgctcgatttagtgagtcagtaagggaaagggggtgggtccaggaggcagaactctgggtgtctcaccatggcctggatccctctacttcctccccctctccactctcngcacagctcngaggccgcctangtaggtgaccacagcccaacacgtcggttgcacggtcgtccccgagggaccaaggtacccgggccaagggtactccgaacctggccttaccgtggggatagtgtaaagttccgaccgaaaggtccttaaagttttttggtttaactttggaacccaggtcaacgtaagcccaacgcccgtaccggccctgtgttggtgtangttaataaagacagtagacgacggcctacggaggtacgtaccgtgaacgtctcgttcgtacgtcggaccncgacgccgtacaacgggtaactggtaacggtcgtaaacgtttcgaaccttacggacgttaacggcgtacggtaccgagtaacgaggaacgacgtaagccgtagtacgtaattatcgtaaccgagtacgtaagacgttacaaccgngtaacggtccgttacgttacggtcggttacgggtacggaccggggtaaccgaacgtcgttaccggtacgtaacccgggtagttccggacccgtttaccggaaccggttccgtaccgtacccgtaccggtacncccggttacgttacccc

SEQ ID NO: 26826 - DNA, 909 bp, Homo sapiens
  misc_feature: GYAE6OF01BZMP1.41.45.E01.1.454.CMB.1.raw
  modified_base (106)..(106): a, c, t, g, unknown or other
  misc_feature (106)..(106): n is a, c, g, or t
tcagtctatactatcacgaccggtgctcgatttagtgagtcagtaagggaaagggggtgggtccaggaggcagaactctgggtgtctcacatggcctggatccctntacttctccccctctctactctctgcacaggctctggacggccgtcctagtggaggtgacacaggcctacacgtcggtgtctaggttcgtccccgaaggacgacggtaccgggccctaagggtacttccgaaccgttgccgttcgtacgggaagtagtagtaaacgttcggaaccgaaagggtcctttaagtttttacggttttaacgttacgggaaccccttagggaccgtaaacggaaccgacccgtaccggaccccgtaccggtcccgttggtttacgggttcggtacgtaagttacggtaaagttaaaggaaccgtagggtcggaacggttaccggtcccgtacgggaccggtacctttacccggtggaaccggtctttaacggtttcccgtacgggttccggaaccggttcgacccggtacgttacgaaacgggtaagttaacggtactacggttaacctacggacctaggttacgtagggtacgaccggttacgagggaccgtaaagggaacgtaaccgtcggtaacgaacggttttattaacgggtttattacggtaaacgtacggtaacccggtaagtaaccggaacgtcgttaacgggtaccgtttaccgttaccgggtttaggggtaccgggttcgggggttacccggggaacggggtaaccgtacggtccggttaaacccggttcccgggtaacccgtttgggaaccccgtccccggtaaagggttacccggcccgtttacccccgggacccggtttaccgaccgtttaacccggttccccgttcccccggg

SEQ ID NO: 26827 - DNA, 503 bp, Homo sapiens
  misc_feature: GYAE6OF02I35AS.41.45.E01.1.454.CMB.1.raw
  modified_base (331)..(331): a, c, t, g, unknown or other
  misc_feature (331)..(331): n is a, c, g, or t
  modified_base (446)..(446): a, c, t, g, unknown or other
  misc_feature (446)..(446): n is a, c, g, or t
tcagtctatactatcacgaccggtgctcgatttagtgagtcagtaagggaaagggggtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagccccaggcccctgtgttggtgatgtataaagacagtgagaggccctcagggatccctgagcgattcnctggcgccagctcaggaacagtagtcacgttgaccatcagtgagtcaggcagaagacgagctagactattattgtacaagcagtagacagcagtgtacttagtcgggtgtcgggnggggaccaagctgaccgtctaggtcagccaaggcctcgcccctcggtcactcgtccg

SEQ ID NO: 26828 - DNA, 507 bp, Homo sapiens
  misc_feature: GYAE6OF02GQSO8.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggccccctgtgttggtgatgtataaagacagtgagaggccctcagggatccctgagcgattctctggcgccagctcaggaacagtagtcacgttgaccatcagtggagtcaggcagaagacgagctgactattagttgtcaagcagtagacagcagtgtcttagtcgggtgttcggcggggaccgagcgtgaccgtcgtaggtcgagcccaggctcggcccctcggtcacgtctcccg

SEQ ID NO: 26829 - DNA, 505 bp, Homo sapiens
  misc_feature: GYAE6OF02IY8M9.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtaataaagacagtgagacggccctgagggactccctgagcgattctcgtggcgccagctcaggaacagtaagtcacgttgaccatcagtggacgtccgaggcagaagacgaggctgactattatgtcaagcagtagacagcagtgtcttagtcggtgtcggacggggacagctgaccgtctaggtcagccgaaggctcgcccctggtcacgtctccg

SEQ ID NO: 26830 - DNA, 517 bp, Homo sapiens
  misc_feature: GYAE6OF02IIVUD.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagccccaggccccctgtgttggtgatgtataaagacagtgagaggccctcagggatccctgagcgattctctggcgccagctcaggaacagtagtcacgttgaccatcagtggagtccaggcagaagacgaggctgactattattgcaagcagtagacagcagtggtaccttagtcgggtgttcggcggggacaggcgtcgaccgtcctaggtcagacccaaggcctcggccccgtcggtactacctcgtccgg

SEQ ID NO: 26831 - DNA, 502 bp, Homo sapiens
  misc_feature: GYAE6OF02G7AMK.41.45.E01.1.454.CMB.1.raw
  modified_base (311)..(311): a, c, t, g, unknown or other
  misc_feature (311)..(311): n is a, c, g, or t
tcagtctatactatcacgaccggtgctcgatttagtgagtcagtaagggaaagggggtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggccccctgtgttggtgatgtataaagacagtgagaggccctnagggatccctgagcgattctctggcgccagctcaggaacagtagtcacgttgaccatcagtggagtccaggcagaagacgaggctgactattattgtcaagcagtagacagcagtgtcttagtcgggtgttcggcgggggacaggcgtgacgtctaggtcagcccaaggctcgccctcggtcacgtctccg

SEQ ID NO: 26832 - DNA, 499 bp, Homo sapiens
  misc_feature: GYAE6OF02GBMQ2.41.45.E01.1.454.CMB.1.raw
tcagtctatactatcacgaccggtgctcgatttagtgagtcagtaagggaaaggggtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcaggggatccctgagcgattctctggcgccagctcaggaacagtagtcacgttgaccatcagtgagtccaggcagaagacgaggctgactattattgtcaagcagtagacagcagtgtccttagtcgggtgttcggcgggggacagctgaccgtctaggtcagcccaaggctcgcccctggtcacgtctcg

SEQ ID NO: 26833 - DNA, 826 bp, Homo sapiens
  misc_feature: GYAE6OF02JS1ER.41.45.E01.1.454.CMB.1.raw
tcagtctatactatcacgaccggtgctcgatttagtgagtcagtaagggaaagggggtgggtccgaggaggcacgaacctcgtcgggtgtctcaccattggcctggatccctctacttctccccctcctcactctctgcacaggcttcgtgaggccgcctagttcgaggtgacactaaggccacactcggtgtcagtcgtccccaggacaggacggccaggggatcaccgtgctctgggacagtgaattcgccaaggctaagtttgttacttggtaccagtcacgtaagccagtccaggcccctgtgttggtgagtcgtataagacagtaggaggacggcctacgacgggtatcccgtagaaggtccgtaagttcgtacgttggaccgtaccacggcttacgaacggtaaccgtaggtaacgtaccgtaacggtttacggaacccgtaagtacccgtaagggttacgggtaaccggtttaccccggaaacgggttacccgtaaacgggtaaaacggggaacccgggtaaacggggtaacccgtaacgggtaaaacccgttaaggttttaaaccggtttttaacggtaaccccgttaaaaggttaccgtaaacggttaacgggaaccgttaacggaacccgttagggtttaccgggtaaccgttttacggttaccgggggttacgggtttacccggggaccggggggtaaccgtaacgggtacgtttaccggtacccgggtttaccggtagggtacggtaaccggacccggtagggtcccgttacggccccccgttaggggtacccgtacggtcccggttacccggg

SEQ ID NO: 26834 - DNA, 516 bp, Homo sapiens
  misc_feature: GYAE6OF02ILVJM.41.45.E01.1.454.CMB.1.raw
  modified_base (508)..(508): a, c, t, g, unknown or other
  misc_feature (508)..(508): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcgagggatcccgtgagcgattctcgtggcgccagctcgagaacagtagtcacgttgaccatcagtggacgtccgaggcagaagacgaggctgactattagttgtacaagcagtagacagcagtgtacttagtcgggtgtcgggcggggacagcgtagccgtcgtaggtcacggcccgaaggctcggccccgtcggtcncgtctccg

SEQ ID NO: 26835 - DNA, 512 bp, Homo sapiens
  misc_feature: GYAE6OF02F79PQ.41.45.E01.1.454.CMB.1.raw
  modified_base (313)..(313): a, c, t, g, unknown or other
  misc_feature (313)..(313): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagccccaggcccctgtgttggtgatgtataaagacagtgagaggccctnagggatccctgagcgattctctggcgccagctcgaggaacagtagtcacgttgaccatcagtggagtccgaggcagaagacgaggctgactattattgtcaagcagtagacagcagtgtcttagtcgggtgttcggcggggacaggcgtgaccgtcgtaggtcagcccgaaggcgtcgccccgtcggtccactcgtccg

SEQ ID NO: 26836 - DNA, 516 bp, Homo sapiens
  misc_feature: GYAE6OF02GRCMD.41.45.E01.1.454.CMB.1.raw
  modified_base (425)..(425): a, c, t, g, unknown or other
  misc_feature (425)..(425): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagccccaggcccctgtgttggtgatgtataaagacagtgagaggccctcgagggatccctgagcgattctctggcgccagctcaggaacagtagtcacgttgaccatcgagtggagtccaggcgagaaggacgaggctgactattattgtcaagcagtaganagcagtgtcttagtcgggttggttcggcgggggaccaggcgtgaccgtctacggtcacgccgaaggctcggcccctcggtctactctccgg

SEQ ID NO: 26837 - DNA, 553 bp, Homo sapiens
  misc_feature: GYAE6OF02F4T4E.41.45.E01.1.454.CMB.1.raw
  modified_base (422)..(422): a, c, t, g, unknown or other
  misc_feature (422)..(422): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaaggcaattttgtttattggtaccagcagaagccagccccaggcccctgtgttggtgatgtaataaagacagtgagaggccctcagggatccctgagcgattctctggcgccagctcaggacagtagtcacgttgaccatcgagtggagtccgaggcaggaagacgaggctgactagttattgtacaagnagtagaacagacgagtcggtaccttagttcgggttgttcgggcgggggaccaggtccgtacgacccggttacgtaggtcgacggacccgtaaggccgtccggcccccgtcggtacctaccgtcgttcccgg

SEQ ID NO: 26838 - DNA, 512 bp, Homo sapiens
  misc_feature: GYAE6OF02ITOAX.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagccccaggcccctgtgttggtgatgtataaagacagtgagaggccctcagggatcccgtgagcgattctctggcgccagctcaggaacagtagtcacgttgaccatcagtggagtccaggcagaagcgagctgactattattgtacaagcagtagacagacagtgtccttagtcgggttgtcgggcggggacaggcgtcgaccgtcgtaggtcacgccgaggctcggcccctaggtcacgtctccgg

SEQ ID NO: 26839 - DNA, 562 bp, Homo sapiens
  misc_feature: GYAE6OF02GZ4VW.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctcgtggagatgaattgaccaaggctaattttgttattggtaccagcagaagccagcccacggcccctgtgttggtgatgtataaagacagtgagacggccctgagggactcccgtgacgcgtattctcgtcggcgccagctacgaaggaacaggtagtcacgttcgacctatcgagtggacgtccgaggcagaagacgaggctagacttagttactgtacaagcagtagacagcagtcggttacttagtcgggtggttcgggacggggaccaggcgtacggaccggttcgtaacggtcacggacccgaggtccgtccggtccccgttcggtacctaccgtctacccgg

SEQ ID NO: 26840 - DNA, 524 bp, Homo sapiens
  misc_feature: GYAE6OF02JACF8.41.45.E01.1.454.CMB.1.raw
  modified_base (362)..(362): a, c, t, g, unknown or other
  misc_feature (362)..(362): n is a, c, g, or t
  modified_base (421)..(421): a, c, t, g, unknown or other
  misc_feature (421)..(421): n is a, c, g, or t
tcagtctatactatcacgaccggtgctcgatttagtgagtcagtaagggaaagggggtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctggagatgaattgccaaaggctaatttgtttattggtaccagcagaagccagcccaggccccctgtgttggtgatgtataaagacagtgagaggcctcagggatcctgagcgattctctgcgccagctcaggacagtagtcacgttnaccatcagtgagtccaggcagaagcgagctagactattattagtcaagctaggtacganagacagtgttaccttagtcgggttgtcgggcggggaccgaagcgtggaccggtcgtagtcgacgacccgaggtccgtcgaccccgtggtccacgtcttcccgg

SEQ ID NO: 26841 - DNA, 524 bp, Homo sapiens
  misc_feature: GYAE6OF02HQAP3.41.45.E01.1.454.CMB.1.raw
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgtttattggtaccagcagaagccagcccaggccccctgtgttggtgatgtataaagacagtgaggaggccctcaggggatccctgagcgattctctggcgccagctcaggaacagtagtcacgttgaccatcagtggagtccaggcagaagacgaggcngactattattgtacaagnagtagacaganagtgtcttagtcgggtggttcggcgggggtacaggctggaccgtcgtaggtcgagacccgaggtcctcgccccgtggtcctaccgtctacccgg

SEQ ID NO: 26842 - DNA, 507 bp, Homo sapiens
  misc_feature: GYAE6OF02HRID9.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcgagggactcccgtgagcgattctctggcgcagctcaggaacagtagtcacgttgaccatcagtggagtccaggcaagaagacgaggctagacttaattattgacaagcagtagacagacagtgtcttagtcgggtggtcgggcggggacagcgtgaccgtcgtagcagccaggctcgcccgtggcctactctccg

SEQ ID NO: 26843 - DNA, 569 bp, Homo sapiens
  misc_feature: GYAE6OF02H2SXM.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaaggctaattttgttattggtaccagcagaagccagcccaggcccctgtcgttggtgatgtataaagacagtgagaggcctcgagggatccctgagcgattctctggcgccagctcaggaacagtagtcacgttgaccatcgagtggagtccgaggcaggaagacgaggctgagtattattgtacaagcagtagactagactaggttgtaccgtttagtcggggttggttcggggacgggggtaccaaggtcgtacggtacccggttaccggtacggtccgacgtaccccgaaggtccgtccggtacccccgtcgggtcctacccgtcgttccccgg

SEQ ID NO: 26844 - DNA, 571 bp, Homo sapiens
  misc_feature: GYAE6OF02H7KUF.41.45.E01.1.454.CMB.1.raw
  modified_base (287)..(287): a, c, t, g, unknown or other
  misc_feature (287)..(287): n is a, c, g, or t
  modified_base (563)..(563): a, c, t, g, unknown or other
  misc_feature (563)..(563): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgaccaaggcaattttgtttattggtaccagcagaagccagcccaggcccctgtgttggngatgtaataaagacagtgagaggccctcgagggactcccgtgacgcgattctcgtggccgccgagctcgaaggaacaagttacgtccaacggtttcgaacccatacgaggtagggacgtaccgaggacaagaaaggacgaaggcctagtaacttattattagtacaagtcaaggtagtacgagacgagtcggttaccttagttcgggttggttcgggccgggggacacggctacgaccgtccgaaggtcacggcccaggctccgccccgtcggtcnctctcccg

SEQ ID NO: 26845 - DNA, 510 bp, Homo sapiens
  misc_feature: GYAE6OF02HW0HW.41.45.E01.1.454.CMB.1.raw
  modified_base (318)..(318): a, c, t, g, unknown or other
  misc_feature (318)..(318): n is a, c, g, or t
  modified_base (417)..(417): a, c, t, g, unknown or other
  misc_feature (417)..(417): n is a, c, g, or t
  modified_base (462)..(462): a, c, t, g, unknown or other
  misc_feature (462)..(462): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggcccctgtgttggtgatgtataaagacagtgagaggccctgagggntccctgagcgattctctggcgcagctcaggaacagtagtcacgttgaccatcaggtggacgtccgaggcagaagacgaggctgactattattgacaagnagtagacagcagtgtaccttagtcgggtgtcggcggggacagcgngccgtcgtaggtcacgccgaggcgtccgccccgtcggtctctcgtccg

SEQ ID NO: 26846 - DNA, 534 bp, Homo sapiens
  misc_feature: GYAE6OF02JF2A3.41.45.E01.1.454.CMB.1.raw
  modified_base (440)..(440): a, c, t, g, unknown or other
  misc_feature (440)..(440): n is a, c, g, or t
tcagtctatactatcacgaccggtgctcgatttagtgagtcagtaagggaaagggggtgggtccagggaggcagaacttcgtgggtgtcttcaccagtgggcctggatcccgtctacttctcccctctcactctctgcacaggctctgaggccgcctatgaggtgacacagccacactcggtgtcagtgtccccaggacagacggccaggatcacctgctctggagatgaattgaccaaggcaattttgttattggtaccagcagaagccagcccaggcccctgtgttggtgatgtataaagacagtgagaggccctgagggactcccgtgacgtcgaattctcgtggcgccgagcgtcgaaggaacagttaacgtcacgttgacctatcgagtggatccgaggcagagacgagctgactattatgtacagctagtaganagcagtcgtacttagcgggtgtcgggacgggtacagtcgtgaccgtcgtagtcacgccgaacggcgtcgccccgtaggtccacgtcgtacccgg

SEQ ID NO: 26847 - DNA, 725 bp, Homo sapiens
  misc_feature: GYAE6OF02GNDJ7.41.45.E01.1.454.CMB.1.raw
  modified_base (221)..(221): a, c, t, g, unknown or other
  misc_feature (221)..(221): n is a, c, g, or t
tcagtctatactatcacgaccggtgctcgatttagtgagtcagtaagggaagggggtgggtccaggaggcagaactctgggtgtctcaccatcggcctggatccctctacttctcccctctcactctctgcacaggctctgaggccgctatgaggtgacacagtccacactcggtctcagtgtccccaggaccaggacgcaggactcacctgctcgtgganatggaattgaccaaggctaaattttgttaatcggtaccagcagaagccagcccaggcccctgtgttgtgatgtataaagctagtgagacggccctgagggactcccgtgacgcgtattcgtcgtggccgccagtcctacgaaggaacaggttacgtcctaacggttcgaacccagttccgtaaggtacgggacgtaccgaagggacaaggaaacggtaccggaagggtaccttaggtaaccttaagtttaagttacggtttacgtaaaggacgtacggttaacggaaccgtaaggtaccgtaaacgggtttcgggttaacccgttttaacgggttccgggggttaccggtttaccgggggaccggggggtaaccctaagggtaccgttaccgggaacccggttccggttaacggttcccggtaacggtaccccgtaagggtacccctttacccgggtacccccccgtttagggtccccgtttaacgttacccgtttacccccgg

SEQ ID NO: 26848 - DNA, 762 bp, Homo sapiens
  misc_feature: GYAE6OF02IN70Z.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaattttgtttagttcggtaccagcaagaagccagccccaggcccctgtgttggtgatgtataaagactaggtgagacggccctcgaggggactcccgtaggacggccgtaagtttctcggtcggcccgaccgagtccttacgaacgggaactaaggttacggtacgtaacggtttacgacccgtaagtccgtaaggtacgggacgttacccgaaggggctaaacgggaaacggaacggtaggaccgttaggaacttagtttaacgtttgtaacgaaagtcctaaggtaacgtaacgagacgtacgggtcgttacccgtttaaggttccgggggtttacgggttacgggggtacccggggggtaaaccgtaacggtacccggttacggttaacccccgggttcccggttaacggggttacccggaaacccgggttaccccccggtaaaggggtcccgtttaccccggggaccccccccggttttacccggggtaccttaccccggttcccgttttacccccccggg

SEQ ID NO: 26849 - DNA, 621 bp, Homo sapiens
  misc_feature: GYAE6OF02G9DY7.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgccaaggctaatttgtttattggtaccagcagaagccagcccacggcccctgtgttggtgatgtataaagacagtgagacggcctcgaggactccgtgacgcgtattcgtctcggtcgccgagcctacgaaggaactaggtacgtcctacggttacgaacctatacgtagtacggtacgtccgaagggtcaaggaacggacggaggtcgtagtacgttaattacgttgtacgaagtcgtaagtacgtacgagacgtagtcggttacttaggtcgggttaggttccgggacggggtaccacggtcgtaccggtacccggttccgtacggtacgtaccggtaccgaacggtcccgtaccggtcccccgttcggtacctaccgttccgttacccg

SEQ ID NO: 26850 - DNA, 565 bp, Homo sapiens
  misc_feature: GYAE6OF02IBCUJ.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgttatggtaccagcagaagccagcccaggcccctgtgttggtgatgtataaagacagtgagaggccctcgagggactcccgtgagcgattctcgtggccgcagctcaggaacaggtacgtcacggttgaaccatccgagtggacgtccgaggcaaggaagacgaggactgtactattatttgacaagctaagtagacgagcgtagtcggttacttaggttcggggttcggtcgggcgggggaccaggtcgtacggaccggtccgtacggacacggacccgaaggtccgtaccggcccccgttacggcctaccgtcttaccccg

SEQ ID NO: 26851 - DNA, 544 bp, Homo sapiens
  misc_feature: GYAE6OF02GM4M6.41.45.E01.1.454.CMB.1.raw
  modified_base (425)..(425): a, c, t, g, unknown or other
  misc_feature (425)..(425): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcgagggatccctgagcgattctcgtggcgccagctcgagaacagtagtcacgttgaccatcagtgagtccaggcagaagacgaggctgactattattgtacaagcgagtagacngacagtggtccttagttcgggtggttaccgggcgggggaccaacggcgtacggacccggtccgttaggtacgaccggccgtaaggccgtcgcccccgtcggtcctaccgttcgttcccg

SEQ ID NO: 26852 - DNA, 612 bp, Homo sapiens
  misc_feature: GYAE6OF02GBDD3.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaattttgtttattggtaccagcagaagccagcccaggcccctgtgttggtgatgtataaagacagtgagaggccctcgagggatccctgagcgattcgtctcggtcgccgagcctcgaaggaacaggtacgtcgacggttgacccatcgagtggacgtccgaggacagaaagacgaggctagtacttagttatgtacaagcaagtacgacagacgtagtcggttccgtttaaggttccggggttacggttccggggaccggggggtaacccgtaacgggtaccgttaggacccggttaccgtacgggttaccgaccggtacccgacggtaccgtccggtccccccgtacggtccgtaccgttccgttaccccggg

SEQ ID NO: 26853 - DNA, 672 bp, Homo sapiens
  misc_feature: GYAE6OF02FMMZ4.41.45.E01.1.454.CMB.1.raw
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
tcagtctatactatcacgaccggtgctcgatttagtgagtcagtaagggaaagggggtagggtccgaggaggcgagaactctgggtgtctcaccatggcctggatccctctacttctcccctcctcactctctgcacagctctgaggccgcctatgaggtgacacagccacactcggtgtccagtgtcccccaggacagacggccaggatcacctgctctggagatgaatgccaaggcatttgtttatggaccagcagaagccagcccaggccccctgtgttggtgatgtataaagacagtganaggcctacagggatcccgtgagcgattcncgtgcgtccagtcctcgaggaaccaggtaagtccaacggtttggaaccccatacccgagtacggaggtacccgtacgggaccgtacggaaagtaccggaagggtaccgtaggaaccgttaagtttaaacttagtttaccgaaaggtacccgtaaggttaacgaacgtaacggacgtaggttacgggttacccgtttacgtttaccggggtagtttccggggtacggggggtacccggtaaggtccgtaggtacccggttcccggttaacgggtaccgtacggtcccgaaggtacccgtccggtacccccgtcggtacccgtacccgttccgttacccgg

SEQ ID NO: 26854 - DNA, 589 bp, Homo sapiens
  misc_feature: GYAE6OF02H7FBR.41.45.E01.1.454.CMB.1.raw
  modified_base (343)..(343): a, c, t, g, unknown or other
  misc_feature (343)..(343): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgaccaaggctaattttgttattggtaccagcagaagccacgcccacggcccctgtgttggtgatgtaataaagacagtggaggacggccctgagggactcccgtgagcgattcncgtggcgcagctcagaacagtagtctacgtgaccatcgagtggacgtcgaggacaagaagacggaggctacgtacttattaacttgtacaacgctaaggtaacgacgagacgtagttcggttacttacggtcgggttaggtcggggtacggggacgaaggtcgtacggtaccggtcgtacggtaccgaccggtaccgaacggtccgtccggcccccgttacgggtccttacccgtcgttaccccgg

SEQ ID NO: 26855 - DNA, 520 bp, Homo sapiens
  misc_feature: GYAE6OF02G36KC.41.45.E01.1.454.CMB.1.raw
  modified_base (335)..(335): a, c, t, g, unknown or other
  misc_feature (335)..(335): n is a, c, g, or t
tcagtctatactatcacgaccggtgctcgatttagtgagtcagtaagggaaaggggtgggtccaggaggcagaactctgggtgtctcaccatggcctgaatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagccccaggccccctgtgttggtgatgtataaagacagtgagaggccctcagggatcccgtgagcgattcnctggcgccagcctgaggaacagtagtacacgttgaccatcgagtggacgtccgaggcagaagacgaggctgacttattagttgtcaagtcgagtagacagcagtgtcttagtcgggtgttcggcggggacaggctggaccgtcgtaggtcgacgccgacgcgtcgtccctcggtctcgtcttccg

SEQ ID NO: 26856 - DNA, 601 bp, Homo sapiens
  misc_feature: GYAE6OF02G0HGK.41.45.E01.1.454.CMB.1.raw
  modified_base (287)..(287): a, c, t, g, unknown or other
  misc_feature (287)..(287): n is a, c, g, or t
tcagtctatactatcacgaccggtgctcgatttagtgagtcagtaagggaaagggggtgggtccaggaggcagaactctgggtgtctcaccatggcctggatccctctacttctcccctctcactctctgcacaggctctgaggccgcctatgaggtgacacagccacactcggtgtcagtcgtccccaggacaggacggccaggatcacctgctctggagatgaattcgccaaaggctaagttttgttattggtaccagcaagagccagccaggccctgtgttggngatgtataaagcagtgaggaggccctagagggactcccgtgacgcgtattctcgtggccgccgtagctacgaggaactaggtactcgtacgttacgaccgtatacgtaggtggtacgtccgaagggacaaggaagacggaaggcctagtaacttagttagttacgtacgaacgctagtacgacgtagacgtacgtggttaccgtagttcgggtggtcgggacggggtaacacggtacgtcggaccggttcgtacggtaccgacggaccccgtaaggtcccgtccggtccccgtacggtacctaccgtcgttccg

SEQ ID NO: 26857 - DNA, 693 bp, Homo sapiens
  misc_feature: GYAE6OF02HHMW8.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgaccaaggctaatttgttattggtaccagcagaagccagccaggcccctgtgttggtgatgtaataaagacagtgagacggcctcgagggactcccgtgacgcgtattcgtcgtggccgcagctacgaaggaactaggtacgtaccgtaacgttacggacctaatcgtaaggtggacgtaccgaaggacgaaggaaacgaacggaggtctacggtaacttaagttacgttacgtacaaagtacaaggtacgaacaggacgtacggttacggttcccgtttaaggtcggggttcggtttaccgggggaaccggggggtaacctaaccggggtcgttaaccgggtaccccggttaaccggttacgggtacccgtaaacccgggtaccccggtaaacgggtcccggttaccccgggtccccccggttaccgggttacccgtacccggttcccggttttacccccggg

SEQ ID NO: 26858 - DNA, 409 bp, Homo sapiens
  misc_feature: GYAE6OF02F8P8I.41.45.E01.1.454.CMB.1.raw
  modified_base (243)..(243): a, c, t, g, unknown or other
  misc_feature (243)..(243): n is a, c, g, or t
  modified_base (403)..(409): a, c, t, g, unknown or other
  misc_feature (403)..(409): n is a, c, g, or t
tcagtctatactatcacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggancccctggtcaccgtctcctcagcctccaccaagggcccatcggtcttccccctggcgccctgcctccaggacgcacctccgagagcacagcggccctgggctgcctggtcaaggactacttccacgtctactgctgacgcgggctggcaaggcgcatagnnnnnnn

SEQ ID NO: 26859 - DNA, 689 bp, Homo sapiens
  misc_feature: GYAE6OF02IO71H.41.45.E01.1.454.CMB.1.raw
  modified_base (222)..(222): a, c, t, g, unknown or other
  misc_feature (222)..(222): n is a, c, g, or t
  modified_base (353)..(353): a, c, t, g, unknown or other
  misc_feature (353)..(353): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacaggacgccaggatcacctgctctgganatgaattgaccaaggctaatttgttattggtaccagcagaacgccacgcccacggcccctgtggttggtgattagtaataaagactaggtgagacggccctgagggactcccgtagacgcgtacttctcgnggccgccagctacggaacggaactaggtacgtcgtacgttacgacctagtacgaggtacggtacgtaccgaggaccgaaggaacgacggaaggtcgtaacgtacttaattacgtttacgaacaacggtactaaggtaacgacgtaacggtacgttaacgggttcgtttaaccgttagggttaccggggtttaccggggttcgggggacccggggtaaccgtacgggtacgttaccggtacccggttaccggttaacggtacccgacggtaaccccgtaacgggtcccttacccgggtcccccgttacggtaccttacccggttcccgttaccccgg

SEQ ID NO: 26860 - DNA, 502 bp, Homo sapiens
  misc_feature: GYAE6OF02FKQIF.41.45.E01.1.454.CMB.1.raw
  modified_base (393)..(393): a, c, t, g, unknown or other
  misc_feature (393)..(393): n is a, c, g, or t
tcagtctatactatcacgaccggtgctcgatttagtgagtcagtaagggaaaggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtgagtcaggcagaagacgagcngactattatgtcaagcagtagacagcagtggtcttatcgggtgttcggcggggactaggctggaccgtctaggtcgacgcccgaaggctcgcccctggtccactcgtcg

SEQ ID NO: 26861 - DNA, 822 bp, Homo sapiens
  misc_feature: GYAE6OF02H3IEG.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacaggaccggccaggatccacctgctcgtggagatgaattgaccaaaggctaattttgttattggtacagcagaacgccagccaggcccctgtcgtggtgatgtaataaagacagtgagcggccctgaggacttccgagacgcgtattctcgtcggccgaccagctacgaacgggaactaggtacgtccgtaacggtttcgaaacccgtagttaccgtaggttacgggtaacgttcccggtaacgggtacgaagggaaaacggaccggaaacggggtcctaacggttaaaccgtttaagtttaacgttttacggtaaccgtaaaacggtaccgtaaacggttaaccggaaacggtaacggtaccgttaagggttttaccgggtttaacccgtttttaagggtttacccggggggtttacggggttttaacccgggggggacccggggggggttaaacccgtaaacgggttcccgggttaaccggttacccccgggtttaaccggttaaccggggttccggaaacccgggttaacccccgggtaaccgggttccccggttacccgggtaccccccccggttttaccggggtaccctttaacccccgggtttcccttttacccccccgggg

SEQ ID NO: 26862 - DNA, 539 bp, Homo sapiens
  misc_feature: GYAE6OF02HGFTP.41.45.E01.1.454.CMB.1.raw
  modified_base (345)..(345): a, c, t, g, unknown or other
  misc_feature (345)..(345): n is a, c, g, or t
  modified_base (435)..(435): a, c, t, g, unknown or other
  misc_feature (435)..(435): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgttattggtaccagcagaagccagcccaggcccctgtgttggtgatgtaataaagactagtgagaggccctcgagggactcccgtgagcgattctctggcgcngctcgaggaacagtagtcacgttcgaccatcgagtggacgtccgaggcgaagaagacgaggctagactattagttgacaagcagtagacngactaggtcgttccttagtcgggttgttcgggcggggtacaggctgtaccgtcgtaggtcacgaccgtaggccgtcgccccgtcggtacctacgtcgttcccgg

SEQ ID NO: 26863 - DNA, 654 bp, Homo sapiens
  misc_feature: GYAE6OF02IJX3W.41.45.E01.1.454.CMB.1.raw
  modified_base (216)..(216): a, c, t, g, unknown or other
  misc_feature (216)..(216): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctntggagatgaattgaccaaggctaatttgtttatcggtaccagcagaagccagccccaggcccctgtgttggtgattagtataaagacagtgagacggccctgagggactcccgtgacgcgtatttctcgtggtccgaccagctcgaaggaacaggtacgtccgtacgtttacgacctactcgaaggtgggacgtaccgagggtacaaggaaggacggaggctacgtaacttaagttagtttacgtacgaagtacaaggtaagacgaacgacgtaggttcggttaccgtttaggtcgggttacgggtaccggggtaccggggggaacaacgggtccgttacgggtacccggttaccgtacgggtaccgaaccggtacccgaacgggtccctaccggtccccccggttaccgggtaccctacccggttccttacccccgg

SEQ ID NO: 26864 - DNA, 638 bp, Homo sapiens
  misc_feature: GYAE6OF02J16P6.41.45.E01.1.454.CMB.1.raw
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (627)..(627): a, c, t, g, unknown or other
  misc_feature (627)..(627): n is a, c, g, or t
tcagtctatactatcacgaccggtgctcgatttagtgagtcagtaagggaaaggggtgggtccgagggaggcgagaactctgggtgtctcaccatggcctggatccctctacttctcccctcctcactctctgcacaggctctgaggccgcctatgaggtgacacagccacactcggtgtcagtgtccccaggacngacgccaggatcacctgctntcgganactgaattgccaggactaatttcggttatggtacctagcagaagcagcccaggcccctgtcgttggtgatgtataaagcagtagagaggccctgacgggctaccgtagacgcgtacttctctcggcgccagccgtcgaaggaacctaggtaacgtctacccggtttagaccgtaacctgtaacggttacgggtagtaccccgtaagggtaccgtacgggaaacgacggtaacgggacgttaacgaccgtaacgttaaagttcgtttaacgaaccggtagtacggtacgtaacgaacggaccgtaaggtcgtaccgttagtacgggttcgttacgggcggggacgtacggcgtacggtaccgtacggtacgtacgcgtaccgtaacggccgtacgccctcggtacnccgttctcccg

SEQ ID NO: 26865 - DNA, 506 bp, Homo sapiens
  misc_feature: GYAE6OF02H9L2J.41.45.E01.1.454.CMB.1.raw
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (389)..(389): a, c, t, g, unknown or other
  misc_feature (389)..(389): n is a, c, g, or t
  modified_base (445)..(445): a, c, t, g, unknown or other
  misc_feature (445)..(445): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgaccaaggcaattttgttattggtaccagcagaagccagcccaggcccctgtgttggtgatgtataaagacagtgagacggcctcgagggactccctgagcgattcnctgcncngctcagacagtatcacgttnaccatcagtgacgtcagcagaagacgngactgactagttattgacagctagtagactagctagtgtacttgtcgggtgtcggnggggacagctgccgtcgtaggtcacgtcccgagtccgtcgccccttggcctactcttcccg

SEQ ID NO: 26866 - DNA, 572 bp, Homo sapiens
  misc_feature: GYAE6OF02FO943.41.45.E01.1.454.CMB.1.raw
tcagtctatactatcacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcacccctggacagccggcctccatcgtcctgcaagtctagtcagacgcctcctgcatagtgatggaaagacatatttgtactggtacctgcagaggtcaggccaggtcctccgcagctcctcatctatgatttcttcaagcgcctctctggtacgtgcctaagataggttcagtggcaggcgggtcgggactaggtatttcaactactagaaactcgaacggtccgggtggacggcgtggaggtacgtggttaggtaattttagttacttgctagtagacaagggtactacgtttctaccggtttccccgggtaacctttcgggaacccgtaacgggtacccgtaaggggtacggaacttacggaacggtacggtaccgtggtaccgg

SEQ ID NO: 26867 - DNA, 655 bp, Homo sapiens
  misc_feature: GYAE6OF02F9RHQ.41.45.E01.1.454.CMB.1.raw
  modified_base (348)..(348): a, c, t, g, unknown or other
  misc_feature (348)..(348): n is a, c, g, or t
  modified_base (384)..(384): a, c, t, g, unknown or other
  misc_feature (384)..(384): n is a, c, g, or t
tcagtctatactatcacgaccggtgctcgatttagtgagtcagtaagggaaagggggtgggtccgaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattcgaccaaggctaattttgttattcggtacagcagaagccagccaggcccctgtgttggtcgatgtataaagacagtgagacggcctcgaggactccgtagagtcgtattcgtctggcnccagctcgaggaacagtacgtacacgttacgacctntacgaggtaggacgtccgaggacaaggaaacgacggagggctacggtaacttagttaacgttcgtaacgaacgtacgaagttaacgaaccgtagtacgtaggttacggttaccggtttaaggttccgggggttaggttccgggggaacgggggtaccgtaagggtcgttacgggtacccggttacggttaacggtaccgaaccggtacccggtaacggtcccgtcccgggttacccccgtcgggttaccctaccgttccgtttacccccgg

SEQ ID NO: 26868 - DNA, 685 bp, Homo sapiens
  misc_feature: GYAE6OF02ISIAX.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctcgtggagatgaattcgaccaaggctaatttgttattgtaccagcaagaacgccagtcccgacggtcccctggtcgttggtgattagtaataaagcagtagagacgcctagagggactccgtgacgtcgtattcgtcgtcggcgacctaggctacgaacggaactaggttacgtcgtaccggttacgaacctacgtacgtacggttacggacgttaccgagggaacaagggaaacgacgggacggtacgtacggtaacgttaagtttagttacgtacgtaacggtaacgtaaggtaacgaacgtacggtacgtaggttcgttaccgtttaacgggttccgggtttaagggtccgggaaccgggggtaacaacgggtcgttaaccgggtaccgtccggttacggtaccgaacggtaccccgtaacgggtccgtacccggtcccgtacggttccgtacccgtcgttaccccg

SEQ ID NO: 26869 - DNA, 673 bp, Homo sapiens
  misc_feature: GYAE6OF02JKTTI.41.45.E01.1.454.CMB.1.raw
  modified_base (221)..(221): a, c, t, g, unknown or other
  misc_feature (221)..(221): n is a, c, g, or t
  modified_base (263)..(263): a, c, t, g, unknown or other
  misc_feature (263)..(263): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctgganatgaattgaccaaggctaatttgttattggtaccagcagaanccagcccaggcccctgtgttggtgatgtataaagacagtgagaggccctagagggactcccgtgagcgattctcgtggcgccagctacgaggaactagtacgtcacgttcgaacctagtcgaggtcggacgtaccgaggtacgaacggaacggtacggaacggtcctacggtaaccgttaagtttagttacggtacaaacggtacaaggttagaaccgaggtaccgtaacggttcggttaccgtttaaggtcggggtttacggtttacggggaccgggggtaaccaacgggttcgtaaccgggtacccggttaccggttacgggtaccgtaaccgggaccccgtaaacgggtcccgttacccggtccccccggttagggtttaccctaccggtttacccgttaccccggg

SEQ ID NO: 26870 - DNA, 759 bp, Homo sapiens
  misc_feature: GYAE6OF02I72WE.41.45.E01.1.454.CMB.1.raw
  modified_base (222)..(222): a, c, t, g, unknown or other
  misc_feature (222)..(222): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctgganatgaattgaccaaggctaatttgtttattaggtaccagtcaagaagccacgccccacggccccttgtgttggtcgattgtagtaaaacgcgaggtgaggacggcctcgagggacttcccgtaggacgtacggtattcgtacgtggaccgccgtagcctacgaacggtaaacgtaggttaacgttcccgaacggttttacggaaccactttaccggtaaggttcggggtaaccgtaccggtaagggaacccgaaagggtaacggaacgggaccggtaacgttagggtaaccttaaggttttacgtttagtaaccgtaacggtaccgtaaggttaacgacggtaacggtacgtaaggttacgggtttaccgttttacggttacgggggttttacggggttaccgggggaaccggggggttaacctaacgggtcgttaccggttaaccccgggttcggtacgggttaaaccgcccgtaacccggaacgggttccttaccggtccccccgtagggttaccctacgtcccgtttaaccccgg

SEQ ID NO: 26871 - DNA, 679 bp, Homo sapiens
  misc_feature: GYAE6OF02HISO2.41.45.E01.1.454.CMB.1.raw
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (393)..(393): a, c, t, g, unknown or other
  misc_feature (393)..(393): n is a, c, g, or t
  modified_base (461)..(461): a, c, t, g, unknown or other
  misc_feature (461)..(461): n is a, c, g, or t
  modified_base (535)..(535): a, c, t, g, unknown or other
  misc_feature (535)..(535): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccgagcacnctgctgngangtatatcgacgagacttagtttagttagtacgtacagacaagacacgaccgccgaccgtcccgttgttaggttggtatagttagtaaaagtaaacgtacgtaaggtgaacggtccggtccctaggacggtaccgttcccgaggacggacgttacttccgcggtacgccgacgngtccgaaggaacgagtacggtactacgtacgtacgacgtacgtacgtacggtcgacgtacggaggtanaacggaagacggtacggtgtacgtattaacgtttcgtacgaacggtacgtagtaacgtacgtacgacggttacnggttaccgttacgttagggttcgggtttacggacggggcggaacgtacgcgtaccggttaccgtccggtagtacccgtaccggaaccggtaccggtcccgtccccgttcccgggtaccgtcccgtacgtttcccgttacccccg

SEQ ID NO: 26872 - DNA, 580 bp, Homo sapiens
  misc_feature: GYAE6OF02ICKKT.41.45.E01.1.454.CMB.1.raw
  modified_base (289)..(289): a, c, t, g, unknown or other
  misc_feature (289)..(289): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgaccaaggctaatttgtttattggtaccagcagaagccacgcccacggcccctgtgttggngatgtaataaagacagtgagaggccctgagggatcccgtgacgcgattctcgtggccgtccaggcctacgaggaacaggtacgtcacgttcgacctatcgaggtggacgtccgaggcaagaagacggaggctgtactagttattgtacaagctaagacgacgagacgtagtggttaccttagtcgggttcggttcgggacgggggtaccaaggccgtacggtaccgtccgtacggtccgacggacccgaaggtcctccggcccccgttcggtacctaccgtccttacccgg

SEQ ID NO: 26873 - DNA, 784 bp, Homo sapiens
  misc_feature: GYAE6OF02H57HK.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatagaattgaccaaggctaagttttgtttacgttggtaaccagaccagaagccaacgcccgacggtccccttggtcgttggtgattgtaataaagactagtagaggtacggcccctagaagggtactcccgtaggacgcgtacttctcgtggccgacctacgcgttacgaaggtaacgaggtacgtcctaagttcggaacctacgcaacgggtggtaacgtcccgaagggacaaaggaacggaacggtacggacgtacgggtaactttaagttaaacggtttggtaacgtaaacggtacgtaaacggttaaacggaaacctaaacgggtaccggttaaggttaccggggttttacccgtttaaggggtttccggggtttacgggggttacccggggaaccgggggggtaacgtaaccgggtcccgggtttaacgggtaaccccgggttccggttaaaccgggttcccggaaacccgggttaccccggtaaacggggttcccttaaccccgggtcccccggtttaacccgggttacccgtccggttccccgtttaacccccggg

SEQ ID NO: 26874 - DNA, 933 bp, Homo sapiens
  misc_feature: GYAE6OF02J3B9N.41.45.E01.1.454.CMB.1.raw
  modified_base (618)..(618): a, c, t, g, unknown or other
  misc_feature (618)..(618): n is a, c, g, or t
tcagtctatactatcacgaccggtgctcgatttagtgagtcagtaagggaaagggggtgggtccaggaggcagaactctgggtgtctcaccatggcctggactccctctacttcctccccctcctcactctctgcacaggctctggacggccgcctatggacggtgacacacgcccacgtaccgtcggtcgtctacggtcgtaccccgaggaccgacggaccggccacggtactacctaccgtcggtctcgtggaagtatacggtaacttcggaccgaaggttacttaacgttttagtttagttaccggtaaccacggacaacggacgacccgacgtaccccgccggtcccgttagttcgggttcgtacggtaacgttaacggttaaagtaaacggtacgtaacggttagggaaccgggtaccggttaccccgtaacgggtaacccggtaccgggtttacccggacggttaccggttacccgtttaacgttccggttcggtaccggttacccggacccgtacggtaccggtaacggtaaacgggttacctacggtttaaccgtaccgtttaccggtaccggaccctacggtacgtacggggtacgtaccgggaacggnggtaaaccggtaacggacgggtaccggttacggtaccgttagttaaacttggttaaaccgtttgaaaccggtaagtacgtaaggacgtaacggtacggttaccggtagggttttaccgggttaccggtttacggggtttacccgggggtacgggttacccggggggacggtaacccgtaccgggtttacccggtacccgggttaaccggtccgggttacccgaaccggtacccggttaaccccgaccggttcccccggttcccggtccccggttaacccggtccgttttaccccgggttcccggtttccccccgg

SEQ ID NO: 26875 - DNA, 625 bp, Homo sapiens
  misc_feature: GYAE6OF02JZ4YY.41.45.E01.1.454.CMB.1.raw
  modified_base (327)..(327): a, c, t, g, unknown or other
  misc_feature (327)..(327): n is a, c, g, or t
  modified_base (358)..(358): a, c, t, g, unknown or other
  misc_feature (358)..(358): n is a, c, g, or t
  modified_base (509)..(509): a, c, t, g, unknown or other
  misc_feature (509)..(509): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacaggacggccaggatcacctgctcgtggagatgaattcgaccaaggctaatttgttagttcggtaccagcagaagccagcccaggccctgtgtggtgatgtaataagacagtgagacggcctgagggactcccngacgcgattctgtgccacacgtcagagaacngtacgtctacgttacgacctagtcgagtacggactacccgaagggacaaacgggtaaaggaaccggtagggtaccctaagaacttagttacgttagtacgaagcgtaagtacgacgagtacggagtaccggttccttaagttacgggggtnttaccgggggccgggttaacgacgtcggtacgaccccgggtcggtcggtaccgacggtacccgtaagggtccctccggaccccccggttggtacccgtaccgttccgttaccccgg

SEQ ID NO: 26876 - DNA, 919 bp, Homo sapiens
  misc_feature: GYAE6OF02FK8PV.41.45.E01.1.454.CMB.1.raw
  modified_base (112)..(112): a, c, t, g, unknown or other
  misc_feature (112)..(112): n is a, c, g, or t
tcagtctatactatcacgaccggtgctcgatttagtgagtcagtaagggaaagggggtgggtccaggaggcagaactctgggtgtcttcaccatgggacctggatacccctntacttctcccctctcactctctgcacaggctctgaggccgcctatggaggtgacacgagccacacgttcggtgtcgacgtcgtccccaggtacagaccggccgaaggactccaccttgctcgtagggacgactaggtaattcggaccgtaaagggtaccttaaagtttttcggttttaacgtttacgggttaaccctaaggtccaaacggtaaaccggcccgtaacggaccccgtaaacgggtccccccgtttgggttccgggttttaggggtacgtaacggttacggttaaacgttaaaaacggtacgtaagggtttacggaacgggtaaccgggtacccccgttaacgggaaacggggggtacccttaccccgttagggaacggttaccggtaaacttttcccggtaacggttcgggacccgtaccgtacgggtccttaacgggaacgggaaccgtaaggttacggttaccgtacggttacgaaacctagtacgtaggttcggaacgtaccgaaggcgtaaacggaacggacggtacgggtcgtaacggtactttaagtttaacgtttcgtaacgtaacggacgtaaacgtttacgaacgtaggtacgtacgggttcgtttacgttagggttacggggttcgggttaccggggaaccgggggtaactaacggggttaccgttaccgggtaccccgggttaacgggttaccgggtacgtacccgggtaacccggtaaacgggttcccggttacccggtacccccgggttaccggtaccgttacccggttacccggtttacccccgg

SEQ ID NO: 26877 - DNA, 735 bp, Homo sapiens
  misc_feature: GYAE6OF02JO9VB.41.45.E01.1.454.CMB.1.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggcccgctatgaggtgacacagccacactcggtgtcagtcgtccccaggacaggaccgccaggactcacctgcttacgnggagtntagtattcggaccgaggtacttagttttgttattacggacgagtacgagaacgccacgcccgaccggtccctggtcggttcggtagatagtaagaacgacgagtaggaggtaccgccctaggacggtacgtcccgtggacggtacgtacttcgtcgtcggccgtaccgtcgtaccgtcgaaacggacgtaacgtacggtaccgtacgtacgtacctaacgtcgaagggtacggtacgtaccgtacgggtaacgaaggaacggtaccgaggttaccgtaaggtaccttaaggttacgtttacgaggtaacgtacctaaggtacgtaacgaggtacgtaacggtttacggttcccgtttaagggttccggggttcgggtaacgggggttaacccgggggaacgtacggtccgggtacggttaccccggtacggttaaccggtaccgacggtaaccccggagttcccgtacccggtccccgttagtacccgtccgttccgtaccccggg

SEQ ID NO: 26878 - DNA, 590 bp, Homo sapiens
  misc_feature: GYAE6OF02ISQAJ.41.45.E01.1.454.CMB.1.raw
tcagtctatactatcacgaccggtgctcgatttagtgagtcagtaagggaaagggggtgggtccaggaggcagaactctgggtgtctcaccatggcatggatccctctacttctccccctcctcactctctgcacaggctctgaggccgcctatgaggtgacacacgccacactcggtgtcagtcgtccccaggacagaccggccaggatcacctgctcgtggagatgaattcgaccaaggctaatttgtttattggtaccagcagagccagcccaggccccctgtgttggtgtatgtaataaaggacaggtggacgaggccctcgaagggactcccgtgacgcgtattccgtcgtcggccgaccgcgcttcgaaggaactagtagtctaacgttcgaacctagtcaggtcggacgtccgacggcaaggaagacggaggctggtaattaattagttagtacgaacgcgaaggtacgacagcgagtttcggtacttacggttcgggtggttaccggggacgggacgagtccgtcggtaccgttccgtaggcgtacgcccgaggccgtccgccccggtcgtaccgtcgtccg

SEQ ID NO: 26879 - DNA, 812 bp, Homo sapiens
  misc_feature: GYAE6OF02H2LRR.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttcctccccctcctcactctctgcacaggctctgaggccgcctatgaggtgacacagccacactcggtgtcagtcgtccccaggacagacggccaggatcactgctctggagagtgtaattgaccgaaggtctaaagttttgtttagttacggtaccagcaaggaacgccaagcccacggcccctgtgttggtgatagtaataaagacagtgagacgccctagaagggtactcccgtaggacgtacgtattcgtcgtcggccgtaccgaacggtccgtacgaaacgggtaaacgtaacggttaacggtaccgttaacgggtttaccgaaccgtaaacgttcccggttaagggttacgggtaaccggttaacccggaaacggggaccgaaacgggaaacgggaaaccggaacggggtaccgttaacgggtaaacctttaagtttaaggttttacggaaacgtaaacgttaccgaaaggttaacggaacccgtaaggtaaccggtacggtttaaccgggtttaccgttttaacgggttaccggggttttacgggggtttacggggacccggggggtaacctaaacggggtccgttacggggtaaccccggttaaccggttaaccggttacggaaccggtaccccgaggttacccgtcccggttcccccggttaccgggttacctacccgtccggtttacccccg

SEQ ID NO: 26880 - DNA, 660 bp, Homo sapiens
  misc_feature: GYAE6OF02HJMSZ.41.45.E01.1.454.CMB.1.raw
  modified_base (347)..(347): a, c, t, g, unknown or other
  misc_feature (347)..(347): n is a, c, g, or t
tcagtctatactatcacgaccggtgctcgatttagtgagtcagtaagggaaagggggtgggtccaggaggcagaactctgggtgtctcaccatggcctggatccctctacttctccccctctcactctctgcacaggctctgaggccgcctatgaggtgacacagccacactcggtgtcagtcgtccccaggacagaccggccaggactcaccgtgctcgtggagatgaattcgaccaaggtctaagttttgttattacggtaccagtcgagaacgccacgccacggcccctgtcgttggtgagtgtaataagactagtgaggacggcccgtacgagggtactccgngtacgcgtacgttcgcgttcggaccgcgagcgtacgagtaacgaagtacgtacgtaccgtcgacgtctcgtaggtcggtacgtaccgtacggacaggaacgacggaggtacctagtacttagttacgttcgtacgaacgtactacgtaagaacacgtcgtaaggttcggtacgttaggtccgggttagggttccggggaaccggggtaccgaggtccggtacggtacccggttaccgtacggtaccgaccgtaccggtaaccggtaccgttacccggccccgttacggtcccgttcgtacccggttaccccgg

SEQ ID NO: 26881 - DNA, 554 bp, Homo sapiens
  misc_feature: GYAE6OF02JBVHE.41.45.E01.1.454.CMB.1.raw
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgttattggtaccagcagaagccagccccaggccccctgtgttggtgattgtaataaagacagtgagaggccctcgagggactcccgtgagcgattctctggccgaccagcctacgaggaacagtacgtcacgttacgaccagtcaagtggacgtccgaggccgaagaagacgaggctagacttattatgtanaacgctagagacagacnggtagttccttagtcgggttggttccgggcggggacagcgtacggaccgttcgtacggtcgacgacccgaggccgtcccggccctcggtcctacgtcttcccg

SEQ ID NO: 26882 - DNA, 571 bp, Homo sapiens
  misc_feature: GYAE6OF02FRCPM.41.45.E01.1.454.CMB.1.raw
  modified_base (178)..(178): a, c, t, g, unknown or other
  misc_feature (178)..(178): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtntcagtgtccccaggacagacggccaggatcacctgctctggagatgaattgccaaggctaattttgtttaattggtaccagcagaagccagccccaggccccctgtgttggtgatgtataaagacagtgagaggccctcgagggatccctgagcgattctcgtggcgccagctcgaggaacagtagtcacgttgaccatcagtggagtccaggcagaagacgaggctgacttattattgtacaagctagtacgacagtcgagttcggtacctttagttcggggttgttccgggacgggggtacctaacggcgtacggacccgttccggtaacggtccgacggacccgacgggcctccggtaccccccgtcggtcctacccgttcgttaccccg

SEQ ID NO: 26883 - DNA, 794 bp, Homo sapiens
  misc_feature: GYAE6OF02HNU7W.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgacggccgcctatgaggtgacacacgccacactcggtgtcacgtcgtccccaggacagaccggcaggatcactgctcgtggagatagtagttcgaccgaaggtcttaagttttgtttagttacggtacctagtaccgaagaacgtaccgacgacccgacggccccttggtacggttagggtcgtaacgtacggtaaataaaacggtacgtaaggtaggaggtacggtccccttacgaaggggtacctccgtaggacgtacgtaacttccgttacgacggtccgccggaacgtcgttacggaacggtaaactacgggttaacgttaccgtaaacggttaccgaacccttaagttaaccgtaacgggttaacggtaacccggttaccggaaacgggtacgaaacgggtaaaccggacggtaacgggcgttaacggtaatttaacggttaacgtttacgtaacgtaaacgtacgtaaggttaaaccgacgtaacgtacgtaggttaccgttaccgttacggttcgggttaccgggttaccggggacggggaaccgtaaggaccgttacggtaccgtaacggtacggtaccgaaccgttacccggaacggttcccgtaccggtccccgtacggtacctaccggttccttaccccgg

SEQ ID NO: 26884 - DNA, 576 bp, Homo sapiens
  misc_feature: GYAE6OF02F8ZK2.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctcgtggagatggaattgaccaaggctaattttgtttaattggtaccagcagaagccagcccaggcccctgtgttggtgatgtaataaagacagtggagacggccctgagggctcccgtgacgcgtattctcgtggcgccagctcgagacaggtactcgacgttgactatcaggtggagtccgagcagagacgaggctagacttattagttgtcaagctagtacggacagacgtaggtcgttacgttagtccggggttcgtcggggaccgggggtacacggtccgtacggtacccggtccgtaacggtcaaccggacccgacggtccgcccggtcccccgtcggtacctccgtcgttcccgg

SEQ ID NO: 26885 - DNA, 620 bp, Homo sapiens
  misc_feature: GYAE6OF02GFBTI.41.45.E01.1.454.CMB.1.raw
  modified_base (297)..(297): a, c, t, g, unknown or other
  misc_feature (297)..(297): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgattgaccaaggctaattttgtttatggtaccagcagaagccagccccacggcccctgtgttggtgatgtaanaagacagtgagacggcctcgagggtactcccgtagacgtcgtacttctacgtcggcgacccgagcctacgaggaaactaggttacgtacacggttagacctatcgaaggtggacgtccgaggcaagaacgacgaaggctaggacttaagttgttagtacagacgtagtacggacgacgagtggtacggttccgttaggttcggggttagttccggggaccgggggtaccaggtcgtacggtacccggttcgtacgtccgaaccggtccggaacggtccggttaccggcccccgttacggtccgtacccgttcgttacccccgg

SEQ ID NO: 26886 - DNA, 681 bp, Homo sapiens
  misc_feature: GYAE6OF02IZ25D.41.45.E01.1.454.CMB.1.raw
  modified_base (225)..(225): a, c, t, g, unknown or other
  misc_feature (225)..(225): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtcccccaggacaggaccggccaggatcacctgctcgtgganagtgaattcgaccaaggactaagttttgtttagttggtaacctagcaagaacgccgacgcccacggcccctgtgttcggtgtatgtaataaagacgtaggtgagacggaccctacgagggtactccgtgacgcgtattctcgtacggccgacgacgctacgaagaacgtagtacgtctaacgttcgaacctagtacgtaggtacggacgtaccgaggacgaaggtaacggacgacggtactagtaacgttaattagttacgtacgaacgacgtaagtagacacggtacgtaggtttcgtaccgtttaggtacggggttacgggttcgggacccggggtaacgtacgtcggtaccggtacccggttaccggtacggtaccgtaaccggtaccccgtaacggttcccgtacccggttcccccgttaccggtaccgttaccgttcccggtttcccccgg

SEQ ID NO: 26887 - DNA, 570 bp, Homo sapiens
  misc_feature: GYAE6OF02IA56T.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcactgctctggagatgaattgccaaggctaatttgttatggtaccagcagaagccagcccaggcccctgtgttggtgatgtataaagcagtgagaggccctgagggactcccgtgacgcgattctcgtggccgccagctacgaaggaacaggtacgcacggttcgaccattcgagtggacgtccgaaggcagaaagacgaggctagtacttattattagtacaagcaagtagacgagacgtagtgttctttaggtcgggttcggtcggggacgggggaccaggtcgtacggaccggtcgtacggtcgaacgacccgaagggtcctccggtccccgttacgggtcctacccgtcgttaccccgg

SEQ ID NO: 26888 - DNA, 862 bp, Homo sapiens
  misc_feature: GYAE6OF02IRYQG.41.45.E01.1.454.CMB.1.raw
  modified_base (220)..(220): a, c, t, g, unknown or other
  misc_feature (220)..(220): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtcccaggacagacggccaggatcacctgctctgganatgaattgaccaaggctaatttgttattggtaccagcagaagccagccccaggccccctgtgttggtgatgtataaagacagtgagaggccctcgagggactcccgtggagcgtattcgtcgtggccgccacgctcgaggacgacgtaggtactacgttacgtacacgtacgtagtaggtacggtaccgtacgggacgaggtaaggaacggtacgggacggtacgtaacgttaagttttaaacgttacgtttacgtaaacgtacggtaacgttaacgggtaacgtaacggtaaccgtaacgggttacggggtttaaccgggttttaacggtttaccggggggttttcggggtttacccgggggttaacccggggggggtaacccggggggtttaaaccgggtaccgggttaccggggttaacccccggggttttaaccccggggttttaaaccccgggggttttaacccgggggtaaaccccgggttaaacccccggggtttaaaacccccgggggtaacccccggggtttaccccggggtttacccccccccccggggtttaaccccccgggggtttacccccccgggttttaaaacccccgggttttaccccccgggttttttaaccccccccccggggg

SEQ ID NO: 26889 - DNA, 635 bp, Homo sapiens
  misc_feature: GYAE6OF02H4BBO.41.45.E01.1.454.CMB.1.raw
  modified_base (333)..(333): a, c, t, g, unknown or other
  misc_feature (333)..(333): n is a, c, g, or t
  modified_base (351)..(351): a, c, t, g, unknown or other
  misc_feature (351)..(351): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
tcagtctatactatcacgaccggtgctcgatttagtgagtcagtaagggaaagggggtgggtccaggaggcagaactctgggtgtctcaccactggcctggatccctctacttctcccctcctcactctctgcacaggctctgaggccgcctatgaggtgacacagccacactcggtgtcagtgtccccaggacagaaggccaggatcacctgctctaggagatgaaattcgaccaaggctaattttgtttattggtaccagcagaagccagcccaggcccctgtgttggtgatgtactaaagacagtgagaggcctcgtagggacttcccgngagcgattctctcggccncgagtcctcgaaggaactagtagtcacggtttacgaacccatacaggttagggacgtacccgagggacctagaaacgacgaaggtctaggacttaattattaggttanaacgnaagtaacggaacagacaagtgttaccttaaggttcgggttcgggttcgggaccgggggacaaagggtcttacgggacccgttccggttaacggtcctaacggtaccccggaaacggtcccgttccggaccccccccgtttgggttacccgtacccttcgtttaacccccgg

SEQ ID NO: 26890 - DNA, 590 bp, Homo sapiens
  misc_feature: GYAE6OF02FOZD2.41.45.E01.1.454.CMB.1.raw
  modified_base (576)..(576): a, c, t, g, unknown or other
  misc_feature (576)..(576): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaattttgtttattggtaccagcagaagccagcccacggcccctgtgttggtgatgtataaagacagtgagaggccctgaggactcccgtgagcgattcgtcgtcggcgaccagctacgaacgaacagtacgtctacggttgacctatcgaggtggagtccgaggcgagaacgacggaggctacgacttatttatgtacagtcgaagtacgacgagacgagtacggttactttaggttcggggttaggttccggggacgggggtaaccgaaggtcgtacggtacccggttacgtaggtccgtaccgaccgtaacggtccgtccggcccccgttcgtaccncggtcccttcccgg

SEQ ID NO: 26891 - DNA, 548 bp, Homo sapiens
  misc_feature: GYAE6OF02F8BDS.41.45.E01.1.454.CMB.1.raw
  modified_base (395)..(395): a, c, t, g, unknown or other
  misc_feature (395)..(395): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggccccctgtcgttggtgatgtataaagacagtgagaggccctcagggatccctgagcgattctctggcgccagctcaggaacagtagtcacgttgaccgatcagtgagtccaggcagagacgngctgactattatgtcaagcagtagacgagacagtcggtacctttaggtccgggttggttcgggcggggggtaccgaaggtcctaggacccggttcgtaggttccgacgacccgaaggcccttcggcccccgttcggtccaccgtcgttcccgg

SEQ ID NO: 26892 - DNA, 795 bp, Homo sapiens
  misc_feature: GYAE6OF02HJYTC.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccaacactcggtgtcagtgtccccaggacagacggccaggactcacctgctcgtggagatagaattgaccgaaggcttaagttttgttattggtaccagcagaagccagccgacggtccctgtgttggtgatgtaataagacagtgagcgccgtagaggctccgtggacgtcgtactttccgtcgttcggccgaccgaggtacctacggtaaggaaccgttaggtacgtaccgtaacgttacgaaccctagtaccgtacgggtacgggtacgtaccggaagggacctaaagggaaacggaccggtaagggtaccgttaacgtaaccgtttagtttaaccgtttacggtaacgtaaagtcggtaaacggttaacggaaccgtaacggtacccgttaagggtttaccggggttaccgtttacggggttacccgggggtttacggggttacccgggggggaaccggggggttaacccgtaacggggttcccggtaacggggtttaccccgggttaccgggtttaacccggtacccgggttaacccgggaacccccgggttaacggttccccggtaaccccggttcccccggttaccgggtttaccccgtacccgttccccggtttacccccg

SEQ ID NO: 26893 - DNA, 833 bp, Homo sapiens
  misc_feature: GYAE6OF02JSLGT.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctctcactctctgcacaggctctgaggccgctatgaggtgacacagccacactcggtgtcagtcgtccccaggacagacggccaggatcgacctgctcgtggagatgtaagttcgaccgaaggtctaagtttgttagttaggtaccagtcgagaacgccacgcccgacggtcccctgttcgttggtgatgtaagaagactagtagagacggtccctggaacggtactcccgtggacggtacgtacgttctcggtacggcccgtaccgtagtaccgttacggaaggaaccgtaacggtacgttacccgtaagttccggaacctagtacgtagggttacgaaccggttaccgtagggacctaagggaaacgggaaccggtggtaccgttaacggaaaccgtttagtttacgttacggtaaccggtaacgtaacgtaacgggtaaacgtacggtaacgggtaccgttaacgggttaccggttacccgttttaacggggttccgggggtttaccgggttaccgggggggtaacccggggtaacccgtaagggttccccgggtttaaccggggtaacccgggttaccccggggtttaaagtcccggggttaaaccccggtcccggtaaccgggggttacccccttacccccggggtaccccccggttttacccggggtaaccccgtttaccccggttacccccgtttttaaccccccggg

SEQ ID NO: 26894 - DNA, 532 bp, Homo sapiens
  misc_feature: GYAE6OF02FIYYR.41.45.E01.1.454.CMB.1.raw
  modified_base (444)..(444): a, c, t, g, unknown or other
  misc_feature (444)..(444): n is a, c, g, or t
  modified_base (482)..(482): a, c, t, g, unknown or other
  misc_feature (482)..(482): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaattttgtttattggtaccagcaagaagccagcccacggccccctggtgttggtgatgtaataaagacagtgagaggccctgagggatcccgtgagcgattctcgtggccgccagcctcgaacggaacagtatccgagttgaccatcagtggacgtccgaggcaagaagacgagcgtgacttattatgtacaagctagtagacaganagtgtacttagtcgggtgttcgggacggggacagtcgngaccgtcaggtaccacgccgagcgtcgccccgtcggtcaccgtcttcccg

SEQ ID NO: 26895 - DNA, 731 bp, Homo sapiens
  misc_feature: GYAE6OF02H0BFK.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctcgtggagatgaatgaccaaggctatttgttatgtaccagcagagccagccagccctgtgtgtgatgtaataagacagtagaggacggccctcgacgggtactcccgtaggacgtcgtactttccgtacgtcggtacccgaccgtacgcccgttacgaaacgggaaaccgtaagggttaaccgttaccgttaaccggttacggaaacccgtaacgtttaccgtacgggtttacggggtaaccggttacccggaacgggtaccggaaacgggaaacggaaccgggtaacgggtcgtaaccggtaaactttaagtttaacgtttacgtaacgaaacggtaccgtaaaggtaaccggaactacgggaacgttaacgggttacgtttaccgtttaacgggttcgggttaccgggttaccggggacgggggtaaccaggtccgtacgggttaccgtcggttacggacgaccggaccgtacggtccgtccggaccccgttcggtacctcccgtcgttcccgg

SEQ ID NO: 26896 - DNA, 602 bp, Homo sapiens
  misc_feature: GYAE6OF02GHL4T.41.45.E01.1.454.CMB.1.raw
  modified_base (223)..(223): a, c, t, g, unknown or other
  misc_feature (223)..(223): n is a, c, g, or t
  modified_base (252)..(252): a, c, t, g, unknown or other
  misc_feature (252)..(252): n is a, c, g, or t
  modified_base (281)..(281): a, c, t, g, unknown or other
  misc_feature (281)..(281): n is a, c, g, or t
  modified_base (328)..(328): a, c, t, g, unknown or other
  misc_feature (328)..(328): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggcccgcctatgaggtgacacagccacactcggtgtcagtgtccccaggacagacggccaggatcacctgctctggagntgaatgccaaggctatttgttatgtaccngcagagccagcccaggcccctgtgttggngagtgtaataaagacagtggagacggcctcgagggactccgtgacgngtattcgtcgtggccgtccacggtcctcgaaggtaaccaggtacgttccgacgtttacgacctatcgaggtggtacgtcgaggacaaggaagacggaggcgtacgtacttagttagttactacgaagtacgaagttacgacgtagactaggttccggtacgttacggtgggttcggtcggggaccggggtacaggccgtagtacccggtcgtacggtaccgacggtacccgaggtcctcccggccccgttacggtccctccgtccttaccccgg

SEQ ID NO: 26897 - DNA, 601 bp, Homo sapiens
  misc_feature: GYAE6OF02JCEDX.41.45.E01.1.454.CMB.1.raw
  modified_base (479)..(479): a, c, t, g, unknown or other
  misc_feature (479)..(479): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacacgacggccaggatcacctgctcgtggagatgattgccaaggctaattttgttagttggtaccagcgaagaacgccagccccgacggcccctgtgttggtgattgtaataaagactaggtagaggacggcctcgacgggtctccctgagtctattcctcgtgggccgccgacgccgtcgaacgggaactacggtagtaccgtacgttacgaacctacgtacgaggttacggacgtaccgagggacgaaggaacggacggagcttagacttagttaatgacagtnagtagacaagcgtagtcgttacgttggtcgggttggtcgggcggggactagcgtacggcccgtagtacggcgtaaccggccgtaggcctccggccccgtacggtctaccgtcgttaccccgg

SEQ ID NO: 26898 - DNA, 760 bp, Homo sapiens
  misc_feature: GYAE6OF02IA8QO.41.45.E01.1.454.CMB.1.raw
  modified_base (259)..(259): a, c, t, g, unknown or other
  misc_feature (259)..(259): n is a, c, g, or t
tcagtctatactatcacgaccggtgctcgatttagtgagtcagtaagggaaagggggtgggtccaggaggcagaactctgggtgtctcaccatggcctggatccctctacttctccccctctcactctctgcacaggctctgaggcccgcctatgaggtgacacagccacactcggtgtcagtgtccccaggacaggaccggccaggatccacctgctctggagatgaattcgacaaggctaatttgtttatggtaccngcagacgcacgccacggcccctgtcggttggtgacgttagtaataaaaggactaaggtagaaggacggtccctacggacgggtactccgtggacgacgtattcgtcgtcggccgtcaacggctacgaaacggtacgaacggttcgtactaacggtttcgaaaccgtacgttaaccggtacgggtacggggtaaaccggttcccggaaaggggtaccgaaacgggtaaacggtaccggggaacgggtaccgtaacggttaaccgttaagtttacgtttacggtacgtaaacggtacgtaaggtaacgaccgtaaggaccgttaggtacgtttacggtcgggttaccgggttcgggttacggggaccgggggtaaccgtacgggtcgttaacccgggtaccgggtaccgttacgggtaaccgtcccggtaacccgtaacggtccccggttacccggcccccggtttaaccgggtcccgtttaacccgttcggttacccccggg

SEQ ID NO: 26899 - DNA, 561 bp, Homo sapiens
  misc_feature: GYAE6OF02FZL55.41.45.E01.1.454.CMB.1.raw
  modified_base (221)..(221): a, c, t, g, unknown or other
  misc_feature (221)..(221): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
  modified_base (345)..(345): a, c, t, g, unknown or other
  misc_feature (345)..(345): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcactgctctgganatgaattgccaaggctaatttgttatggtaccagcagaanccagccagcccctgtgtgtgatgtaanaagacagtgagacggcctcgagggtactcccgtagacgcgtattctcgtggcgaccngctacgaggaacagtacgtctacgttgacctatcaggttggtacgtcccgaggacgaaggaaacgacgacggctagaacttattattcgtactaagactagtagacagcgtagtccggttacttagttcgggttgtcgggcggggacacgcgtacggtcccgtcgtacggctacggaccgaaggccgtccgccccgttgcctactccgttccccgg

SEQ ID NO: 26900 - DNA, 673 bp, Homo sapiens
  misc_feature: GYAE6OF02F32JL.41.45.E01.1.454.CMB.1.raw
  modified_base (224)..(224): a, c, t, g, unknown or other
  misc_feature (224)..(224): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (341)..(341): a, c, t, g, unknown or other
  misc_feature (341)..(341): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagaccggccaggactcacctgctctgganatgaattgaccaaggctaattttgtttattcggaccagcagaagccagcccacggcccctgtgttggtnatgtaanaagactagtgagacggcctcgagggactcccgtgacgcgtnttctcgcggccgccacgctacgagaacgagttacgtcgacgttagacctagtaccgagggttacggacgttaccggacggacgaaacggaaacggacgtaagggtccgtaagtaaccgttaagtttacgtagtacgaacgtcgtaaggttaacgaacgtacggtacggtaggtttccggttaccgtttaagggtccggggttacgggttaccggggaccgggggtacgtaccggtcggtaccggtacccggttcccggtaaggttaccgaacccgccggtaacgggtccctcccgggtaccccgttacggtaccgtaccgtccgttaccccg

SEQ ID NO: 26901 - DNA, 652 bp, Homo sapiens
  misc_feature: GYAE6OF02JAVCB.41.45.E01.1.454.CMB.1.raw
  modified_base (614)..(614): a, c, t, g, unknown or other
  misc_feature (614)..(614): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagaccgccgaggactcacctgctcgtggagtatgaattcgaccaaggtcttaagttttgtttagttaggtaccagtacgaagtaacgccacgtaccccgacggtcccccttaggttcggttaggtacgtagttacggtaaataaagaccgtaggtagacggacggtcccgtagacgggtaactcccgtagaacggtcgtacgttcgtcgacggtccgaccgcgtcacgaaggactagtcgtacgtacgttacgacctagcgtacgtaggaccgtcgaggtacaacggagtaccggagtactcgaacttattacgtgtaacgagtacgtagtacaacgtgacgtacggtactcggttacgtggttcggtcgggaacgggacctagtccgtacggtcgttacggtacgtccgagtacccgnggtcctccggtacccctggtacctacgtcctaccccgg

SEQ ID NO: 26902 - DNA, 733 bp, Homo sapiens
  misc_feature: GYAE6OF02JMJRQ.41.45.E01.1.454.CMB.1.raw
  modified_base (184)..(184): a, c, t, g, unknown or other
  misc_feature (184)..(184): n is a, c, g, or t
tcagtctatactatcacgaccggtgctcgatttagtgagtcagtaagggaaagggggtgggtccgaggaggcagaactctgggtgtctcaccatggcctggatcctctactctcccctcctcactctctgcacaggctctgaggccgtcctatgacggtgacacagcccacactcgggtgtccngtgtccccagggacagaccggccaggatcacccgtgctctggagactggaaattcgaccgaaaggctaaaagttttgttaattcggtaaccaggtccaaggacgccaacgccccgtaacggcccccgtgttacggttacggtcgtaacgttaggtaattaaaaacggacgtaaggttaggaacggtaacggtcccctacgtaacgggaaccttcccgttaggacgtcgaagtttccgtacgttcggaccgacccgataccgtactaacggaactaggtaacgtcgtaacgtttcggaaccctagtactacggttacggacgttacccggaggacgaggtaacgacggacggtccgtagacttagttacgttactaacgacgacgtagtaacgcttacggaacgtcgtacggttacgttaaccggttcggttacggtacgggtcgggtaacgaacgtcgtaacgggtccgttaaaccggtcgtaccggtaccgaccggtaacgtccggttaaccgccccgttcggtaccctacggttccgttaccccggg

SEQ ID NO: 26903 - DNA, 676 bp, Homo sapiens
  misc_feature: GYAE6OF02JEAOR.41.45.E01.1.454.CMB.1.raw
  modified_base (300)..(300): a, c, t, g, unknown or other
  misc_feature (300)..(300): n is a, c, g, or t
  modified_base (441)..(441): a, c, t, g, unknown or other
  misc_feature (441)..(441): n is a, c, g, or t
  modified_base (497)..(497): a, c, t, g, unknown or other
  misc_feature (497)..(497): n is a, c, g, or t
tcagtctatactatcacgaccggtgctcgatttagtgagtcagtaagggaaagggggtgggtccgaggaggcagaactctgggtgtctcaccatggcctggatccctctacttctccccctcctcactctctgcacaggctctgaggccgcctatgaggtgacacagccacactcggtgtcagtcgtcccccaggacagacggccaggactcacctgctcgtaggacgatgaattgccaaggcctaagttttgtttaattcggtactagcaagacgcacgaccacggcccctgtgttggngatgtaataaagacgtagtagagaggccctacgaggtacgtcccgtagacgtacgtattcgtacgtcggacgtccgagtccagaacgacgagttactacgtacgtaacgaccacgtagtacggtacgaccgtacgacgganaacggacggtagacgtgtacgtattagttagttcgacgtacgtagtagtacgaacngtagtacggttacggtaccgttcgggttagggtccgggtaccgggggaaccgggtaaccgtaggtaccggtttaccggacccggtttaccgggaacggttaacgtacccggtaacccgggtaagttccccggttcccgtacccccggtcggttaacccgtccgttaccggttccccccg

SEQ ID NO: 26904 - DNA, 834 bp, Homo sapiens
  misc_feature: GYAE6OF02JO04D.41.45.E01.1.454.CMB.1.raw
  modified_base (174)..(174): a, c, t, g, unknown or other
  misc_feature (174)..(174): n is a, c, g, or t
  modified_base (184)..(184): a, c, t, g, unknown or other
  misc_feature (184)..(184): n is a, c, g, or t
  modified_base (461)..(461): a, c, t, g, unknown or other
  misc_feature (461)..(461): n is a, c, g, or t
  modified_base (488)..(488): a, c, t, g, unknown or other
  misc_feature (488)..(488): n is a, c, g, or t
  modified_base (556)..(556): a, c, t, g, unknown or other
  misc_feature (556)..(556): n is a, c, g, or t
  modified_base (568)..(568): a, c, t, g, unknown or other
  misc_feature (568)..(568): n is a, c, g, or t
  modified_base (739)..(739): a, c, t, g, unknown or other
  misc_feature (739)..(739): n is a, c, g, or t
tcagtctatactatcacgaccggtgctcgatttagtgagtcagtaagggaaagggggtaggggtccaggaggcagaactctgggtgtctcacatggcctggatccctctacttctccccctcctcacctctctgcacaggctctgacggccgcctatgaggtgacacagcccanaactcgggtntcagtcgtccccgaggacaggtaccgccaggatccaccttgctcgtgggatatcgtaattcgccgaaaggccttaaagttttgtttacttcgggtaaccaggaccgtaaggaccgaccgaccgccgaccgtcccgtggttcggtagcgtagtacgtaaagtaagacgttaggtagacggtaccgtacccgacgggacggtacctcccgtggtacgtcggttacttccttacggcgtcccgaaccgtgcccgaagtaacggtaaccgaagggtttacnccggtttaacgaccggtaaccttacgnggttaaccggtacggtaaccgtacccgaagggtaaccccgaaagggtaaaccggcgggtaacccggtnttaaacccggtnttttaaaggttacggtttacccgaagttaaccggtacgttaaagggcccaaaagtttcgggtaaaccggtttcgggtttaccgtttaaccgggttacgggtttcgggttaacgggggtccgggaaccggggtaactaccggtccgggtaacccgtccggtaaccgggttanacccggggttaaccaccccgggtaagggttacccccgtaaccccgggtccctttaacccggggctttacccccgttacccggtttcccccccggg

SEQ ID NO: 26905 - DNA, 910 bp, Homo sapiens
  misc_feature: GYAE6OF02FNGDT.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctctcactctctgcacaggctctgaggccgcctatgaggtgacacagccacactcggtgtcagtcgtccccaggacaggacggccaggactccacctgtcgtcgtaggagtactaggtaattcggaccgaaagggtcctaaagttttttcggttttaacgttacgggttaaccccgaacggtaccgtaaaggaaacggtaccccaaacggcccccgtaaccggggtacccccccgtttaggttacgggttttcgggttacggtaaggtttacggttaaaaccgttaaaaacggtaaaccggtaacgggttaacgggaacgggtaacccggggtacccccggttacgggtaaccggggggtacctttaccccgggtaagggtaacgggtaccggttaaatttccccggttccgttacggggcccgtacccgtaaggaccgttaaccggaaggggtaaaccttacggtacggtacgttaccggtaacggtaccgtaacgtcggtaagggtcggtaaccgtaccggaacgggtacgaagggaaacgacggggtacggtaccgttaacggactttaagtttaacgttacggttaaccgaaggtacgtaagtaagtaccgtagtaccgtaggttccggttaacgtttacgggttacggggttcggttaacggggtaccgggggtaacgtaacggtcggtaaccgtaccggttccggttaacggttccgaaccggttacccggacggttacccgtccggttaccccgttaccggttccgtaccgttcccgttaccccg

SEQ ID NO: 26906 - DNA, 649 bp, Homo sapiens
  misc_feature: GYAE6OF02FIP8K.41.45.E01.1.454.CMB.1.raw
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (367)..(367): a, c, t, g, unknown or other
  misc_feature (367)..(367): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacaggacggccaggatccacctgctcgtggagatgaattgaccaaggctaattttgttattcggaccagcaagacgccgagcccacggcccctgttggttggtacgntagtaanaaagacagtagacgcggcctacgagggtactccgtgacgcgtattcgtcgtcggcgccgngtctagacggaacagtacgtcgtacgttacgaccgtatcgacgggtcgacgtcgacggacgaggaacgacgacggtcgtagtacttactttacttcgtaactaacgacgtaaggtaacgactacggacgtacggtacgggtttctttacgggttacggggttcggttaccgggggtacccggggtacgacggttcgaccggtaccggttcgtacggtaccgaccggtaccgtacggtaccgtcccgtaccccggtcggtaccgtaccgttccgttaccccgg

SEQ ID NO: 26907 - DNA, 847 bp, Homo sapiens
  misc_feature: GYAE6OF02FV13U.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctcccctcctcactctctgcactaggctctggacgccgctatgaggtgacacagccacactcggtgtcagtcgtccccaggacacggacgccaggtactccacctgctcgtaggacgatgtaattcggaccaaggtcttaaagttttgtttaattcggtaccagtacaagaacgccgacgcccgtacggccccttggttcgttggtcgagttagtaaagtaaagacgtaaggttagaacggtacggcccctaaggacggggtaccttacccggtggtaaccggtccgttaactttccgtacggtcggacccgcctacggtcctaacggaaggttaaacgagggttaactaccgtaccgttaccggtaaacctaggtacctaacgggtcggtaacccggtaccgagggaccgtaaacggaacgggtaaccggacgggttaccgttcgaaacgttttaggttaacgttttacggaaccgttaaaggacccggtaaggtaaccgggtaacggttcccgtaacgcgggttttaaccgtttccggtttaacgggttccggggtttaacgggtacccgggggttccgggggtaaaccttcggaccgggttccgggttaaccccggtccgggttaaggggttaccccgaaccccggggttaacggtaccgggttaccccgtttacccgggtacccccccggttacgggttaaccccgtacccggttcccggtttacccccgg

SEQ ID NO: 26908 - DNA, 697 bp, Homo sapiens
  misc_feature: GYAE6OF02JFGEB.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctggagatgaagttgaccaaaggcaaattttgtttaattggtaaccagcagaagcctagcccaggcccctgtcgttggtgatgtaataaagacagtagagaacggccctagacgggtactcccgtagacgtccgtaattcgtacgtcgggcctacccgtaggccctacgaacggaactaggtaacgtcgtaacgtttcgaacccgtagttaccgaggtacggacgtacccgaaggacgaacggaaagacgagggtactagtaacgttaagtttaagttagtacgtaagtacgaacgttaacgaacgacggtacgtaaggttacgggttaccgtttaacggttccgggttacgggtttaccggggaccgggggggtaaacccaacgggtcgtaacggtaacggtacggttacccgttaaggggtacctaacggacccgaacggtacccgtcggtaaccccccgtcggttaccaccgtttacccg

SEQ ID NO: 26909 - DNA, 759 bp, Homo sapiens
  misc_feature: GYAE6OF02FLC1N.41.45.E01.1.454.CMB.1.raw
  modified_base (401)..(401): a, c, t, g, unknown or other
  misc_feature (401)..(401): n is a, c, g, or t
tcagtctatactatcacgaccggtgctcgatttagtgagtcagtaagggaaagggggtgggtccaggaggcagaactctgggtgtctcaccatggcctggatccctctacttctccccctctcactctctgcacaggctctgaggccgcctatgaggtgacacagccacacgtcggtgtcagtcgtcccccaggacacggaccggccaggactccgacctcgctcgtaggagtattaggaattcgaccgtaaggctaattttgttattcggaccagtcgagtaacgccgacgcccgacggcccctaggttcgttggtagagttcgtaataacgacgtaggtacgacggacggccctacggacggtacctacccgtggactacgtattccgtccgtaggccnccgagccgtacgacggaactcggtacgtacgtacgtacacgtacgtcgtaggtcgaacgtccgaagacgtaagggaacgaacggtaacggtcgtaacgtacgtttaacgttacgtttacggtacaacggctaacggtacggaaccacggtaccgtagggttaccgtttaccggtttacggttacgggggtttaccgggttaccgggggtcccgggggttaaaccacgggttacccgtacgggttacccggttaacccggtacgggttaacccacccgggttaccctaaacgggtcccccggttaccgttacccccggtaccggtaccccgttaccggttttccccggttaacccccgg

SEQ ID NO: 26910 - DNA, 579 bp, Homo sapiens
  misc_feature: GYAE6OF02GSGE9.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgttattggtaccagcaagagccagcccaggcccctggtcgttggtgatgtaataaagacgagtgagacggtccctgagggactcccgtgacgcgtacttcgtcgtcggccgcgacgtcctacgaaggaactaggtacgtacgtacgttacgaacctagtcgtaggtggacgtccgaagggtcgaaggaaaggacggacgcgtagacgttaatttacgttacgtacaaggtctaaggtaacgacaggctaggttcgttcttaggtcgggttggtcgggacgggacaggtctcgaccgtcgtacgcgacgccgagctccgccccgtggctcgtctcccg

SEQ ID NO: 26911 - DNA, 907 bp, Homo sapiens
  misc_feature: GYAE6OF02I2UMQ.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctggaggccgcctatggaggtgacacagcccacacgtcggtgtcagtcgtccccaggacagacgccaggactcaccgtgctcgtggagatagaattcgacccgaaggcctaagttttgtttaacgttcggtaaccacggtacaaggaacgacccgacggacccccgaacggtcccccccgttaggttggtttacggggtggtaacgtttacggtttaaaacgtaaaaagggacctaagggttcggaacggggtaaccggtcccccggtacggtaacgggggtaaccttcccccggtaggtacgggacccgttaacgtttccgtccgttacggggtacccgacccgtacggtacccgttaccgaaacgggaaaacgtaacggttaacggttacccgtaaccggggtttacgaaccccgtaagttaccgtacggggttacgggtaacccggttacccggaaagggacccgtaaaacgggaaaccggtaacgggtaacgggtaccggttaacggtaacccgtttaaagtttaacgttacggtaacccgtaaaggaccgtaggttaacgacgtaacgacgtacggttacgtttacccgttagggtaccgggtttaggggtacccggggtacgggggaccgtaacggtcggtaccgggtaccccgttaccgggtaaccggttccggtaaccggaccccggtaaacggttcccggtaaccccgggttcccccgtacccggttaccggtaaccccgttcctttaaccccccggg

SEQ ID NO: 26912 - DNA, 640 bp, Homo sapiens
  misc_feature: GYAE6OF02GAOKM.41.45.E01.1.454.CMB.1.raw
  modified_base (107)..(107): a, c, t, g, unknown or other
  misc_feature (107)..(107): n is a, c, g, or t
  modified_base (177)..(177): a, c, t, g, unknown or other
  misc_feature (177)..(177): n is a, c, g, or t
  modified_base (389)..(389): a, c, t, g, unknown or other
  misc_feature (389)..(389): n is a, c, g, or t
tcagtctatactatcacgaccggtgctcgatttagtgagtcagtaagggaaagggggtgggtccaggaggcagaactctgggtgtctcaccatggcctggatccctntacttctccccctctcactctctgcacaggctctgaggccgcctatgaggtgacacagccacactcggtntcagtcgtccccaggacagacggccaggatcacctgctctggagatgaattgccaaggctaattttgttattggaccagctagaagccagcccgagcccctgtcgttggtgatgtaataagctaggtgaggacgtccctgagggtactcccgtgagcgtatctcgtcggcgcgagtctacgacggaactaggtacgtcgacgttcgaacctntaccgtaggtcggtacgtcgagcgtaagacggacgaggtactgtactagtttagtacgtacgaacgtcgtagacgacgaggtacgtagtcggttaccgttaggttcggggttacggttcggggaccgggggttaaccacgggtccgacggtacccggtacggttacggtccgtaaccggtacccgtaagggtcccgttacccgggtacccccggttccggtacccttacccggtcccggtttaacccccgg

SEQ ID NO: 26913 - DNA, 679 bp, Homo sapiens
  misc_feature: GYAE6OF02IUYVW.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctcccctctcactctctgcacaggctctgagccgcctatgaggtgacacagccacactcggtgtcagtcgtccccaggacagacggccaggactcaccgtgctcgtggagtatgaattcggaccaaaggctaaattttgtttaattcggtaccagtcgagaacgccaacgcccgacggcccctgttcggttggtcgaattgtaactaaagacgtagtgaggacgcctagacgggactcccgagacgcgtattccgtcgtcggccgccgacgtccgtacgaacggaacgtacgttaacgtacgtacggttacgaacccgtagtaccgtaggtaggacgttacgacgacggaacggtaaggaacggtacggtacgtacgtacgttaagttacgttacggtacgtaagtaccgtaagtaacggacgtacgacgtacgtacgttacgttacggtcgggttacggttcgggaccggggtaacacggtcgtacggtacgtcgttacggacgtaccgtaccggtacggtaccgtaccggtccccgtacggtacccgtccgttacccgttcccgg

SEQ ID NO: 26914 - DNA, 836 bp, Homo sapiens
  misc_feature: GYAE6OF02ILQQ1.41.45.E01.1.454.CMB.1.raw
  modified_base (107)..(107): a, c, t, g, unknown or other
  misc_feature (107)..(107): n is a, c, g, or t
tcagtctatactatcacgaccggtgctcgatttagtgagtcagtaagggaaagggggtggtccaggaggcagaactctgggtgtctcaccagtggcctggatccctntacttcctccccctctcactctctgcacaggctcgtaggacggcccgctagtggaggtacaccaacgcgtccacgtacgtcggtacgtcaacggtccgtaccccgaaggaccaggaccggtcgaaggacctcaccgtgctcgaggactagagtacgtcgaccgaaggtactttaagttttgtttacttcggaacagacgaacgacgccacggtaccgacggtcccgtggttcggttggtagacgttagtaaacgtaacgaccgttagacggtaacggccggtccgaggtacggtctaccgtagacggtacgttactcgttacgcggaccgtaccgtcgtaccgttaacgaggaaacgttggtaccgttacgtaacgggttaccgaaccttcgtacggtacggtagttaccgacggtaacggacgtaacggaaacggtacgggtaaccgtgttaaccgtaactttaacggtttgtttaaaccgacgggtaaccttaaaggaagttaaacccgggattacggaccggttacggtttaccgggttaccgtttaacgggttcggggtttaccggggttacggggaacccggggttacgtaaccgggacccgtttacgggtaaacccggttttcccgggaacggtacccggtaacccgggttaccccgtaacgggttccccggttacccggtaccccggttaccggtaaccttcccggtttacctacccccggg

SEQ ID NO: 26915 - DNA, 624 bp, Homo sapiens
  misc_feature: GYAE6OF02GAW1K.41.45.E01.1.454.CMB.1.raw
  modified_base (374)..(374): a, c, t, g, unknown or other
  misc_feature (374)..(374): n is a, c, g, or t
  modified_base (483)..(483): a, c, t, g, unknown or other
  misc_feature (483)..(483): n is a, c, g, or t
tcagtctatactatcacgaccggtgctcgatttagtgagtcagtaagggaaagggggtgggtccaggaggcagaactctgggtgtctcaccatggcctggatccctctactctcccctctcactctctgcacagctctgaggccgcctatgaggtgacacagccacactcggtgtcagtcgtaccccaggacagaccggccaggatccacctgctcgtggagatagaattcgaccaaggctaagttttgtttattcggtaaccagcagaacgccacgcccgacggtcccctgtcgttggtgatagtaagtaagactaggtagacgacggtcccgtagagggtactcccgtgacgtcgtacttcgcgttcggccnccgacgtctacgacggtaactagtacgtaccgtacgtcgtaccactcgaggtacggactaccggagtcgaagtaacggacgacgtacgtagacttaagttactacgtanagaccgtagtacgagtacgacgtacgtcgttacgttaggtcgggttcgtacggggtcggggtaactacggcgtacggtacccgtcgtaggtccaacggtaccgtaacgtcccgcgtccccgtcgtcctaccgtgttccccg

SEQ ID NO: 26916 - DNA, 790 bp, Homo sapiens
  misc_feature: GYAE6OF02FP1OM.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacaggaccggccaggatccacctgcctcgtaggagatcgtaattcgaccaaggtctaatttttgtttagttacggtaccagtacagaaacgtccacgccccaacgggtcccccctggttcggttcgggtgtattaggttaataaaaggacgtagtaggaaggtacggtacccctacgtacgggggacctcccgttaggacggtacggttacttaccgttccgtcgggtaccgccggagtcccgtacgaacggtaaacgaaggtacggttaccgacgttacgaaccctactacggacggtagggacgttccgaacgggtacaagggtaacgaccggtacggcgttacggtaacgtttaagtttacgttggttaaccaacggtacgtaaaggtaccgtaagacgacgtacggttacgggtttaccgtttagggttacgggtttcgggtacggggtaccgggggtaaccgtaacgggtacggttaccggtaacccggttccggttaacggttcccggtaaccggtaccccggaacgggttaccgtccccgggttaccccccgttacgggtaccgttacccgttcccgtttaccccccggg

SEQ ID NO: 26917 - DNA, 804 bp, Homo sapiens
  misc_feature: GYAE6OF02FXTGE.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctctcactctctgcacaggctctgaggccgcctatgaggtgacacagccacacgtcggtgtcagtcgtccccgaggaccaggaccggccaggactccacgtgctcgtggagtatagaattcgaccgaaggtcttaagtttgtttaagttcggtaaccgaggtcgaacggaacgcccgtaacgccccgtaacggtcccccgttaggtttggttcgggttagagtttaggttaaagtaaaacggtaccgtaggtaggtaacggtaccggcccgttacggaacggggtaccgtacccgttagggacgtaccgggtaacttttccggttccggttcggtcccggaccgtaacggtcccgttaacggaaacggtaaaccgtaaggttaccgttaccgttaacggttacgaacccgtacgtacgacgggttggaaccgtaccgagggtccgaaggaaggacggtacgggtacttacggtactttaagtttacgttggtacgtaagtcgtaagtaggacagtacgaggttcgtacgtttggttaccggggtcggttcggggacggggtaacctagggtaccgtaccgggtaccgtttaccggcggttaacccaccgggtaacccgtaccgggtcccggtttcccggtacccccggttacggtttaacccgtccgttccccggtttacccccgg

SEQ ID NO: 26918 - DNA, 701 bp, Homo sapiens
  misc_feature: GYAE6OF02FS9DW.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggactcacctgcctctgggagatagaattcgaccaaggctaattttgtttaattcggtaccagtcgagaagccagccccaggcccctggtcgttggtgatgtataaagacagtagagacggccctgagggactccctgagtcgtatctcgtcggcgcgagcctcgaaggaacaggtacgtcgtacgttgacctactcgacggtggtacgtaccgagggactaagggaacgaacggtacgggaccgttacgaacgtttaagtttaacgttaggttacgtaaacgaccgtaaggtaacggtaaccgtaggaacggtacgggtacgggtttcccgtttaaggttccggggttcgggttaccgggggtaaccgggggggttaacccaaggggtccttaccgggacccggtttaccggttacgggtacccgaaccggtacccgtaaacgggcccttacccggtccccccgttacggtcccgttacccttccgttaacccccgg

SEQ ID NO: 26919 - DNA, 576 bp, Homo sapiens
  misc_feature: GYAE6OF02FHMWJ.41.45.E01.1.454.CMB.1.raw
  modified_base (221)..(221): a, c, t, g, unknown or other
  misc_feature (221)..(221): n is a, c, g, or t
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgagtgacacagccacactcggtgtcagtgtccccaggacagacggccaggatcacctgctctggagntgaattcgccaaggtcaagttttgtttaattcgggtacctagcagaagtccagcccaggcccctgtgtgtgatgtataagcngtgagacggccttgacgggctccgtgacgcgtattctcgtcggcnccgagcctcgaaggacngtacgtctacgttcaccatcgagtggagtccgagacgaagacgacggagctaggacttattagtgttacgaagtctagtacgactgacgtagttacgtacctttagtcgggtcttacggggcggggtaccaggtcgacggacccgtttcggacggtccgaacgtaccggtacgtcgtccgtacccccggtgtaccctcgttcccgtcccgg

SEQ ID NO: 26920 - DNA, 952 bp, Homo sapiens
  misc_feature: GYAE6OF02GTOPG.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctcgtggagatagtaatcgaccgaaggtaccttaaagttttgtttaagttcggtaaccagacgaaggaacgaccacggccccaaccggtccccccttggttcggtttacgggtcggtaagttacggtttaaagtaaaacggtaaccgaaggttacggtaacgggtaaccgggtccccgttaccggaaggggtaaccttcccccggtaggaacgcggtactttaccgtccgttcggccgacccgtaacgtccgttaacgaacgggaaccgtaaggtacgtttaccgtaaacggtttacccgaaaccgtacgtttaccgaggggttacggaaccgggtttccccggaagggtaacggaaaccggggttaaaggaaccggacgggtaccgtttacgtaaccgtttaaagttttaacggttacggttaacccgtaagggtaaccccgtaaaggggtaaccgtaaaccgtaaccggggttaaccgtaacggggtttttccgggttaaacccgtttttaaaccggggtttccgggggtttaaccgggggtttaaccccggggggtaccgggggggtaaaaccccgttaggggtaccccgtttacccggggtaacccgggttttcccggttaaccggggtaaccccgtaaccgggtaaccccggtaaaacccggggttccgttaccccgggttcccccccgggttacgttacccggttaacccccttcccggtttaaccccccgg

SEQ ID NO: 26921 - DNA, 698 bp, Homo sapiens
  misc_feature: GYAE6OF02GPSQ9.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctactctccccctcctcactctctgcacaggctctgaggccgcctatgaggtgacacagccacactcggtgtcagtcgtccccaggacagacggccaggatcacctgctcgtggagtatagtaattcgaccgaaggcttaaagtttttcggtttaagttcggtaaccacggacgaacggaacgacccaacggaccccaacggggtcccccttaggttacggttttgggtacgtacgttacggttaaacgtaaaacggacgtagggtacggtaacggacggtccccttaggaacgggtactcccgaggtacgacgtattcgtcgtcggccgacgatccgtacgaaggactagtacgtctacgttcactcgtacgacgtggacgtacgaggtacgaaggaacgtacggacggtacgtagtaacttacgttagtacgtacgtaaacgtagtaacgtagaacgtacgacgtagtacgttcgttacggtcgggtcgggttacgggaccggggtactaaggtccgtacggtaccgtccggtacgtacgtaccgacggtacgtcgtcccgtacccggtacgtcgtacctccgttcccgg

SEQ ID NO: 26922 - DNA, 574 bp, Homo sapiens
  misc_feature: GYAE6OF02FMSYT.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagccccaggcccctgtgttggtgatgtaataaagacagtgagaggcctgagggactccgtgagcgattctcgtggcgccacgctcaggaacagtagtctacgttgacctagcagtggacgtccgaggcgaagaagacgaggctagactagttagtgtacagtacagtagagagacagtcgtacttagtcgggtaggttcgggacgggggtaaccaggtcgtacggtaccggtaccgtacggtaccgtacggacccgtaacggtaccgtcccggtaccccgttccggtacctaccgttccgttaccccgg

SEQ ID NO: 26923 - DNA, 892 bp, Homo sapiens
  misc_feature: GYAE6OF02IGY3N.41.45.E01.1.454.CMB.1.raw
  modified_base (107)..(107): a, c, t, g, unknown or other
  misc_feature (107)..(107): n is a, c, g, or t
  modified_base (206)..(206): a, c, t, g, unknown or other
  misc_feature (206)..(206): n is a, c, g, or t
  modified_base (478)..(478): a, c, t, g, unknown or other
  misc_feature (478)..(478): n is a, c, g, or t
tcagtctatactatcacgaccggtgctcgatttagtgagtcagtaagggaaagggggtgggtccaggaggcagaattctgggtgtctcaccatggcctggatccctntacttcctcccctctcactctctgcacaggctcgtgacggccgacctatggaggtcacacagcccaactacgtcggtgtctagtcgtcccgaggtaccncggaccggccgaggtactccaccgttgccgttcgtagggaacgtattagtaacgttcgaaccgtaaggtacttaacgtttttgttacgtacgggtaaccagtacgtaacggaacgacccgtaccggtaccccggtaccggtccccgttgggttacggttgggtacgtagttacgttaaagtaaacgaccggtaggtaggaccgggtaccggtccctaggtaacgggtacctcggtaggacgttacggtcgttacgcggtcgaccgtaccgtnaccgtcgaaggtactacggtacgtacgtacggttactaccgtacgtaggacggttacgggtacgtaccggacggtaacggaacggaaccgggtaacggtacggtaccgttaacggttaacgtttaacgtttaacggttacggtaaccggttaaacggtaccgggttaacgtaaaccgtacggtaccggtaacgggttacggtttaaccgggttaccggtttaccggggtaccggggttccggggttaccgggggaacccgggggttaacgtacgggtaccgggtaccccggttaaccgggttcgggttaaccgggtaccgggtaaccccgggtacccggttaacccgggttcccgtaccccgggttaccccggttacccggttaccttcccccgggttacccggttccccccgg

SEQ ID NO: 26924 - DNA, 715 bp, Homo sapiens
  misc_feature: GYAE6OF02GLNU9.41.45.E01.1.454.CMB.1.raw
  modified_base (212)..(212): a, c, t, g, unknown or other
  misc_feature (212)..(212): n is a, c, g, or t
  modified_base (639)..(639): a, c, t, g, unknown or other
  misc_feature (639)..(639): n is a, c, g, or t
tcagtctatactatcacgaccggtgctcgatttagtgagtcagtaagggaaagggggggagaggagcccagcactagaagtcggcggtgtttccattcggtgatcagcactgaacacagaggactcaccatggagtttgggctgagcttgggttttcctcgttgccttcttttaagaggtgtccagtgtcaggttcagctggtggacgtcgngggggagcggtggtcccagtcccgtagggggacctcccgtgagtacctctccgtgtagttgccggtccgactctagttcagttcgacttctgcctagtcgctacgtcggggtcccaccgtagggtcctccggagggtaccggaaggggtccgtacgggtagggtcggggtcggacgtcgtttaccagttccgtggttctaggtaacgtaacgggtaaaagttaaacggaacttaacggtaacgtacggtaaacccgtcgggttaaggaaccgggtcccgttatttcccgtcccgtcgtaccgacggtaactactaaccgtaaccgaaacgaaccgtaaccgtgtactacgttaacaaactagtaaacctagttacgagacgtacggaacgtccgtacgtcctacgttatacttacgttgaccgtacnccgtataccgttccgtacggtcgggtaccgaagggtaccgtccgtcggtacccctaccgtccgtacctcgtacccg

SEQ ID NO: 26925 - DNA, 684 bp, Homo sapiens
  misc_feature: GYAE6OF02HPSW3.41.45.E01.1.454.CMB.1.raw
  modified_base (227)..(227): a, c, t, g, unknown or other
  misc_feature (227)..(227): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacacgtcggtgtcgagtcgtcccccaggacgagaccggaccgacggatcacctgctcgnggagatgaattgaccaaggtctaagtttgttagttcggtaccagcagaacgccacgccgacgtcccgtgttacggttggtgagttagtaacgtaaaggctaaggtggacggaacggtccccgtagaacgggtctacccgtaggacgtacgtattccgtacgtcggacctccgagtctacggaacgtaacaggttacgtcgtacgtttacgaccatacgaggttcggacgtacgacggacgacgaaggtacgacggtctacgtaacgttattagtttacgtacgtaagtacgtagtacgaagtacgacggttaggttacgtacggttacgttacggggttcgggttacggaccgggggtacccgtaacggccgtaccgtaccggtaccggtacgccggtaacccgtaccgacgggtccgtcccggcccgttaccgggtacctccggttcgttaccccg

SEQ ID NO: 26926 - DNA, 676 bp, Homo sapiens
  misc_feature: GYAE6OF02GL3AL.41.45.E01.1.454.CMB.1.raw
  modified_base (330)..(330): a, c, t, g, unknown or other
  misc_feature (330)..(330): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgccaaggctaatttgtttagtggtaccagcagaagccagcccaggcccctgtgttggtgatgtataaagactagtagagacggccctacgagggactcccnggacgcgtattctcgtcggcgccgagtcctacgaggaactaggtacgtacgtacggttacgacctagtacgacggtggtacgtcgaacgggcaaggaacgacgtacggctacgacttaagtttacgttagtacctaaggtactaacggtacgaacaacggtacgtacggttcgggtttacctttacgggttccggggtttcgggttaccgggggtaccggggggtaaccacgggtccgttaccggtacccggtaaccggttacggttacccgaaccgggtacccgtaacggtccgtcccggtaccccccgttacggtacccgtacccgtttcccgttacccccggg

SEQ ID NO: 26927 - DNA, 774 bp, Homo sapiens
  misc_feature: GYAE6OF02HJEOF.41.45.E01.1.454.CMB.1.raw
  modified_base (345)..(345): a, c, t, g, unknown or other
  misc_feature (345)..(345): n is a, c, g, or t
tcagtctatactatcacgaccggtgctcgatttagtgagtcagtaagggaaagggggtgggtccaggaggcagaactctgggtgtctcaccgatggcctggactccctctacttctccccctcctcactctctgcacaggctctgagccgctatgaggtgacacagccaacacgtcggtgctagtcgtaccccaggaacacggacggacctaaggactaccgaaccgtgtccgtagtacgggaatacgtaggtaaagttcggaacccgtaaagggtaccttaaaggtttttacgtttacgttaacggtaaccaggtacgaaacggaacgaccgacggtaaccccncggggtacccctggttacgggttgtaacgaacgttagtaaacgtaaacggataagggtactaaggtaaccgcccgttacggaacggtaaccttcccggaaaggcgttacgtaacgtttcgacggtcggaccgccagttcgaccgaaggaacagggtacttacggtaacgttacgaaccgtaacgtcgtaacggttacggaccacgaacggggtccaaaagggttacgacgtaccggtgaaaccggtatttaaaggttcttaacgacggtaaccaaagaacgtttacgaaacgtgggtacctagggttaccgttacggttacggttaaccggggttgttaccgggacgggtacgtcgacggttacgtaccggtatacgggtcaacgtaacggccgtacgccgtacccggttcgctttaccgctttacccg

SEQ ID NO: 26928 - DNA, 805 bp, Homo sapiens
  misc_feature: GYAE6OF02JE6K6.41.45.E01.1.454.CMB.1.raw
  modified_base (163)..(163): a, c, t, g, unknown or other
  misc_feature (163)..(163): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
tcagtctatactatcacgaccggtgctcgatttagtgagtcagtaagggaaagggggtgggtccaggaggcagaactctgggtgtctcaccatggcctggatccctctacttctcccccgtctcactctctgcacagggctctgacggccactatggagggtnaacacacgccacacgtcgggtgtacaggtcgtaccccaggacgacggaccggccgaagggttcaccaccttgccttcggtaggaaggattaacgtacgttcgaaccgaacggttcttaaagtttttggtaactttcggaaccgagtacgaacgacgaccgacgtaccggaaccggtcccgtgttggttacgagattaggtaaacaagacgaggtacgacgtccggcctaaggcgggtctcggtacgaggctttacgtacgttgccgggcncggttaacnccgaacggacgtaaagtaccggttaacaaccgttgggtaacccagtttaacgcgtacggtacgggtagtacccgaggtaacgaaggaacgtaacgggtacgacgtacgtaaccgtttgttaacgtacggtaacgtaacggtgtaaacgaacgtaccggtagtacggtttcgggttaacggtttcgttaaaccggggtttccggggttcggggggtaaccggtaacgggggtttacccaacgggttccggaaaccggttccggttaacgggtacgttaaacccgggtccggtaaaccgggtcccgttcgggttacccccttaccgggtaccccggtttaacctccgggtttcccttaccccggg

SEQ ID NO: 26929 - DNA, 792 bp, Homo sapiens
  misc_feature: GYAE6OF02IMJON.41.45.E01.1.454.CMB.1.raw
  modified_base (162)..(162): a, c, t, g, unknown or other
  misc_feature (162)..(162): n is a, c, g, or t
tcagtctatactatcacgaccggtgctcgatttagtgagtcagtaagggaaagggggtgggtccaggaggcagaactctgggtgtctcaccatggcctggatccctctaccttctccccctctcactctctgcacaggctctgaggcccgcctagtgaggtnacacagccaacacgtcggtcgtcaggttccgtccccgaggaccgacgtaccggccgaggacttccgaccgtcgaccttcgtaggagtaagtgtaaattcggaccaacggttaccttaagttttcgttttaagtcggtaaccgtagtacgaaacggacgtaccgaccggaccccgaacggtcccccgttaggttcggtttacgggtaggtaacgtttaacgtttaaacgaaaacggtaaacggtaaggttacggaaacggtcggacccccgttacggaacggggtacccgtttaccccggtagtaacggttacccggtatttcccgttcgccgggtcccgtacctacgcgttaccgggaacgtaaacgacggttaacgtaccgcgtttaaccgaccgtactacggttagacgggtacgtaccggagaccgaaggtaaccgaggtaacgccgttaaagtacgtttaacgttacgtttacgagtaaccgtcgtaacgtacggaagtacgacgtcgttacgttacccgtaggtttcgggttacgggacgggtacggaacgtaccgtgacgggtccctaggcggtaccgcggaccgtagaccctacggtcccgtaacgtctaccgtcgttccccg

SEQ ID NO: 26930 - DNA, 681 bp, Homo sapiens
  misc_feature: GYAE6OF02I7PQC.41.45.E01.1.454.CMB.1.raw
  modified_base (291)..(291): a, c, t, g, unknown or other
  misc_feature (291)..(291): n is a, c, g, or t
tcagtctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtcgtcccaggacagacggccaggatccacctgctcgtggagagtagaatgacgaaggtctaatttgttatcggtaccagcaagacgctacgccagcccctgtgttggtntagtgtaataacgcgtagtagacggagccctaggacggtactccgtgagacgtattcgtcgtcggccgacagtccgtagaacgtaacgtagttacgtcgacgttaccgactacgttacgaaggtacggtacgaccggtaaggcgtaaaggaacggtccgggaaggtactaacggtactttaagttaacgttagaacgttaaggactagggtaacgacgaacggtactacgggttcgttaccgttgggtaccggggttaggtacccgggggacgggtaaccgtacgggtacgtaccggaccggttacggttaccggaggtacccggaccgggtacggtacccgttacccgggcccccggttacgacccggttaccggtccttacccccggg

SEQ ID NO: 26931 - DNA, 782 bp, Homo sapiens
  misc_feature: GYAE6OF02GXZEL.41.45.E01.1.454.CMB.1.raw
  modified_base (453)..(453): a, c, t, g, unknown or other
  misc_feature (453)..(453): n is a, c, g, or t
tcagtctatactatcacgaccggtgctcgatttagtgagtcagtaagggaaagggggtgggtccaggaggcagaactctgggtgtctcaccgatggcctggatccctctacttctccccctcctcactctctgcacaggctctgacggccgcctatgaggtgacacacgccacacgtggtgtcagtcgtcccgaggacaggaccggtaccaggtactccaccgtgcctcgtagggactatagtaattacgaccgaaaggtacttaaagttttggtttaacgtttacggtaacctaggtaaccaaggtaacgtaccccgaacgacccccggtaccggtaccccgtttaggttacggtttagggtagtaacgttacgtaaaagaacgtaacgtaggtacgaccggtaccggtcctaggaacgtcgtaccgaggtacgtcgtacgttcgttacggnggtacccgtcgtaccggtactaaccggtaggtaaacggtacgtaccggttacggtacgttaaccggaactacgtacgtaaggtcgtaacccgtaggaccggtaacgaacgtaaacggacgaggtaaccttaggtaacgttacttacggtactacgaacggtatacggtaacacgtaagtacgtaccggttgttaccgttaacggcggggttaacccggtgggtaaccggaccgtaagtcccggttaggaccccggttaggtaccggtacgtcccgaaccggttcggaacctcccggtacccggttacctcggtacctccggttacccgg

SEQ ID NO: 26932 - DNA, 871 bp, Homo sapiens
  misc_feature: GYAE6OF02GX8PE.41.45.E01.1.454.CMB.1.raw
  modified_base (162)..(162): a, c, t, g, unknown or other
  misc_feature (162)..(162): n is a, c, g, or t
  modified_base (850)..(850): a, c, t, g, unknown or other
  misc_feature (850)..(850): n is a, c, g, or t
tcagtctatactatcacgaccggtgctcgatttagtgagtcagtaagggaagggggtggtccaggaggcagaactctgggtgtctcaccatggcctggactccctctacttcctccccctctcactcgtctagcacaggctcgtgacggtccgccttatggnggtacgaccactaacggccctactacgtcggtctactacgttccggtaccccaggacaggaccggtacgaaggtactccgaccgttcgccttacggtaggtaaggtattacgtaaagttccgaccgaaagggttcttaaagttttttcggttacgttaccggaaccgacgacgtaacggtaaccgccgtaaccggaccccgtaccggcccccgtttaggttcggttacggtagtaacgttacggtaacgtaaaacgaccgtaggtcggaacggtaccggccgtacggaacgtacctccggtagaccggtacttacgtccgtttggacgtcccgaccgtacgtccgtaacgtaaggtaacctacgggtaacgttacgttacccgttaggaaccctacgggtacgtacggggttcgtaaccggtaccggaacgggaacccggtaaaggaccggttaacgggacggtaaccgttagttaaacggtttcgttaaggttcggttaaccagggtacttaacgggacgaccgttagttcccgttaagggtttaccgtttacgggttaccggtttacgggttacgggttacccgggtaacggggttactccggggttaccgttacgacccggttacggttacttaccgggaccgtaaccggtccgttcccggtacccgtccccgtaaccggtttcncccgggtttaccttacccccg

SEQ ID NO: 26933 - DNA, 788 bp, Homo sapiens
  misc_feature: GYAE6OF02I8650.41.45.E01.1.454.CMB.1.raw
tcagtctatactatcacgaccggtgctcgatttagtgagtcagtaagggaaagggggtgggtccaggaggcagaactctgggtgtctcaccatggcctggatccctctacttctccccctctcactctctgcacaggctctgaggccgacctatgtaggtcgacacacgccacaccgtcggtgtcagtcgtaccccgaggacacggaccgaccgaggactccacgtgccttacgtggagagtaggtaacttcgacccgaaggtacttaagtttttgtttaagttacggtaaccgagtacgaaggaaccgaccgtacgaccccgtaccggtaccccgttggttcggtttcggtagtacgttaggttaaacgtaaacggtacgtacggtaggtacgggaaccggtcccgttaccggagggttacccgtccgtacggtacggtacgttacttcgcgttacggccgaccgtacgcgtacgaacggacaggtacgtacctacgtacgtaccgtacgtagtacggtaggtaccggtaccgacgaacgtaaacggaacggtaacgtacggaaccttacggtaactttagtttaacgtaagtacgtaaacgtacgtaagtaacggaacgtacggaacggttaccggttacgggttcgttacgggttagggtttcggggaccgggtaacggggaccttacgggccgtacggtacccggttacggaaccggttccggaaccggacgaccggtccggaccccgttacccggcgtttacccggccggttccgttccccgg

SEQ ID NO: 26934 - DNA, 300 bp, Homo sapiens
  misc_feature: GYAE6OF01CPQ5P.12.19.B08.1.454.CMB.1.raw
  modified_base (296)..(300): a, c, t, g, unknown or other
  misc_feature (296)..(300): n is a, c, g, or t
tcagatacgacgtacacgaccggtgctcgatttagtgagtcagtaagggccctcaggggtccctgatcgcttctctggctccaagtctggcaacacggcctccctgaccgtctctgggctccaggctgaggatgaggctgattattactgtgcagcatgggatgacagcctgaatggtccggtattcggcggagggaccaagctgaccgtcctaggtcagcccaaggctgcccctcggtcactctcgttccaccctcctctacgtcgtatctgagcgggctggcaaggcgcatagnnnnn

SEQ ID NO: 26935 - DNA, 315 bp, Homo sapiens
  misc_feature: GYAE6OF01D0FXV.12.19.B08.1.454.CMB.1.raw
  modified_base (293)..(315): a, c, t, g, unknown or other
  misc_feature (293)..(315): n is a, c, g, or t
tcagatacgacgtacacgaccggtgctcgatttagtgagtcagtaagggccctcgaggggtccctgatcgcttctctggctccaagtctggcaacacggcctccctgaccgtctctgggctccaggctgaggatgaggctgattattactgcagctcatatgcaggcagcaactgttttgcttcggaactgggacccaggtcaccgtctaggtcagcccaagccaaccccatgtccactctcgttcccgcctcctctacgtcgtatctgacgcgggctggcaaggcgcatagnnnnnnnnnnnnnnnnnnnnnnn

SEQ ID NO: 26936 - DNA, 373 bp, Homo sapiens
  misc_feature: GYAE6OF01BQOWC.12.19.B08.1.454.CMB.1.raw
  modified_base (339)..(339): a, c, t, g, unknown or other
  misc_feature (339)..(339): n is a, c, g, or t
  modified_base (345)..(373): a, c, t, g, unknown or other
  misc_feature (345)..(373): n is a, c, g, or t
tcagatacgacgtacacgaccggtgctcgatttagtgagtcagtaaggggccctcaggggtccctggatcgcttctctggctccaagtctggcaacacggcctccctggacccgtctctgggcctcccgaggctgaggacgaggctgtattattacttgcagctcatatacaagcagcacgcctaccccttctttgtccttcggaagtcgggaacctaaggtccacccggtcctacgtcgacgacccaaggccccaaacccctgtcggtaccacgttccgttacggttcccccgtcccttcctcgtacgtccgtatctgaggcggctggacaaggccgnatacgnnnnnnnnnnnnnnnnnnnnnnnnnnnnn

SEQ ID NO: 26937 - DNA, 300 bp, Homo sapiens
  misc_feature: GYAE6OF01BJUQ5.12.19.B08.1.454.CMB.1.raw
  modified_base (293)..(300): a, c, t, g, unknown or other
  misc_feature (293)..(300): n is a, c, g, or t
tcagatacgacgtacacgaccggtgctcgatttagtgagtcagtaaggggccctcaggggtccctgatcgcttctctggctccaagtctggcaacacggcctccctgaccgtctctgggctccaggctgaggatgaggctgattattactgcagctcatatgcaggcagcaactagttttgtcttcggaactgggacccaggtcaccgtctaggtcagccaaggccaacccatgtcactctcgttcccacctcctctacgtcgtatctgagcgggtctggcaaggcgcatagnnnnnnnn

SEQ ID NO: 26938 - DNA, 303 bp, Homo sapiens
  misc_feature: GYAE6OF01E0KVU.12.19.B08.1.454.CMB.1.raw
  modified_base (295)..(303): a, c, t, g, unknown or other
  misc_feature (295)..(303): n is a, c, g, or t
tcagatacgacgtacacgaccggtgctcgatttagtgagtcagtaaggggccctcaggggtccctgatcgcttctctggctccaagtctggcaacacggcctccctgaccgtctctgggctccaggctgaggatgaggctgattattactgcagctcatatgcaggcagcaacagttttgtcttcggaactgggacccaggtcaccgtcctaggtcagcccaaggccaaccccactgtcactctgttcccgccctcctctacgtcgtatctgagcgggctggcaaggcgcatagnnnnnnnnn

SEQ ID NO: 26939 - DNA, 640 bp, Homo sapiens
  misc_feature: GYAE6OF01AW1XC.12.19.B08.1.454.CMB.1.raw
tcagatacgacgtacacgaccggtgctcgatttagtgagtcagtaaggggcctgaagactttttatgggctggtcgcaccctgtgcaggagtcagtctcagtcaggacacagcatggacatgagggtccccgctcagctcctggggctcctgctactctggctccgagatgtgacatccagatgacccagtctccatcctccctgtctgcatctgtgggagacagagtcaccatcacttggccgggcaagtcagaggattagctagttattaagttggtgtcagcaagaacgccgaagggagacgcccgtaaggtcctagatctatcgtacttcactccgtagtttcgacgtaaaggtcgggtaccctagtacgtaacggttcgaggtcggacgtaggttacggtacgttacgtagggtaactaggttactttaccgacgttcctaccgtaaccgtactcgtaacggtccggttcgtacgaccgtaaccgttagtaaacgtttacgtttacgtacttaacgtttacttacctacgtactaaacgtacgtaacttaaccgtaaccttaccccgtaccgtaccgtacccgtacggaccggacccgtaaacgggaccgaccgggtactagggtaacgtaaacg

SEQ ID NO: 26940 - DNA, 526 bp, Homo sapiens
  misc_feature: GYAE6OF01AK2IC.12.19.B08.1.454.CMB.1.raw
  modified_base (222)..(222): a, c, t, g, unknown or other
  misc_feature (222)..(222): n is a, c, g, or t
  modified_base (484)..(484): a, c, t, g, unknown or other
  misc_feature (484)..(484): n is a, c, g, or t
tcagatacgacgtacacgaccggtgctcgatttagtgagtcagtaaggggcctgaagacttttttatgggctggtcgcaccctgtgcaggagtcagtctcagtcaggacacagcatggacatgagggtccccgctcagctcctggggctcctgctactctggctccgagatgtgacatccagatgacccagtctccatcctccctgtctgcatctgtggganacagagtcaccatcacttgccgggcaagtcagaggattagcagttatttaaattggtgtcagcagaagccagggagagcccctaaggtcctgatctatgcttcatccagtttgcaaaggtcgggtcccatcaaggttcagtggcagtggatcgtagggacagtatttcacttctcacctatccagcggtctgaccaacgtgaagtattttagactaacttacttctgtacaacagtagttaccaacgtaccccttcgtaccnccgtcggccgccgaaacgggaccacggctgggaacgtaaacg

SEQ ID NO: 26941 - DNA, 305 bp, Homo sapiens
  misc_feature: GYAE6OF01CT8NJ.12.19.B08.1.454.CMB.1.raw
  modified_base (296)..(305): a, c, t, g, unknown or other
  misc_feature (296)..(305): n is a, c, g, or t
tcagatacgacgtacacgaccggtgctcgatttagtgagtcagtaagggccctcaggggtccctgatcgcttctctggctccaagtctggcaacacggcctccctgaccgtctctgggctccaggctgaggatgaggctgattattactgcagctcatatgcaggcagcaactagttttgtcttcggaactgggacccaggtcaccgtcctaggtcagcccaaggccaacccactgtcactctcgttcccacctcctctaccgtcgtatctgacgcgggctggcaaggcgcatagnnnnnnnnnn

SEQ ID NO: 26942 - DNA, 540 bp, Homo sapiens
  misc_feature: GYAE6OF01CVUU9.12.19.B08.1.454.CMB.1.raw
  modified_base (222)..(222): a, c, t, g, unknown or other
  misc_feature (222)..(222): n is a, c, g, or t
tcagatacgacgtacacgaccggtgctcgatttagtgagtcagtaaggggcctgaagacttttttatgggctggtcgcaccctgtgcaggagtcagtctcagtcaggacacagcatggacatgagggtccccgctcagctcctggggctcctgctactctggctccgagatgtgacatccagatgacccagtctccatcctccctgtctgcatctgtggganacagagtcaccatcacttgccggcaagtcagaggattagctagttatttaaattggtgtcagcagaagccgagggagacgacccctaaggtcctgatctatgcttcatcctagtttcgactaaaggtcggggtacccagtcgaaggttcaggtgcgagtggatcgtagggacagtatttcactctcactatcagtcgtctgacctacgtgaacgtattttcgactaactttacttctagtacaacgtagtacgttaacaactacccctcgtactacccgtcggaccgaccgaacgggacacggctagggacgtaaacg

SEQ ID NO: 26943 - DNA, 586 bp, Homo sapiens
  misc_feature: GYAE6OF01AOJ2Y.12.19.B08.1.454.CMB.1.raw
  modified_base (221)..(221): a, c, t, g, unknown or other
  misc_feature (221)..(221): n is a, c, g, or t
tcagatacgacgtacacgaccggtgctcgatttagtgagtcagtaaggggcctgaagacttttttatgggctggtcgcaccctgtgcaggagtcagtctcagtcaggacacagcatggacatgagggtcccgctcagctcctggggctcctgctactctggctccgagatgtgacatccagatgacccagtctccatcctccctgtctgcatctgtggganacagagtcaccatcacttgccgggcaagtcaggaggattagctagtttatttaaattggtgtcagcagaagccgagggagacgccccgtaaggtcctagattctatgtcttcatcctagtttgacgtaaaggttcggggtaccccagttacgtaaggttcaggttcgggactaggtggattcggtagggactagtactttcacttcctaccacatacgacgcggtctgacctaacgtgaattagtttacgacttaactttacttctacgtacaactagtacttaaccgtaaccttccccgttaccgtacctaccgtcggtacccggaccgtaacgggaccgaacggcgtacggtaacgtaaacgg

SEQ ID NO: 26944 - DNA, 382 bp, Homo sapiens
  misc_feature: GYAE6OF01B4X5Y.12.19.B08.1.454.CMB.1.raw
  modified_base (358)..(358): a, c, t, g, unknown or other
  misc_feature (358)..(358): n is a, c, g, or t
  modified_base (360)..(361): a, c, t, g, unknown or other
  misc_feature (360)..(361): n is a, c, g, or t
  modified_base (363)..(382): a, c, t, g, unknown or other
  misc_feature (363)..(382): n is a, c, g, or t
tcagatacgacgtacacgaccggtgctcgatttagtgagtcagtaaggggccctcaggggtccctgatcgcttctctggctccaagtctggcaacacggcctccctgaccgtctctgggctccaggctgaggatggaggctgattattactgcagctcatatgcaggcagcaactaggtttttgtccttcggaacgttgggaccccagggttccaccggttcctagggtccacgaccccgaaaggccccaaacccctacgtcgtccacctccgttccgttcccccgcccttacctccttaaccggttcttatcccgttgacggtccgggtcctgggaccaaaggggtccaccaagtgngnnannnnnnnnnnnnnnnnnnnn

SEQ ID NO: 26945 - DNA, 319 bp, Homo sapiens
  misc_feature: GYAE6OF01AJM6Y.12.19.B08.1.454.CMB.1.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (299)..(303): a, c, t, g, unknown or other
  misc_feature (299)..(303): n is a, c, g, or t
  modified_base (305)..(319): a, c, t, g, unknown or other
  misc_feature (305)..(319): n is a, c, g, or t
tcagatacgacgtacacgaccggtgctcgatttagtgagtcagtaaggggccctcgaggggtccctgatcgcttctctggctccaagtctggcaacacggcctccctgaccgtctctgggctccaggctgaggatgaggctgattatactgcagctcatatgcaggcagcaactagttttgcttcggaactgggacccaggtccaccgtcctaggtcacgcccaaggcccaaccccntgtcactctcgttcccncctctcacgtcgtatctgacgcgggctggccaaggctacatagcnnnnntnnnnnnnnnnnnnnn

SEQ ID NO: 26946 - DNA, 670 bp, Homo sapiens
  misc_feature: GYAE6OF01DUU64.12.19.B08.1.454.CMB.1.raw
  modified_base (228)..(228): a, c, t, g, unknown or other
  misc_feature (228)..(228): n is a, c, g, or t
tcagatacgacgtacacgaccggtgctcgatttagtgagtcagtaaggggcctgaagacttttttatgggctggtcgcaccctgtgcaggagtcagtctcagtcaggacacagcatggacatgacgggtccccgctcagctcctggggctcctgctactctggctccgagatgtgacatccagatcgacccagtcctccatccctccctgtctgcatcgtggtggganacagagtccaccatcacgttcggccgggacaagtcaggaggtattagactaagttatttaaagttggtgtacagacaagacggccgagggagaccgtaccccgtaaggtcctagagttctagtcgtcttcactccgtagtttcgaacgtaaacggtccgggtacccagtacggtaaggttcgaggtcggtactaggttggtacgttcgtagggaactagttactttaccacttccgtaccaactcgtacgacggtccgggttctacgtaccgtaacgtaaggtaattacgttttacgacctttaaccgtttcttacgtcgtaaccaaacgtacggttaacttaacctaacccgttaccccgttacccgtaccttaccggtccggtaaccccgaacgggtaaccgggaaccgtaccgggtacgtacgggtaagttaaaaccgg

SEQ ID NO: 26947 - DNA, 753 bp, Homo sapiens
  misc_feature: GYAE6OF01ET7LD.12.19.B08.1.454.CMB.1.raw
tcagatacgacgtacacgaccggtgctcgatttagtgagtcagtaaggggcctgaagacttttttatgggctggtcgcaccctgtgcaggagtcagtctcagtcaggacacagcatggacatgagggtccccgctcagctccgtggggctcctgctactctggcctccgagatgtgacatccagatcgaccctagtcctccacttccctccctgtctgcattcgtggtggagacagacgtcacctatcctacgttcggcccgggacaacgtcaaggaggtaacttagacttaagtttaacttttaaaggttggtactacgagacgaaggaacggaccggaaggggacgaccggtaccccgttaaaggtccgtagtacgttacctagtcgtaccttacgtacttacccggttaagtttcgaaaccggtaacgggttaccgggtaccctaagttacggttaacgggttacgacggttcgggacgtaacgggttaggtaacgttacgggtacgggtaaccgtaacggtttactttaccgaaccgtttcccgtaccgtaacccgtacgttaccggtacggttcccgggttactacggtaaccgtaaccgtaaggtaaccgtttacttacggtaaccttaaccgtttacgttcgtaacgtactaaacggtacgttaaccttaaacgtacccttacccgtaccgtacctaccgtcggacccgtacgaccggtacgtaaggcggtacggaataaaccggg

SEQ ID NO: 26948 - DNA, 334 bp, Homo sapiens
  misc_feature: GYAE6OF01AY60F.12.19.B08.1.454.CMB.1.raw
  modified_base (236)..(236): a, c, t, g, unknown or other
  misc_feature (236)..(236): n is a, c, g, or t
  modified_base (301)..(301): a, c, t, g, unknown or other
  misc_feature (301)..(301): n is a, c, g, or t
  modified_base (303)..(305): a, c, t, g, unknown or other
  misc_feature (303)..(305): n is a, c, g, or t
  modified_base (307)..(307): a, c, t, g, unknown or other
  misc_feature (307)..(307): n is a, c, g, or t
  modified_base (309)..(334): a, c, t, g, unknown or other
  misc_feature (309)..(334): n is a, c, g, or t
tcagatacgacgtacacgaccggtgctcgatttagtgagtcagtaaggggccctcaggggtccctgatcgcttctctggctccaagtctggcaacacggcctccctgaccgtctctgggctccaggctgaggatgaggctgattattactgcagctcatatgcaggcagcaactagttttgtcttcggaactcgggacccaggtcaccgtcctaggcacgcccaagcccaaccccntgtcactctcgttccccgcctcctctacgtcgtatcctgacgcggctgacgaaggcgtacatagntnnngncnnnnnnnnnnnnnnnnnnnnnnnnnn

SEQ ID NO: 26949 - DNA, 754 bp, Homo sapiens
  misc_feature: GYAE6OF01BFT8V.12.19.B08.1.454.CMB.1.raw
tcagatacgacgtacacgaccggtgctcgatttagtgagtcagtaaggggcctgaagtacttttttatgggctggtcgcaccctgtgcaggagtcagtctcagtcaggacacagcatggacagtggacgggtccccgctcagctccgtggggctcctgcctactcgtggcctccgagtatgtagacactccagatcgaccctagtcctcccacttccccttccctgttcctgtacctagttcgttaggacggggaacgaccgaggtactccaacctattacctacgttcggaccggtataacgtacgaaggaaggtattacggacttaaggttttaatttaaaggttggtacgtacgaacgacgaaggtaacgccggaagggaccggtaccgtacccgtaaggtcctaggtacttactagtcgtactacgatacgtagttagaacgtaacgggtccggtactagtatacggtacaggtcgagtaagtgattcggaggaacttagtacctttacgacttaccgacctactacgtcggtaaccggtcgtcgtaacaccgttaagtagttaaggtttaactttcgtaacctttaacctttgttacccgaacgttaactaaaagttaccgttaaaccgtttaaacccgtaacccctttcccccggtaacggaccccgtaacccggtacgggaaccccggtaaccgaaaccgggggtacctacccggggtttataaacgggggttaaataaaaaccggg

SEQ ID NO: 26950 - DNA, 376 bp, Homo sapiens
  misc_feature: GYAE6OF01ETMY7.12.19.B08.1.454.CMB.1.raw
  modified_base (332)..(332): a, c, t, g, unknown or other
  misc_feature (332)..(332): n is a, c, g, or t
  modified_base (336)..(338): a, c, t, g, unknown or other
  misc_feature (336)..(338): n is a, c, g, or t
  modified_base (340)..(376): a, c, t, g, unknown or other
  misc_feature (340)..(376): n is a, c, g, or t
tcagatacgacgtacacgaccggtgctcgattttagtgagtcagtaagggccctacgagggggtccctgatcgcttctctggcttccaagtctggcaacacggccctccctgaccgtctctcgggcgtccagggctgaggatgaggctggatttatacgtgcagcttcatatacaagcagcagccacccgtctttgtaccttcgggaaagtggggaccaaggttccaccgtcctacgtcagcccaaggcccaaccccatgtccactctcgttccccgcctacctctaacgtctaatcttggagtcggggctgggacaaggcgacactaggcngtcnnntnnnnnnnnnnnnnnnnnnnnnnnnnnnnnnnnnnnnn

SEQ ID NO: 26951 - DNA, 754 bp, Homo sapiens
  misc_feature: GYAE6OF01CYP6I.12.19.B08.1.454.CMB.1.raw
  modified_base (216)..(216): a, c, t, g, unknown or other
  misc_feature (216)..(216): n is a, c, g, or t
tcagatacgacgtacacgaccggtgctcgatttagtgagtcagtaaggggcctgaagactttttatggctggtcgcaccctgtgcaggagtcagtctcagtcaggacacagcatggacatggacggtccccgctcagtcctccgtgggctcctgctactctggcctcgagatgtgacatccagctcgaccctagtcctaccactcccgtcctgtcncgactattcgtaggaggacacacgacgtaccaccactactaccgttcggaccggacgtaagtacgaagtacggtaattacgtacgttaagtttaaattaagttcggtagtactagactaaggaccgtaaccggagggacgtacccgtaaccccgttaaaggtcctagtacgttactcgtcttacttacgtacttacccggttgtttacggaacgttaaaggggtcccggtaacctacggttaacgtaaggtttcgacggtacggtcgtaaggttcgacgttacggtaggtaaccgtaagttaccgttacgaaccttccaaccgtaccgtaagtccggtaccgttagggttacccacgtaaccgtacgttaacgttaacgtttaccgtttacgtaccttaactttcgttacgtactaaccgtaaattaacgtaccttaaccgtaaccctccccgttagttacccgtaccgggtacccggaaccggaaaccggtaacgggtaacccgtacgggtaacgtaaggggtaaacttaaaaccgg

SEQ ID NO: 26952 - DNA, 847 bp, Homo sapiens
  misc_feature: GYAE6OF01CQC6G.12.19.B08.1.454.CMB.1.raw
  modified_base (143)..(143): a, c, t, g, unknown or other
  misc_feature (143)..(143): n is a, c, g, or t
  modified_base (551)..(551): a, c, t, g, unknown or other
  misc_feature (551)..(551): n is a, c, g, or t
tcagatacgacgtacacgaccggtgctcgatttagtgagtcagtaaggggcctgaagtacttttttatgggctggtcgcaccctgtgcaggagtcagtctcagtcaggacacagcagtggacagtcggacgggtccccgctcncgccgttccggtggggccttccgtcgaccttaccgtcgtcggccttaccgagtattcggtacgacctacgtaccgagtacgtaccgaacccgtgttccctaccgtccttccccgttccgttagtccgtctcgtacgttcggttagggaggaacaacgtaggtacctaccaaccttcgtaccgtacggtacggaccggaacgtaagtacgaaggttagtacgttagtaagtttaaagtttaacgttaggttcgtacgtacgaacggacgaaggtaccgacgggaacggacggtacccgtaccgtttacgtacgtatacttacgtgtcctcttaactacgtagttacggtaacgtaacgggtaccggttccgtaacgtaccgtaaggttacggtactcggggttaacggngttaagggtacgttagggtaccgtacgggtaactttacggtaacctttcaacccggtactttccaaccggtaggtacccgtacggtttccgaacggttaaccaacgggtaaccgtttaaggttaaacctttcgtaaccgtttaccttaaccgttcggttaacctaagttaaccttaaacgaccgttaaccttaacccgtacccgtttacccgtacgtaaacccggtccggtaacccggaaaccggtaccggtaaacggacccggtaaggtacgtaaacggttaaactaaacccggg

SEQ ID NO: 26953 - DNA, 307 bp, Homo sapiens
  misc_feature: GYAE6OF01CD0KP.12.19.B08.1.454.CMB.1.raw
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
  modified_base (294)..(307): a, c, t, g, unknown or other
  misc_feature (294)..(307): n is a, c, g, or t
tcagatacgacgtacacgaccggtgctcgatttagtgagtcagtaagggccctcgaggggtccctgatcgcttctctggctccaagtctggcaacacggcctccctgaccgtctctgggctccaggctgaggatgagctgattattactgcagctcatatgcaggcagctaatagttttgtcttcggaactgggacccaggtcaccgtcctaggtcagcccaagcccaacccatgtcactcgtcgttccccgcctcctctacgtcgtanctgacgcggctggcaggcncatagnnnnnnnnnnnnnn

SEQ ID NO: 26954 - DNA, 760 bp, Homo sapiens
  misc_feature: GYAE6OF01BRPJF.12.19.B08.1.454.CMB.1.raw
  modified_base (173)..(173): a, c, t, g, unknown or other
  misc_feature (173)..(173): n is a, c, g, or t
  modified_base (228)..(228): a, c, t, g, unknown or other
  misc_feature (228)..(228): n is a, c, g, or t
  modified_base (321)..(321): a, c, t, g, unknown or other
  misc_feature (321)..(321): n is a, c, g, or t
tcagatacgacgtacacgaccggtgctcgatttagtgagtcagtaaggggcctgaagactttttatgggctggtcgcaccctgtgcaggagtcagtctcagtcaggacacagcatggacatgacgggtcccgctcagctccgtggggctcctgctactctggctcgagatgtnacatccagatcgacccagtcctaccactccctcctgtcctgctatctggtggganacagagtaccacctatctacgttcggaccgggtactaaggtcgaaggtacggtatttaacggacgttaagttttaactttaaagttcgggttntacgtagacgaaggaacggtccgaaggggacgtaccgtaccccgttaaggtccgtaggtaacttacgtaacgtcgtaccttactaaccgttacccgttaaggtttaccggaaaccggtaaaacgggttccggggtaacccctaaaggttacccgtaaagggttccgaagggttcgggaccgttagtacgggtaactcgggtagggtaactagttacttccgtaacttcctaacctaacctagtccgtacggtacgttctacgacctaacgtagtaacgttcgttaccgtacggaacctttaactttacgtaccgttagtaaccgaacgtaacggtaaccgttaaccgtaccggtttacccccttaccggttccggttaacggggaccgggtaaccggtaaacgtacgggtaacgaacgtaaccgtaacggtaaacccgg

SEQ ID NO: 26955 - DNA, 756 bp, Homo sapiens
  misc_feature: GYAE6OF01ATBZW.12.19.B08.1.454.CMB.1.raw
  modified_base (67)..(67): a, c, t, g, unknown or other
  misc_feature (67)..(67): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
tcagatacgacgtacacgaccggtgctcgatttagtgagtcagtaaggggcctgaagacttttttangggctggtcgcaccctgtgcaggagtcagtctcagtcaggacacagcatggacatggacgggtcccccgctcagctccgtggggctcctgctactctggctccgagagtgtgacatccagatcgaccccgtagtccctcctacttcccctccctgtctcgtctacgtcgtggnggganacgtggtacgccacctatcacgttcggccggacacgtcgaggaggtattaacgtcgtaagttttaatttaagttcgggttacgtcagacaaggtaacgccggaaggggacgacccggtaccccgtagggtccctagacttcgttactcgttcttacctccgttccttaaggttacggaaccggttaaacggggttccggttaacccctagttaaccgggtaacggtttccggaagggttcgggacggttagtaggtacgtccgggtacggacgtaacgttaccgtttcctaccgttctacccgtaacctcgtccggtacggtcggtccgtacgaaccgtaacggttaacgtaacggtttacttacgtaccttaaccgtttcgttacgtacgtaacctaagtacgttaaaccgtttaacccgacccttaaccccgtacccgttaccggtacccgttaccgggaccggtaacccgaacgggttacccgacggtagtaagggtaacgttaaacg

SEQ ID NO: 26956 - DNA, 312 bp, Homo sapiens
  misc_feature: GYAE6OF02GGAQ0.12.19.B08.1.454.CMB.1.raw
  modified_base (300)..(312): a, c, t, g, unknown or other
  misc_feature (300)..(312): n is a, c, g, or t
tcagatacgacgtacacgaccggtgctcgatttagtgagtcagtaaggggccctcgaggggtccctgatcgcttctctggctccaagtctggcaacacggcctccctgaccgtctctgggctccaggctgaggatgaggctgattattactgcagctcatatgcaggcagcaacagttttgtcttcggaactgggacccaggtcaccgtcctaggtcagcccaaggccaacccccactgtcactctgttcccgcctcctctacgtcgtaatctgagccgggctggcaaggcgcatagcgnnnnnnnnnnnnn

SEQ ID NO: 26957 - DNA, 303 bp, Homo sapiens
  misc_feature: GYAE6OF02GY2S4.12.19.B08.1.454.CMB.1.raw
  modified_base (296)..(303): a, c, t, g, unknown or other
  misc_feature (296)..(303): n is a, c, g, or t
tcagatacgacgtacacgaccggtgctcgatttagtgagtcagtaaggggccctcaggggtccctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggccaacccactgtcactctgttcccgcctcctctacgtcgtatctgagcgggctggcaaggcgcatagnnnnnnnn

SEQ ID NO: 26958 - DNA, 363 bp, Homo sapiens
  misc_feature: GYAE6OF02F7N02.12.19.B08.1.454.CMB.1.raw
  modified_base (181)..(181): a, c, t, g, unknown or other
  misc_feature (181)..(181): n is a, c, g, or t
  modified_base (348)..(363): a, c, t, g, unknown or other
  misc_feature (348)..(363): n is a, c, g, or t
tcagatacgacgtacacgaccggtgctcgatttagtgagtcagtaaggggccctcaggggtccctgatcgcttctctggctccaagtctgactacacggcctccctgaccatctctgggctccaggctgaggacgaggctgattattattgcagctcatatacaagcagcagccacccttntttgtcgttacggaaggtcggaaccaaggtccaccgtcctacgtcacgacccgaacggaccccaaaccccacgtgtacctaccttcgttccgttacccccaccccttcctccttacggtccgttatcctggaggccgggtctcgggacaagggccgactaagtagcnnnnnnnnnnnnnnnn

SEQ ID NO: 26959 - DNA, 363 bp, Homo sapiens
  misc_feature: GYAE6OF02HRKHZ.12.19.B08.1.454.CMB.1.raw
  modified_base (293)..(295): a, c, t, g, unknown or other
  misc_feature (293)..(295): n is a, c, g, or t
  modified_base (298)..(363): a, c, t, g, unknown or other
  misc_feature (298)..(363): n is a, c, g, or t
tcagatacgacgtacacgaccggtgctcgatttagtgagtcagtaaggggccctcgaggggtccctgatcgcttctctggctccaagtctggcaacacggcctccctgaccgtctctgggctccaggctgaggatgaggctgattattactgcagttcatatacaagcacttccatctcgtggtgttcggcgtgggaccaagctgacgtctaagtcagcccaaggctgcccctggtcactctgttcccgcctactctacgtcgtatctgagcgggctggcaaggcgcaatagnnntgnnnnnnnnnnnnnnnnnnnnnnnnnnnnnnnnnnnnnnnnnnnnnnnnnnnnnnnnnnnnnnnnnn

SEQ ID NO: 26960 - DNA, 305 bp, Homo sapiens
  misc_feature: GYAE6OF02IG8SE.12.19.B08.1.454.CMB.1.raw
  modified_base (294)..(305): a, c, t, g, unknown or other
  misc_feature (294)..(305): n is a, c, g, or t
tcagatacgacgtacacgaccggtgctcgatttagtgagtcagtaaggggccctcaggggtccctgatcgcttctctggctccaagtctggcaacacggcctccctgaccgtctctgggctccaggctgaggatgaggctgattattactgtgcagcatgggatgacagcctgaatggtccggtattcggcggaggaccaagctgaccgtcctaggtcagcccaaggctgccccctggtcactctgttcccacctcctctacgtcgtatctgagcggctggcaaggcgcatagnnnnnnnnnnnn

SEQ ID NO: 26961 - DNA, 312 bp, Homo sapiens
  misc_feature: GYAE6OF02FY7MC.12.19.B08.1.454.CMB.1.raw
  modified_base (239)..(239): a, c, t, g, unknown or other
  misc_feature (239)..(239): n is a, c, g, or t
  modified_base (303)..(312): a, c, t, g, unknown or other
  misc_feature (303)..(312): n is a, c, g, or t
tcagatacgacgtacacgaccggtgctcgatttagtgagtcagtaagggccctcaggggtccctgatcgcttctctggctccaagtctggcaacacggcctccctgaccgtctctgggctccaggctgaggatggaggctgattattactgcagctcatatgcaggcagcaactagttttgtcttcggaactcgggacccaggtccaccgtcctaggtcacgcccaaggcccaaccccntgtccactctcgttccccacctcctctacgtctactctgagccgggctggcaaggcgacatagnnnnnnnnnn

SEQ ID NO: 26962 - DNA, 705 bp, Homo sapiens
  misc_feature: GYAE6OF02HLLEH.12.19.B08.1.454.CMB.1.raw
tcagatacgacgtacacgaccggtgctcgattttagtgagtcagtaaggggcctgaagacttttttatgggctggtcgcaccctgtgcaggagtcagtctcagtcaggacacagcatggacatgagggtcccgctcagctcctggggctcctgctactctggctccgagatgtgacatccagatgacccagtcctccatcctccctgtctgcatctgtgggagacagagtcaccatcacttcggccggcaagtcagagattagctagtttaattaaagttggtagtcagtcagaagccgagggagacgtccccgtaaaggtccctagacttcgtagtcgtcttacatcctagtttcgacgtaaaggtcgggtacccagttacgaaacggtttcagggttcggtacgtagggttacgtacgttacggtcggggtaactaagtacgtttttaacccgacgtttacccgtacctaaacccttaacgttaccgtaaccggtccgggttaaccgtcggtaaaccccttaaaccggttaaggttaaacgtttaagtttttaccggaaccttaaacgttttacctttacgttacgtacctaaacgtagttaaccgttaacctaacccgttaccccgtcccgtaccgtacccgtcggtacccggtaacccgaacgggtacccgtacgggtacgttacggaacgttaaaaccgg

SEQ ID NO: 26963 - DNA, 402 bp, Homo sapiens
  misc_feature: GYAE6OF02HLTCM.12.19.B08.1.454.CMB.1.raw
  modified_base (117)..(117): a, c, t, g, unknown or other
  misc_feature (117)..(117): n is a, c, g, or t
  modified_base (121)..(121): a, c, t, g, unknown or other
  misc_feature (121)..(121): n is a, c, g, or t
  modified_base (389)..(402): a, c, t, g, unknown or other
  misc_feature (389)..(402): n is a, c, g, or t
tcagatacgacgtacacgaccggtgctcgatttagtgagtcagtaagggccctcaggggtccctgatcgcttctctggctccaagtctggaacaacgcgtccctcgacgcctctggngccncgcgctaggagtgaggacgtcgtagtaattacttgcgacgactctatatagtcgaggacgacgacgaaacctaacgtttttaggttttcgttaccggtaaccggtaacgggtacccgggaaccggtacggtacccgttacccgttacggttacggtacgacccgaaccggacccgaacccccaacctcgtctacctctcgttcccgtaccctacccttcctacgtacgttactctcgaggccgggcgtcgcgaacggacgcataagcnnnnnnnnnnnnnn

SEQ ID NO: 26964 - DNA, 323 bp, Homo sapiens
  misc_feature: GYAE6OF02FZWIB.12.19.B08.1.454.CMB.1.raw
  modified_base (308)..(308): a, c, t, g, unknown or other
  misc_feature (308)..(308): n is a, c, g, or t
  modified_base (315)..(323): a, c, t, g, unknown or other
  misc_feature (315)..(323): n is a, c, g, or t
tcagatacgacgtacacgaccggtgctcgatttagtgagtcagtaaggggccctcaggggtccctgatcgcttctctggctccaagtctggcaacacggcctccctgaccgtctctgggctccaggctgaggatggaggctgattattactgcagctcatatgcaggcagcaactagttttgtcttacggaactcgggacccaggtccaccgtcctaggtcacgacccgaaggcccaaccccactgtaccactcctcgttccccgcccttcctctaccggtctactctgacgcgggctggacaaggcncaatcgnnnnnnnnn

SEQ ID NO: 26965 - DNA, 307 bp, Homo sapiens
  misc_feature: GYAE6OF02HUKQ4.12.19.B08.1.454.CMB.1.raw
  modified_base (286)..(286): a, c, t, g, unknown or other
  misc_feature (286)..(286): n is a, c, g, or t
  modified_base (292)..(307): a, c, t, g, unknown or other
  misc_feature (292)..(307): n is a, c, g, or t
tcagatacgacgtacacgaccggtgctcgatttagtgagtcagtaaggggccctcaggggtccctgatcgcttctctggctccaagtctggcaacacggcctccctgaccgtctctgggctccaggctgaggatgaggctgattattactgcagctcatatgcaggcagcaactgttttgcttcggaactgggacccaggtcaccgtcctaggtcagcccaaggcccaaccccatgtcactctcgttccccgcctctctacgtctatctgagcggctggcaaggcncatagnnnnnnnnnnnnnnnn

SEQ ID NO: 26966 - DNA, 334 bp, Homo sapiens
  misc_feature: GYAE6OF02JKRUA.12.19.B08.1.454.CMB.1.raw
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
  modified_base (307)..(308): a, c, t, g, unknown or other
  misc_feature (307)..(308): n is a, c, g, or t
  modified_base (310)..(334): a, c, t, g, unknown or other
  misc_feature (310)..(334): n is a, c, g, or t
tcagatacgacgtacacgaccggtgctcgatttagtgagtcagtaaggggccctcaggggtccctgatcgcttctctggctccaagtctggcaacacggcctccctgaccgtctctggctccaggctgaggatgaggctgattattactgcagctcatatgcaggcagcaactagttttgcttcggaactgggaccccaggtcaccgtcctaggtcacgcccaaggccaaccccatgtcactctcgttccccgcctcctctacgtctactctgacgccggtcngggtcccaaggccanatacgatgnnannnnnnnnnnnnnnnnnnnnnnnnn

SEQ ID NO: 26967 - DNA, 749 bp, Homo sapiens
  misc_feature: GYAE6OF02IUBXM.12.19.B08.1.454.CMB.1.raw
  modified_base (67)..(67): a, c, t, g, unknown or other
  misc_feature (67)..(67): n is a, c, g, or t
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
  modified_base (528)..(528): a, c, t, g, unknown or other
  misc_feature (528)..(528): n is a, c, g, or t
tcagatacgacgtacacgaccggtgctcgatttagtgagtcagtaaggggcctgaagacttttttangggctggtcgcaccctgtgcaggagtcagtctcagtcaggacacagcatggacatgaggtcccgctcagctccgtggggctccgtgctactctggctccgagatcgtgaccatccagatcgacccngtctccactcccgtccctgtctgcatcgtggtgggganactaggacgtccaaccagtcgaccttggcccgggtacaacggttccgaaggtacggtaacgttacgacttaagtttaagttttaaaacgtttgggtacgttacgacggcgtaaggaacggtcccgaagggggtaaccgacggacccccgttaaagggtcccttagtaacttcctagtcggtcctttacgacttacccgttaagtttcggacgtaaaggggttccgggtaccctaagtacgttaagggttccaagggtcgacgtagggttcgacgtcgtagggactaggtactttacncgtaccaccgtacacgtcgaaccggtcggtacttacgaccgtaaccttaggtaacgtttacgttttacgaaccgttacttttaccgtttccgtacgttaaaccctaagtaacggttacgttaaaccctaacccgttccccggttaaccctccggtaacccgttcggaaccggttacccggaacgggttaccgaccgggtagttacggaaccctttaacggg

SEQ ID NO: 26968 - DNA, 333 bp, Homo sapiens
  misc_feature: GYAE6OF02GDT91.12.19.B08.1.454.CMB.1.raw
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (318)..(333): a, c, t, g, unknown or other
  misc_feature (318)..(333): n is a, c, g, or t
tcagatacgacgtacacgaccggtgctcgatttagtgagtcagtaaggggccctcaggggtccctgatcgcttctctggctccaagtctggcaacacggccctccctgaccgtctctgggctccaggctgaggatgaggctgattattactgcagctcatatgcaggcagcaaactaggtttttgtcttacggaactcgggacccagggtccaccgtcctaggtcacgcccaaggcccaacccccactgtccacctctcgttccccacctcctactcgtctactcgtgaggccggntcggacgaaggccnctataggnnnnnnnnnnnnnnnn

SEQ ID NO: 26969 - DNA, 416 bp, Homo sapiens
  misc_feature: GYAE6OF02H034E.12.19.B08.1.454.CMB.1.raw
  modified_base (261)..(261): a, c, t, g, unknown or other
  misc_feature (261)..(261): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (365)..(416): a, c, t, g, unknown or other
  misc_feature (365)..(416): n is a, c, g, or t
tcagatacgacgtacacgaccggtgctcgatttagtgagtcagtaagggccctcaggggtccctgatcgcttctctggctccaagtctggcaacacggcctcccctgacccgtctctgggctccgaggctggaggatggaggctgattattactgcagctcatatgcgaggcagactaactaggtttttgtcgttacggaagtcgggacccaggtccaccggtcctagggtccaacgacccgaaacggaccctaacccccntcgtaccaacctcgttacccgttcccaaccccttctaccgtccgttacgtactcgttggacgggtccggctggacaagggccgtactaaaagcggncatcgntnnnnnnnnnnnnnnnnnnnnnnnnnnnnnnnnnnnnnnnnnnnnnnnnnnnn

SEQ ID NO: 26970 - DNA, 305 bp, Homo sapiens
  misc_feature: GYAE6OF02JHQWI.12.19.B08.1.454.CMB.1.raw
  modified_base (287)..(287): a, c, t, g, unknown or other
  misc_feature (287)..(287): n is a, c, g, or t
  modified_base (290)..(305): a, c, t, g, unknown or other
  misc_feature (290)..(305): n is a, c, g, or t
tcagatacgacgtacacgaccggtgctcgatttagtgagtcagtaagggccctcaggggtccctgatcgcttctctggctccaagtctggcaacacggcctccctgaccgtctctgggctccaggctgaggatgaggctgattattactgcagctcatatgcaggcagcaactgttttgcttcggaactgggacccaggtccaccgtctaggtcagcccaaggcccaaccccatgtccacttctcgttcccgcctcctctacgtctatctgagcggctggcaaggcnatnnnnnnnnnnnnnnnn

SEQ ID NO: 26971 - DNA, 354 bp, Homo sapiens
  misc_feature: GYAE6OF02GK9Z8.12.19.B08.1.454.CMB.1.raw
  modified_base (239)..(239): a, c, t, g, unknown or other
  misc_feature (239)..(239): n is a, c, g, or t
  modified_base (310)..(313): a, c, t, g, unknown or other
  misc_feature (310)..(313): n is a, c, g, or t
  modified_base (316)..(354): a, c, t, g, unknown or other
  misc_feature (316)..(354): n is a, c, g, or t
tcagatacgacgtacacgaccggtgctcgatttagtgagtcagtaaggggccctcaggggtccctgatcgcttctctggctccaagtctggcaacacggcctccctgaccgtctctgggctccaggctgaggatgaggctgattattactgcagctcatatgcaggcagcaaacgtagttttgtcttcggaacgtgggacccaggtcaccgtcctaggtcagcccaaggcccaaccccntgtaccactctcgtcccaccctcctctacgtctatctgagccgggtctggaccaaggtcgactaagtacgnnnnctnnnnnnnnnnnnnnnnnnnnnnnnnnnnnnnnnnnnnnn

SEQ ID NO: 26972 - DNA, 667 bp, Homo sapiens
  misc_feature: GYAE6OF02H1OLM.12.19.B08.1.454.CMB.1.raw
  modified_base (170)..(170): a, c, t, g, unknown or other
  misc_feature (170)..(170): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (520)..(520): a, c, t, g, unknown or other
  misc_feature (520)..(520): n is a, c, g, or t
  modified_base (537)..(537): a, c, t, g, unknown or other
  misc_feature (537)..(537): n is a, c, g, or t
  modified_base (595)..(595): a, c, t, g, unknown or other
  misc_feature (595)..(595): n is a, c, g, or t
tcagatacgacgtacacgaccggtgctcgatttagtgagtcagtaagggccctcgaggggtccctgatcgcttctctggctccaagtctggacaacacggcctcctgaccgtctcgtgggctcccgaggctggaggatcggaggctaggatttattacctgacagcctanatatgacgaggcaagctaacgttagtttttcgtcgttaccggaacggtccgggtaaccccgtaggtaccctaaccggttcccgttaggtccgaacgtacccgaaaccggaccccctaaccccgtactacgacccgtaccgttcgttacccgtttacccccacccttccgttaccgttacggttaccgttacttaccgtcgggacggttccggggccttacgggacgaacgggtccgttaacgtaatcggactggtcctagngaacccgtntgaacacgtcncncggtacacncangtacacgctcgtacacgacactgtacgtactgtatacgacgcgtagcgtacgacncgtagtactagtacgtntgtacgtacgtctagtactactacgtagtcgtcgtagctagacgacgtagagttacgngtacgtactacgtacgaccgactacgtacgactaacgtcgtccgtacgacgtacgcacgtaccgactctacg

SEQ ID NO: 26973 - DNA, 246 bp, Homo sapiens
  misc_feature: GYAE6OF01B4W69.39.53.E09.1.454.CMB.1.raw
  modified_base (245)..(246): a, c, t, g, unknown or other
  misc_feature (245)..(246): n is a, c, g, or t
tcagtcgcactagtcacgaccggtgctcgatttagagagagtgtgttggttgggacagatttcactctcaccatcagcagcctgctgcctgaagatgctgcaacttattactgtcaaaagtatgacagtgtcccgtggacgttcggcccagggaccaaggtgaaatcaaacgactgtggctgcaccatctgtctcatcttccgcatctgaactagtgcgactgagcggctggcaaggcgcatagnn

SEQ ID NO: 26974 - DNA, 252 bp, Homo sapiens
  misc_feature: GYAE6OF01D7T1O.39.53.E09.1.454.CMB.1.raw
  modified_base (251)..(252): a, c, t, g, unknown or other
  misc_feature (251)..(252): n is a, c, g, or t
tcagtcgcactagtcacgaccggtgctcgatttagagagagtgtgttgggtttgggacagatttcactctcaccatcagcagcctgctgcctgaagatgctgcaacttattactgtcaaaagtatgacagtgtcccgtggacgttcggcccagggaccaaggtggaaatcaaacgaactgtggctgcaccatctgtcttcatcttccgcatctgaactagtgcgactgagcgggctggcaaggcgcatagnn

SEQ ID NO: 26975 - DNA, 494 bp, Homo sapiens
  misc_feature: GYAE6OF01CCQR1.39.53.E09.1.454.CMB.1.raw
tcagtcgcactagtcacgaccggtgctcgatttagagagagtgtgttgggtttggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcagtcagggcattaggcattatttagcctggtatcaacagcacccggggaagttcctagactcctgatctatgatgcatccaatttagaaccaggggtcccatctcgattcagtgcggtggtctgggacagatttcactctcaccatcagcagcctgctgcctgaagatgctgactaacttattactagtacaaaagtatagactagtgtcccgtggaccgttcggacccagggaccaaggtacggaaatacaaaacgactggtggtacg

SEQ ID NO: 26976 - DNA, 254 bp, Homo sapiens
  misc_feature: GYAE6OF01DPEQF.39.53.E09.1.454.CMB.1.raw
  modified_base (253)..(254): a, c, t, g, unknown or other
  misc_feature (253)..(254): n is a, c, g, or t
tcagtcgcactagtcacgaccggtgctcgatttagagagagtgtgttgggtttgggacagatttcactctcaccatcagcagcctgctgcctgaagatgctgcaacttattactgtcaaaagtatgacagtgtcccgtggacgttcggcccagggaccaaggtggaaatcaaacgaactgtggctgcaccatctgtcttcatcttcccgccatctgaactagtgcgactgagcgggctggcaaggcgcatagnn

SEQ ID NO: 26977 - DNA, 548 bp, Homo sapiens
  misc_feature: GYAE6OF01D6I0W.39.53.E09.1.454.CMB.1.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
tcagtcgcactagtcacgaccggtgctcgatttagagagagtgtgttgggtttggggcagaagtctctctcagtcagggcacagcatggacatgaggtccctgctcagctcctgggactcctgctgctctggctccagataccagatgtgacatccagatgacccagtctccatcctcctgtctgcatctgtaganacagatcaccatcacttgccggnagtcagggcattaggcattattagcctggtatcaacagcaccgggtagttcctagactcctgactctatcgatgacatccaatttacgaacctaggggtcccagtctcgacttcaagtggcggttggtctgggactagtatttcactctcactatacagcacgcctgctgcctagaacgactcgactgtacctaacttacgttacgtacgtactaaaagtcgttacgtaaccgtagttccggttacccgtaggtaccgtttaccgggaccctagggaaccgtaacggttacggtaaactaccgtaaaacgtacgttaggtcggtaaccg

SEQ ID NO: 26978 - DNA, 448 bp, Homo sapiens
  misc_feature: GYAE6OF01DGCPH.39.53.E09.1.454.CMB.1.raw
  modified_base (444)..(448): a, c, t, g, unknown or other
  misc_feature (444)..(448): n is a, c, g, or t
tcagtcgcactagtcacgaccggtgctcgatttagagagagtgtgttgggtttgggggaagaggaagactgacggtccgccaggctccagggaaggggctggagtgggtcgccaacattaagaaagatggaagtgagaaaaactatgtggactctgtgaagggccggtttaccatctccagggacaacgccatgcatttagcatatttgcaaataaacagtctgagagccgaggacacggcttcatatcactgtgcgctggggcactatggattctggggccaagggaccacggtcaccgtctcctcagcctccaccaagggcccatcggtctccccctggcgccctgctccaggagcacctccgagagcacagcggccctgggctgcctggtcaagggactacttccactagtgcgactgagcgggctggcaaggcgcatagnnnnn

SEQ ID NO: 26979 - DNA, 481 bp, Homo sapiens
  misc_feature: GYAE6OF01B2O0F.39.53.E09.1.454.CMB.1.raw
  modified_base (423)..(423): a, c, t, g, unknown or other
  misc_feature (423)..(423): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaaggttcctagactcctgatctatgatgcatccaatttagaaccaggggtcccatctcgattcagtggcggtggtctgggacagatttcactctcacatcagcagcctgctgcctgaagatgctgctaacttattactgtacaaagtntgacagtgtcccgtggacgttcggcccagggaccaaggtgaaatcaaagactgtggac

SEQ ID NO: 26980 - DNA, 488 bp, Homo sapiens
  misc_feature: GYAE6OF01B0B6S.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaaggttcctagactcctgatctatgatgcatccaatttagaaccaggggtcccatctcgattcagtggcggtggtctgggacagatttcactctcaccatcagcagcctgctgcctgaagatgctgcaacttattactgtacaaagtatgacagtcgtcccgtggaccgttcggacccgagggaccaagggtcgaaatcaaagactgtggtcg

SEQ ID NO: 26981 - DNA, 482 bp, Homo sapiens
  misc_feature: GYAE6OF01EFK7L.39.53.E09.1.454.CMB.1.raw
  modified_base (448)..(449): a, c, t, g, unknown or other
  misc_feature (448)..(449): n is a, c, g, or t
  modified_base (451)..(451): a, c, t, g, unknown or other
  misc_feature (451)..(451): n is a, c, g, or t
  modified_base (453)..(454): a, c, t, g, unknown or other
  misc_feature (453)..(454): n is a, c, g, or t
  modified_base (457)..(457): a, c, t, g, unknown or other
  misc_feature (457)..(457): n is a, c, g, or t
  modified_base (459)..(482): a, c, t, g, unknown or other
  misc_feature (459)..(482): n is a, c, g, or t
tcagtcgcactagtcacgaccggtgctcgatttagagagagtgtgttgggtttggggggaagaggaagactgacggtccgccaggctccagggaaggggctggagtgggtcgccaacattaagaaagatggaagtgagaaaaactatgtggactctgtgaagggccggtttaccatctccagggacaacgccatgcatttagcatatttacaaataaacagtctgagagccgaggacacggcttcatatcactgtgcgctggggcactatggattctggggccaagggaccacggtcaccgtctcctcagcctccaccaagggcccatcggtcttccccctggcgccctgctccaggacgcacctccgagagcacagcggcctgggctgcctggtcaagggactacttccactagtgcgactgacgcgggctgggcaaggcgcagtgnnangnngantnnnnnnnnnnnnnnnnnnnnnnnn

SEQ ID NO: 26982 - DNA, 502 bp, Homo sapiens
  misc_feature: GYAE6OF01BRH2R.39.53.E09.1.454.CMB.1.raw
  modified_base (391)..(391): a, c, t, g, unknown or other
  misc_feature (391)..(391): n is a, c, g, or t
  modified_base (419)..(419): a, c, t, g, unknown or other
  misc_feature (419)..(419): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcaccggggaagttcctagactcctgatctatgatgcatccaatttagaaccaggggtcccatctcgattcagtggcggtggtctgggacagatttcactctcacatcagcagctgctgcctgagntgctgactaactattactgtacaaagtntagactagtcgtcccggtggtaccgttcggacccgtagggacccgtaaagggtcggaaactacgaaacgaactggtggtaccg

SEQ ID NO: 26983 - DNA, 478 bp, Homo sapiens
  misc_feature: GYAE6OF01BW863.39.53.E09.1.454.CMB.1.raw
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgacatccagatgacccagtctccatcctccctgtctgcatctgtaggagacagagtcaccatcacttgccgggcagtcagggcattaggcattatttagcctggtatcaacagcacccggggaaggttcctagactcctgatctatgatgcatccaatttagaaccaggggtcccatctcgattcagtggcggtgggtctgggacagatttcactctcaccatcagcagcctgctgcctgagatgctgcaacttnttactgtcaaaagtntagacngtgtcccgtgacgttcgccagggccaaggtggaaatcaagactgtgctcg

SEQ ID NO: 26984 - DNA, 486 bp, Homo sapiens
  misc_feature: GYAE6OF01DYS5B.39.53.E09.1.454.CMB.1.raw
  modified_base (425)..(425): a, c, t, g, unknown or other
  misc_feature (425)..(425): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaaggttcctagactcctgatctatgatgcatccaatttagaaccaggggtcccatctcgattcagtggcggtggtctgggacagatttcactctcaccatcagcagcctgctgcctgaacgatgctgcaacttattactgttcaaaagtntgactagtgtcccgtggaccgtttcggcccagggaccaaaggtgaaatcaaagactgtggc

SEQ ID NO: 26985 - DNA, 530 bp, Homo sapiens
  misc_feature: GYAE6OF01A30ME.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgacatccagatgacccagtctccatcctccctgtctgcatctgtaggagacagagtcaccatcacttggccgggcgagtcagggcattaggcattatttagcctggtatcaacagcacccggggaaggttcctagactcctgatctatgatgcatccaatttagaaccaggggtcccatctcgattcagtggcggtgggtctgggacagatttcacttctcaccatcagcagcctgctgcctgaagatgctgctaacttattactgtactaaaagtatagaactagtcgtcccgtagggtaccgtttccgggacccgacggggacccgaaagggtacggaaacgtacgaaaacggtaaacgtcggtacggcgtaccgg

SEQ ID NO: 26986 - DNA, 506 bp, Homo sapiens
  misc_feature: GYAE6OF01CW0SK.39.53.E09.1.454.CMB.1.raw
  modified_base (436)..(436): a, c, t, g, unknown or other
  misc_feature (436)..(436): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatccctccctgtctgcatctgtaggagacagagtcaccatcacttggccgggcgagtcagggcattaggcagttatttagcctggtatcaacagcgacccgggaagttcctagactcctgatctatgatgcatactaatttacgaaccaggggtcccatctcgattcagtggcgggtggtcgtgggacagtatttcgactctcacatcagcagcctgctcgcctgaacgatgctgactaacttattactagtactaaagtntagatagtcgtccgtggtacgtcggaccgagggaccgaaggtacgtaaactacgaaagacgtgtggtacg

SEQ ID NO: 26987 - DNA, 529 bp, Homo sapiens
  misc_feature: GYAE6OF01BPB97.39.53.E09.1.454.CMB.1.raw
  modified_base (291)..(291): a, c, t, g, unknown or other
  misc_feature (291)..(291): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcaggcattaggcattatttagcctggtatcaacagcacccggggaaggttcctagactccngatctatgatgcatccaatttagaaccgaggggtcccatctcgtattcagtggcgggtgggtctgggacaggtatttcgactctcaccatcagcacgcctgctgcctgaagatgctgacaacgtttacttactagtacaaagtatagacgtagtcgtacccgtggtaccgttccggacccgaggggtaacctaagggtacggtaaaacgttacgaaaaccgaaccgttggcggtaccg

SEQ ID NO: 26988 - DNA, 588 bp, Homo sapiens
  misc_feature: GYAE6OF01CZUNX.39.53.E09.1.454.CMB.1.raw
  modified_base (179)..(179): a, c, t, g, unknown or other
  misc_feature (179)..(179): n is a, c, g, or t
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (366)..(366): a, c, t, g, unknown or other
  misc_feature (366)..(366): n is a, c, g, or t
  modified_base (504)..(504): a, c, t, g, unknown or other
  misc_feature (504)..(504): n is a, c, g, or t
  modified_base (537)..(537): a, c, t, g, unknown or other
  misc_feature (537)..(537): n is a, c, g, or t
tcagtcgcactagtcacgaccggtgctcgatttagagagagtgtgttgggtttgggggtctcagagaggagccctagccctggactccaaggcctttccacttggtgatcagcactgagcacagaggactcaccatggaattggggctgagcgtggtttcgtgtagctattagaaggtntcagtgtgaggtgcagctggtggagtcgtgggggagctttggtccaggccgtggggggtccctggagctctcctgtgcagcctntggattcactttagaactntggatgagttggccncagctgcgagggaggntgggagtgggngaccaagagtaggaggtagagtaggaaagagaagtaaaactntaagtggtaggtactgtggtaggaacgggtcaattcacattcaccgaagacgaacgaacgacctaaagtacttaccattagttaactttaacaaagttacgaacgtaagtaactaggacgacgaccgaggactacgtntagtatacgtagtggacggagggaacggggtancgggtaggcgtcgggtaccgttaggcggggccgtaccggggtaacccccgg

SEQ ID NO: 26989 - DNA, 499 bp, Homo sapiens
  misc_feature: GYAE6OF01CPJY3.39.53.E09.1.454.CMB.1.raw
  modified_base (396)..(396): a, c, t, g, unknown or other
  misc_feature (396)..(396): n is a, c, g, or t
  modified_base (427)..(427): a, c, t, g, unknown or other
  misc_feature (427)..(427): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtcctccatcctccctgtctgcatctgtaggagacagagtcaccatcacttggccgggcagtcagggcattaggcattattagcctggtatcaacagcgaccggggaagttcctagactcctgatctatgatgcatcaatttaacgaacagggtcccatctcgattcagtggcggtggtcgtggacagagtttcactctcaccatcagcagcctgctgcctagaagntgctgactaagttacttactagtacaaagtntagacagtcgtccgtggtacgttcggcccgagggaccgtaaggtagaaacgtacaaacgactggtggtaccg

SEQ ID NO: 26990 - DNA, 538 bp, Homo sapiens
  misc_feature: GYAE6OF01D95WI.39.53.E09.1.454.CMB.1.raw
  modified_base (402)..(402): a, c, t, g, unknown or other
  misc_feature (402)..(402): n is a, c, g, or t
  modified_base (434)..(434): a, c, t, g, unknown or other
  misc_feature (434)..(434): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcagtcagggcattaggcattattagcctggtatcaacagcacccggggaaggttcctagactcctgatctatgatgcatccaatttagaaccaggggtcccatctacgtatcgagtggcggtgggtctgggaacagtatttcgactctcaacctatcagcagcctgctgcctgaagntgctagctaaacttattactagtaacaaagtntagaactagttcggtacccgtagggtaccgttccgggacccgtaggggaaacccgtaagggtaacggtaaaacgtaacgaaaaccgtaacgtggtggtaacccg

SEQ ID NO: 26991 - DNA, 529 bp, Homo sapiens
  misc_feature: GYAE6OF01DZX80.39.53.E09.1.454.CMB.1.raw
  modified_base (400)..(400): a, c, t, g, unknown or other
  misc_feature (400)..(400): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcagttaggcattatttagcctggtatcaacagcaccggggaagttcctagactcctgatctatgatgcatccaatttagaaccaggggtcccatctcgattcagtggcggtggtcgtgggactagtatttcactctcacctatcagcagcctgctgcctagaagntgctgactaacttattactagtacaaagtcagtacagtcgtacccgtgggtaccgttcgggacccgtaacgggaacccgtaagggtaacggtaaaacgtaaccgaaacggtaacgtggtcggtacccgg

SEQ ID NO: 26992 - DNA, 511 bp, Homo sapiens
  misc_feature: GYAE6OF01EPIVF.39.53.E09.1.454.CMB.1.raw
  modified_base (398)..(398): a, c, t, g, unknown or other
  misc_feature (398)..(398): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaaggttcctagactcctgatctatgatgcatccaatttagaaccaggggtcccatctcattcagtggcggtgggtcgtgggacaggatttcacttctcacatcagcagcctgctgcctgaagntgctgctaacttatactagtactaaagtatgactagtcgtcccggtggtaccgttccggacccgaggggaccaaagggtagaaaacgtcgaaaacggtaactggtggctacgg

SEQ ID NO: 26993 - DNA, 504 bp, Homo sapiens
  misc_feature: GYAE6OF01A1DWE.39.53.E09.1.454.CMB.1.raw
tcagtcgcactagtcacgaccggtgctcgatttagagagagtgtgttgggtttggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttggccggcagtcagggcattaggcattatttagcctggtatcaacagcacccggggaaggttcctaggactcctgatctatgatgcatcaatttagaaccaggggtcccatctcgattcagtggcggtggtctgggacagatttcgactcgtcacatcagcagcctgctgcctgaagatgctgactaacttattactgtactaaagtatgacagtcgtcccgtggtaccgttcggacccgaggggaccctaagggacgtaaataccgaaaagacgttggtggtaccg

SEQ ID NO: 26994 - DNA, 719 bp, Homo sapiens
  misc_feature: GYAE6OF01EVZU8.39.53.E09.1.454.CMB.1.raw
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (284)..(284): a, c, t, g, unknown or other
  misc_feature (284)..(284): n is a, c, g, or t
tcagtcgcactagtcacgaccggtgctcgatttagagagagtgtggttaggggtttgggggtcgtcgagagaggagccctagccctggactccaaggcctttccacttggtgatcagcactcgagcacagaggactcacatggaattggggctgagcgtggtttcgtgtagctatttagaaggtgtcatgtgagcgnaactggtggcgtgngggggagcttggtccagccgtgggggtccctgagtactctacctagtacagtcctctggattcgaggtttagngacgccgtaggactaaacgtcggtccgccgaggctccgaggggaacgggcgttgggacgtcgggtcgaccaacgtaagttaagaaagagtaggtaagtagaaggtaaaaactgttagacgggtactagtacggtaggtaacggggtccccggttttaaccgattacccgtaccgggtaacgggaacgaaccggtacccgaagtcggtacgtaagtttaaggcctatttaacgtttagaacgtaaaactaaacgtacggtaccgttggaacgacggacgaacggacgacgggtccttaagtacttagtacccgtagttcgtggtccgggtcgtacgggggtacctaacgtaggttacggtaacgttcgggtaacgggggacccgaaaccggggtacccgtaacccggttcccgtaacccggttcccttaaccccgg

SEQ ID NO: 26995 - DNA, 444 bp, Homo sapiens
  misc_feature: GYAE6OF01DH5EN.39.53.E09.1.454.CMB.1.raw
  modified_base (365)..(365): a, c, t, g, unknown or other
  misc_feature (365)..(365): n is a, c, g, or t
  modified_base (439)..(444): a, c, t, g, unknown or other
  misc_feature (439)..(444): n is a, c, g, or t
tcagtcgcactagtcacgaccggtgctcgatttagagagagtgtgttgggtttgggggaagaggaagactgacggtccgccaggctccagggaaggggctggagtgggtcgccaacattaagaaagatggaagtgagaaaaactatgtggactctgtgaagggccggtttaccatctccagggacaacgccatgcatttagcatatttgcaaataaacagtctgagagccgaggacacggcttcatatcactgtgcgctggggcactatggattctggggccaagggaccacggtcaccgtctcctcagcctccaccaagggcccatcggtctcccctgcgccctgctccaggagcacctcgagngcacagccggccctgggctgcctggtcaaggactactccatagtgcgactgagcgggctggcaaggcgcatagnnnnnn

SEQ ID NO: 26996 - DNA, 580 bp, Homo sapiens
  misc_feature: GYAE6OF01CAKDA.39.53.E09.1.454.CMB.1.raw
  modified_base (307)..(307): a, c, t, g, unknown or other
  misc_feature (307)..(307): n is a, c, g, or t
  modified_base (498)..(498): a, c, t, g, unknown or other
  misc_feature (498)..(498): n is a, c, g, or t
  modified_base (532)..(532): a, c, t, g, unknown or other
  misc_feature (532)..(532): n is a, c, g, or t
  modified_base (568)..(568): a, c, t, g, unknown or other
  misc_feature (568)..(568): n is a, c, g, or t
tcagtcgcactagtcacgaccggtgctcgatttagagagagtgtgttgggtttgggggtctcagagaggagccctagccctggactccaaggcctttccacttggtgatcagcactgagcacagaggactcaccatggaattggggctgagcttgggttttccttgttgcttattttagaaggtgtccaatgtgaggcgcaactggtggcgtcgtgggggagcttggtccagccgtggggggtccctgagactctcctgtacagcctctggattcaggtttagtgacgcctggataacgtgggtccncaggctccgagggaggggctgggagtgggtcgccaaacattaaagaaagagtaggaagtgaagaaaaactatagtaggactctggtggaacgggtccgttacatctcgaggacaacgcatgcattagcattatttagactaaaataaacagtactaggaagacgaccgaagaaccgacggtacttcattanactactgtgcgcgttaggggctacgtagtaggtnttcggtggggacccgaacgggacccgaacggtcccnccgtccgtcccg

SEQ ID NO: 26997 - DNA, 551 bp, Homo sapiens
  misc_feature: GYAE6OF01CHB9V.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaagttccgtagactcctgatctatgatgcataccaatttaacgaaccacggggtccctactctcgacttcaggtgggcggtgggtcgtgggacgagtattctactctcacctatcagcagcctgcctggcctagaatcttctcgactaactttacttactagtacaaagtatagtacgtagtcgtaccggtcggtaccggttccgggacccgagggaccgtaacgggtaaggaaacgtaaccgtaaacggtaacgtaggtcggtacgtgtaacccg

SEQ ID NO: 26998 - DNA, 537 bp, Homo sapiens
  misc_feature: GYAE6OF01EQ5MN.39.53.E09.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtagganacagagtcaccatcacttgccgggnagtcagggcattaggcattattagcctggtatcaacagcgaccggggaaggttcctagactcctgatctatgatgcatccaatttagaaccaggggtcccatctcgattcgagtggcgggtgggtctgggacagtatttcacgtctcacctatcagcagcctgctgcctgaagtactgctacgtactaacttactttaactgttaactaaaagtactaggactagtcggtaccgttgggtaccgttccggacccggtacgggacccgaaagggtacggtaaaacgtacgaaaacgtacgttcgtggtaccg

SEQ ID NO: 26999 - DNA, 596 bp, Homo sapiens
  misc_feature: GYAE6OF01BDI5H.39.53.E09.1.454.CMB.1.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagatcaccatcacttggccgggnagtcaggcattaggcatttattagcctggtatcaanagcaccgggaagttcagactcctgatctatgatcgcatacctaatttacgaaccgtacggggtaccccatccgtacgtagtttcaggtacggcggggtggtcgtgggtacaggtactttcacgttccttacgaccctagtcctaacgctaacggtcctcggtccgtcgtccgtaggaagtacgtggtacttacggacttaaacctttattaaccgttagttaacctaaaaggttactaggaacctggttaccgtcccggtacgggtaccgttcgggaccccgacggggaaaccaagggttacgaaacgtacgaaacgtacggtaggtcggtacg

SEQ ID NO: 27000 - DNA, 526 bp, Homo sapiens
  misc_feature: GYAE6OF01C69EB.39.53.E09.1.454.CMB.1.raw
  modified_base (398)..(398): a, c, t, g, unknown or other
  misc_feature (398)..(398): n is a, c, g, or t
  modified_base (435)..(435): a, c, t, g, unknown or other
  misc_feature (435)..(435): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccggcgagtcagggcattaggcatttattagcctggtatcaacagcgaccgggaagttccagactcctgatctatgatgcatccaatttagaaccagggtcccatctgattcagtgggtcggtggtctgggactagtactttcactcgtcacatcagacagcctgcttgcctggaagntgctagacctaactttattactagttactaaaagttntacgacgtagtccgttccggtacgggtaccgtttccggacccggtaagggacccaaagggttaggaaacttacgaaagtaacgtgtaggtc

SEQ ID NO: 27001 - DNA, 583 bp, Homo sapiens
  misc_feature: GYAE6OF01B7FNH.39.53.E09.1.454.CMB.1.raw
  modified_base (230)..(230): a, c, t, g, unknown or other
  misc_feature (230)..(230): n is a, c, g, or t
  modified_base (471)..(471): a, c, t, g, unknown or other
  misc_feature (471)..(471): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctcgctctggctcccagataccagatgtgacatccagactcgacccagtctccatcctcctgtctgccatctgtaggagacagagtcaccatcacgttcgccggngagtcgagggcattaggctattatttacgcctggtatcaacagtccgaccggggtaaggttccagacctcctgatctatgatgcatcaatttacgaacgcgggtccatctcgaatcgagtggacggtggtcgtgggactaggtacttccgactccgttaccacctatccgagactaacggcctgcttacgccgtagaagtatcgctgtaaccttaacgttattacgtataaacgtaaagtntacggtactacggtccggtacccggtagggtcccggttaccggaacccggtacgggtaaccggtaaagggtacgtaaacgtaacccgaaaacggtccgtggtacggtacccg

SEQ ID NO: 27002 - DNA, 619 bp, Homo sapiens
  misc_feature: GYAE6OF01CDJ4E.39.53.E09.1.454.CMB.1.raw
  modified_base (227)..(227): a, c, t, g, unknown or other
  misc_feature (227)..(227): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatcgacccagtctccatcctcctgtctgctatctgtagagacagagtcaccatcacgttggccggngagtcgaggctattacggctatttaattacgtccgtaggtactacaacgacgaccggaacccggggtaacgttccgtaggtacctaccgtagtactctagtgatcgacgtactactaaacgtttacgaaccgtacgggtccctatcgtacgtaattcgaggtcgggtcggtggtcgtagggactagtactttacgaccttctacacatcgacgctacgctgctcgacgtagaagtatcgtctacgtaactaactttacttaacgtacgttaactaaaggttctaagtacgtacgtccggtacccggtagggtaacccgttcggaacccggtacgggaaacccgtaagggtaacggtaaactaaaccggaaacgacgttcgggtacggtaccg

SEQ ID NO: 27003 - DNA, 606 bp, Homo sapiens
  misc_feature: GYAE6OF01BNEBV.39.53.E09.1.454.CMB.1.raw
  modified_base (231)..(231): a, c, t, g, unknown or other
  misc_feature (231)..(231): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatccctccctgtctgcatctgtaggagacagagtccaccatccacgttggccgggngagtcaggggcagttaggctattattagcctggtatcaacgacgcgaacccgggggagttccgtagacctcctgatctagtgatcgctactcctaagtttacgaaccgtacggggtccctatctcgtattcgaggtcgggcgggttgggtcgtagggacgtagtactttccaccgtctaccacctatccgagacagtccctgtctcgcctagaacgtatgctcgtactaactttacgttaccgttagtaactaaagttagtacgaacgtacggttcggtaccccggttgggtaacccggttccggaccccgggtaacggaaccgtaagggtaaaccggtaaactaaccggaaaccggtacgtgggtcggtacccg

SEQ ID NO: 27004 - DNA, 517 bp, Homo sapiens
  misc_feature: GYAE6OF01CFEYB.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatccctccctgtctgcatctgtaggagacagagtcaccatcacttggccgggcgagtcagggcattaggcattattagcctggtatcaacagcgaccggggaaggttcctagactcctgatctatgatgcataccaattttacgaacctaggggtacccatctcgattcagtggcggtgggtctgggactagatttcactctcacatcagcacgcctgctcgcctagaagatgctcgactaacttattactagtaacaaagtatagactgtacgtccggtaggtccgttaccggccgacgggaccaagggtacggaaactacgaaataacgtggtgtaccgg

SEQ ID NO: 27005 - DNA, 736 bp, Homo sapiens
  misc_feature: GYAE6OF01BRBPN.39.53.E09.1.454.CMB.1.raw
  modified_base (171)..(171): a, c, t, g, unknown or other
  misc_feature (171)..(171): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatcgaacccngtcctccatccctccctgtctgcatctggtagagacaggactcacctatacctacgtcggccgggtacgaggtcgagggacctaagttaggactaagtttagtttacgccgttaggtactaccaaacgagacccggaaccggggtacgtacctacgacctcctagactactatgaatgactaactactaaacttaacggaaccgtacgggtaccctactactacgtagttcggaaggttcgggtacgggttcgggttacgtacgggactaacggttacttccgtacgtaccttaccgaacctacgtaccgaacggtaccgtaccggtcccgttacggtccgttccggtaaccgttacggaaagttccggtaccggttacgtaacccggttaacctttaaaccgtttaaacgtttaaccgtaacggttaaacgtaaaacgtacgtaacggtacggtaaccgttccgggttacccggttacgggtacccggtaccgggtacccggtaaacgggtaccggtaaggtaaacggtaaacgtaaccaaaggtaacgttacggcggtaaccg

SEQ ID NO: 27006 - DNA, 689 bp, Homo sapiens
  misc_feature: GYAE6OF01CITKR.39.53.E09.1.454.CMB.1.raw
  modified_base (198)..(198): a, c, t, g, unknown or other
  misc_feature (198)..(198): n is a, c, g, or t
tcagtcgcactagtcacgaccggtgctcgatttagagagagtgtgttgggtttggggcagaagtctctctcagtcagggcacagcatggacatgagggtccctgctcagctcctgggactcctgctgctctggctcccagataccagatgtgacatccagatgacccagtctccatcctcctgtctgcatctgagganacagagtcaccatcacgttcggccgggcgagtcgagggctagttaggactatttaacgtttacgccgttaggtatacaaacgacggaccggaaccggggtaagttccgtagacctccgtagtatactatgatgactatactaagttacgaaccgtacgggtcccagttctacgtacttcgaggtcggtcggtggtcgtaggactaggtactttcacgttctacgacctatcgacgtaccacgcccgttagccttacggaccgtaggtaaacgacgttaccggtactaccggttaaccttaaacgttttaagttaccgtaacggttaaacgtaaaacgggtttctaacggtaacccggtttacggttccggttaccccgggtaacggggttacccggttaacccggggaccccggtaaacggggtaccgtaaaacggggttaaccgaaaacgttaaccggtaaaacggttaacgtcgggttaaccggtaccg

SEQ ID NO: 27007 - DNA, 532 bp, Homo sapiens
  misc_feature: GYAE6OF01D12W6.39.53.E09.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
  modified_base (526)..(526): a, c, t, g, unknown or other
  misc_feature (526)..(526): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctcctgtctgcatctgtagganacagagtcaccatcacttggccggggcagtcagggcattggcattattagctggtatcacagcgaccggggagttcctagactcctgatctatnatgacatacctaattacgaaccgtacggggtcccatctacattcgaggtcggcggtgggtgtggactagtactttacacttctaccactatcagcagcctagctgcctagagatgctagactaacttattactagtaactaaagtacagtactaggttccgtaccggtcggtaccggttacccggaccggtaacgggaaccgaaagggtacgaaactaacgaaagtactggngtaccg

SEQ ID NO: 27008 - DNA, 561 bp, Homo sapiens
  misc_feature: GYAE6OF01DOPPL.39.53.E09.1.454.CMB.1.raw
  modified_base (257)..(257): a, c, t, g, unknown or other
  misc_feature (257)..(257): n is a, c, g, or t
tcagtcgcactagtcacgaccggtgctcgatttagagagagtgtgttgggtttgggggtctcagagaggagccctagccctggactccaaggcctttccacttggtgatcagcactgagcacagaggactcaccatggaattggggctgagctgggttttccttgttgctattttagaaggtgtccaatgtgaggcgcaactggtggcgtctgggggaggcttgggtccagcctggggggtcccctgagactctccngtacagcctctggattcaggtttagtgacgcctggataaactgggtccgccaggctccgaggggaaggggctgggagtgggtcgccaacgattaagaaagataggaagtgaagaaaaactatgtggactcgtgtggaagggtccggtttaacatctccgagggacaacggccagtgactatttagactatatttgactaaataaacagttctagagagccgaagacacggcttcatatcactgtgcgcgtgggcactagtggacttcgtgggacccgagggaccacggtccaccgtcgtacccg

SEQ ID NO: 27009 - DNA, 700 bp, Homo sapiens
  misc_feature: GYAE6OF01DFXQS.39.53.E09.1.454.CMB.1.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatcgacccagtctccatcctccctgtcctgtatctgtagganacagagtcaccatcacttggccgggnagtcgagggcattaggctattatttagctggtatacaacacgcgaacccgggggaaggttccgtacgtactcctgatctactgtatgacactacctaatttaacgaaccgtacggggtccctactccgttcgtattacgaggtcgggcgggtcgggtcgtgggactagtacttactactctaccactatcacgcacgcctgctcgccgtagaatagtcggtccttacggtaaccttaacgtttaacgtttaacgttaccggtaaacttaaaacgttaagttacgtaaccggttacggttacccggttaccccggggttaccgggtacccggtttaccccgggggaacccgggttaaacccggggggtaaaacccgttaaaacgggggttaaaccgggttaaaaaccgttaaacccggtaaaaaacccggttacgggtttaaacccgggtagggtaccccggttaacccggg

SEQ ID NO: 27010 - DNA, 747 bp, Homo sapiens
  misc_feature: GYAE6OF01B9OKP.39.53.E09.1.454.CMB.1.raw
tcagtcgcactagtcacgaccggtgctcgatttagagagagtgtgttgggtttgggggtctcagagaggagccctagccctggactccaaggcctttccacttggtgatcagcactgagcacagaggactcaccatggaattggggctgagcttgggttttccttgttgcttattttagaaggtgtccaatgtgaggcgcaacgtggtggcgtcggtgggggagcgttggtccaggccggtggggggtccctggacgactctccgtgtacacgtcctcgtggattcgtaggtttagtcgaccgccgtaggaataacgtcgggtccgccaggcctaccggaggggaaggggtctagggacggtcggggtccacccaaagtaagttaaaaggaaaagtagtagggaaagtagaaaagtaaaaactgtagtaggtactcggtaggtaacgggtaacgggtacccggtttaacacgttccgtaccggaacggggaaccaaccggacctagtacgtacgttaagtttacggaacttaagtttaagttacgaaactaaaacttaaacgtagtacgtacggaacggaacggtaccggaaacggaacgtaccgggttacttaccgaagttacgttacgacgttcgggtagtaccggtcggtacggggacctacggttagtacgggtaccgttaccgggacggggtacccgtaaacggggaccccgtacggtaccctacccggttccgtaaccccg

SEQ ID NO: 27011 - DNA, 572 bp, Homo sapiens
  misc_feature: GYAE6OF01D4329.39.53.E09.1.454.CMB.1.raw
  modified_base (399)..(399): a, c, t, g, unknown or other
  misc_feature (399)..(399): n is a, c, g, or t
  modified_base (443)..(443): a, c, t, g, unknown or other
  misc_feature (443)..(443): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatcgacccagtctccatccctccctgtctgcatctgtaggagacagagtccaccatcacgttggccgggcgagtcagggcagttaggctatttatttagccttaggtatacaacgacggaccggaacccgggggtaaggttccctacgacctccctagtactctatgatgcactactaagttacgaaccgtacgggtccatctgattcgaggtcgggcggtggtcgtagggactagtnttccacgtctcactagtcacgcacgcctgtctcgcgtagaagtntacgctgtaaccttactttattacttagtaactaaagtatagtacgtgttccggtacccggtacggtccggtaccggacccggtacggaccgtaaggaacgtaaactacgaaacggtactggtcgtacg

SEQ ID NO: 27012 - DNA, 771 bp, Homo sapiens
  misc_feature: GYAE6OF01CF97K.39.53.E09.1.454.CMB.1.raw
  modified_base (203)..(203): a, c, t, g, unknown or other
  misc_feature (203)..(203): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgacatccagatcgacccagtctccactcctccctgtctgcatctgtagganacagacgtcaccatcacgttcggccgggcgagtcgagggcagttaggctaattatttacgcctggtatacaacagaccgaccggggtaacgttcctagactcctagactcgtatgatcgactactactaagtttacgaaccgtacggggtaccctagtccgttacgtacgttacgacggtcggggtacgggttcggggtacgttacggggaaacgttagggtttaaccttttacccgaacccgtttcccttaacccgtaaccccgtaattacccggtaacggacctaaaccggtcccgttacggtacccgttaccggtaccgttaacggaaacgttacgtccgtaccgttaaccgttaacctttaaaccgttttaaccttaacgttaacggttaaaacgttaaaacggttacgttacgtaaccggttaacgggtttaccccgggttacccgggttaaccgggttaacccgggtttacccgggaacccgggtaaacgggggtaaccggtaaacgggtaacggtaaaacgtaaccgaaaacggttaggttacgggtcggccgttaaccgg

SEQ ID NO: 27013 - DNA, 684 bp, Homo sapiens
  misc_feature: GYAE6OF01BSZKG.39.53.E09.1.454.CMB.1.raw
  modified_base (156)..(156): a, c, t, g, unknown or other
  misc_feature (156)..(156): n is a, c, g, or t
  modified_base (285)..(285): a, c, t, g, unknown or other
  misc_feature (285)..(285): n is a, c, g, or t
  modified_base (488)..(488): a, c, t, g, unknown or other
  misc_feature (488)..(488): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctacgtgctctggcctcccagactaccagtatgnacatccagatcgacccagtcctccactcctcctgtctgccatcgtagaggacacagatccacatccgtagtccgggaccggcgaagtcgagggctaagttaggactaattagtttacgccgtaggttanaccgaacgaggtacccggaacccggggtaaggttccctaaggtaccttcctaggtacttcctaagtcgtaatcgactaactaacctaaagttaacggaaacccggtacgggtccctaagtaccgtacgttactacgaggtacgggtccggttagggtcgtagggaactagtacgttcactctaccgactatacgataaccgcnccgtacgccgttagacccgtaagtaagaacgttcacgttaagaacctttaaccttagttactaaacgaacgtaaagttacacgtaacgtaggttcccgttaccgggtacgttaaccggtccggaccggtaacggtaacccgggaagtaaccggaaaactaccggtaaaacgtacggtacggtacgtcggtaaaccg

SEQ ID NO: 27014 - DNA, 681 bp, Homo sapiens
  misc_feature: GYAE6OF01E130Z.39.53.E09.1.454.CMB.1.raw
  modified_base (642)..(642): a, c, t, g, unknown or other
  misc_feature (642)..(642): n is a, c, g, or t
  modified_base (646)..(646): a, c, t, g, unknown or other
  misc_feature (646)..(646): n is a, c, g, or t
  modified_base (648)..(649): a, c, t, g, unknown or other
  misc_feature (648)..(649): n is a, c, g, or t
  modified_base (651)..(652): a, c, t, g, unknown or other
  misc_feature (651)..(652): n is a, c, g, or t
  modified_base (654)..(654): a, c, t, g, unknown or other
  misc_feature (654)..(654): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
  modified_base (660)..(669): a, c, t, g, unknown or other
  misc_feature (660)..(669): n is a, c, g, or t
  modified_base (671)..(672): a, c, t, g, unknown or other
  misc_feature (671)..(672): n is a, c, g, or t
  modified_base (674)..(678): a, c, t, g, unknown or other
  misc_feature (674)..(678): n is a, c, g, or t
  modified_base (680)..(681): a, c, t, g, unknown or other
  misc_feature (680)..(681): n is a, c, g, or t
tcagtcgcactagtcacgaccggtgctcgatttagagagagtgtgttgggtttggggggaagaggaagactgacggtccgccaggctccagggaaggggctggagtgggtcgccaacattaagaaagatggaagtgagaaaaactatgtggactctgtgaagggccggtttaccatctccagggacaacgccatgcatttagcatatttgacaaataaacagtctgagagccgaggacacggcttcatatcactgtgcgcgtggggcactatggattcgtgggaccgaagggaccaccggtccaccgtaccgtccctcacgccctacccaccgaacgggcccctacgtccgggttcccgtttcccccccgtcgggtccccgtcccccgttcggccccgttacccgaacgggaccggacccgtacccccgtacccggaacgggaaccgaccgaaccgaaccgggtcccggggtacccccggttcgggggcccgttccggtaccccggttcggggtaacccgtaaaccggggttacccttaacccgtttacccgtaacgtacggttaccggacggtaaccgttcgggaacgggtccggggtacgtacggggaccgtaaacggggccgtaccgtaaggttacggngcgngnngnncngncncnnnnnnnnnncnncnnnnngnn

SEQ ID NO: 27015 - DNA, 572 bp, Homo sapiens
  misc_feature: GYAE6OF01DFUK2.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctcctgtctgcatctgtaggagacagatcacatcactggccgggcagtcgaggcattaggactatttattagcctaggtatcaactagacgaccggggaagttcctagactcctgatctatgatgacactactaatttacgaaccgtagggtccctatctcgattcaggtggcgggtgggtactgggactagtactttcactactcacatcaagacacgcctgtcgtcggacctggtaagagtagtctagacctaaactttaattaccgtagtaactaaaagttatagaacgtaggtccggtacccggtacgggtaaccgttaccgggacccgtaacggggaaaccgtaaagggtaacggtaaagtaaacaaacggtaaacgtggtacggtacg

SEQ ID NO: 27016 - DNA, 792 bp, Homo sapiens
  misc_feature: GYAE6OF01DUH3R.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctccgtgggactcctactgctctggcctccagactaccagatgtgactatccagatcgaccagtcctcctactccctcccgtgtctgctattcgtaggtaacggacgacagtacgtaccaaccacttacctaccgttcgggaccggggcgtaacggtcggaaggggtacctaagttacggacttaagtttttagtttaacggccgtttaggttaactaccgaaaccgcggacccgggtaaacccgggggttaaccgtttaccctacgtaaccgttccgtagtactttacgtacgtagtacgtcgactacgtaaccttaaagtttaccggaaacccggtccgggtaaccctactccgttacgtacttacggagggttcgggacggggtttggggttccggtagggaacccgttaagtttactttaccgtaaccttccgtacctaacgtaacttccgaacgtctaccggtcctaggtccgtccgtaccgtaggaacgtgtccggtactacggtaaccttaaacttttacgttacgttaacgtaaacgtaaacggttactacggaacgtttaccggttcggttaccccggtaggggtttacccgtcccgggaaccgggtaacgggtaccgtaaaggggttaacgtaaaccgtaacgtaaaccggtaggtcggtcggtcgtaaccg

SEQ ID NO: 27017 - DNA, 533 bp, Homo sapiens
  misc_feature: GYAE6OF01DYWT1.39.53.E09.1.454.CMB.1.raw
  modified_base (422)..(422): a, c, t, g, unknown or other
  misc_feature (422)..(422): n is a, c, g, or t
  modified_base (455)..(455): a, c, t, g, unknown or other
  misc_feature (455)..(455): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctcctgtctgcatctgtaggagacagagtcaccatcacttgccgggcagtcaggcagttaggctattattagcctggtatcaacagcgaccgggaaggttcctagactcctgatctatgatgcatcctaaatttacgaaccgtacggggtcccatcgtacgtagttcgaggtgggacggttggggtcgtgggactagtactttctacgtctacaccatcagcacgtctgctcgaccgtagaagntgctgactaacttattactagttaacaaagttnagacgtagtcggtaccgtggtaccgtcggacccgagggaccgtaaggaggtaaactacgaaagtacgtggcggtaccg

SEQ ID NO: 27018 - DNA, 619 bp, Homo sapiens
  misc_feature: GYAE6OF01EVWW1.39.53.E09.1.454.CMB.1.raw
tcagtcgcactagtcacgaccggtgctcgatttagagagagtgtgttgggtttgggggtctcagagaggagccctagccctggactccaaggcctttccacttggtgatcagcactgagcacagaggactcaccatggaattggggctgagctgggttttccttgttgctattttagaaggtgtccaatgtgaggcgcaactggtggcgtctgggggaggcttggtccagccgtgggggtccctgagactctcctgtacagcctctggattcaggtttagtgacgcctggataaacgtgggtccgccgaggcctccgaggggaagggcgtggaggtgggtcgccaacattaagaaagatggaagtgaagaaaactgtagtgactctaggtgaacggggtccgtttaaccagtctaccgagggaccaaccggccatcgactattagctaatatttagactaaataaactacgtactaggagacgaccggacggacgaccggctttacaattactaccatcggtcgccggtcgtcggggcctaccgttagtcgggttacttccggtacggggaccgtaaaccggggacccgtaaccgggtcccgtacccgtccttaccccg

SEQ ID NO: 27019 - DNA, 587 bp, Homo sapiens
  misc_feature: GYAE6OF01EN0HH.39.53.E09.1.454.CMB.1.raw
  modified_base (202)..(202): a, c, t, g, unknown or other
  misc_feature (202)..(202): n is a, c, g, or t
  modified_base (582)..(582): a, c, t, g, unknown or other
  misc_feature (582)..(582): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatccctccctgtctgcatctgtagganacagagtcaccatcacgttggccgggcgagtcgagggcagttaggctatttattagccttggtactacaacgacggccgaacccgggggtaagttcctagacctcctagatctatgatgactactaccgtaaagtttaacgaaccggtacggggtacccctaagttcctacgtacttcgaggttcgggtcgggttagggtcgtagggactaggttactttccgacttcctaccaacctatccgagcacgcctagcctcgtcgtgaagtctcgtactgacttaacgtttattactagtaactaaagtatagactagtccgtaccggtaggtccggttccggaccgtagggaaccgaaggtacgtaaactacaaagtctggngtacg

SEQ ID NO: 27020 - DNA, 888 bp, Homo sapiens
  misc_feature: GYAE6OF01CG5FL.39.53.E09.1.454.CMB.1.raw
  modified_base (145)..(145): a, c, t, g, unknown or other
  misc_feature (145)..(145): n is a, c, g, or t
  modified_base (151)..(151): a, c, t, g, unknown or other
  misc_feature (151)..(151): n is a, c, g, or t
tcagtcgcactagtcacgaccggtgctcgatttagagagagtgtgttgggtttgggggcagaagtctctctcagtcagggcacagcatggacatgagggtccctgctcagctctgggactcctgctgctctggctccagataccngatgtnacatccagatgacccagtcctccactccctcctgtctgctatctgtaggagacagacgtccaccacttccgacgttcggccggggtacgaggttaccgacggggtactacgtttaaggtaccttaagttttaacgtttacggtacccgttagggtttaacttaccgaaaacgtaccgggtaaccccgggtaaacccccggggggttaaacgggttttacccgttaaaccggtaccgtttacccgtttacggtattacccgttaattgggtaactcgtaccgtaacttaacccgtaaagtttttaaacccggaaaccccgtaacgggggtttacccctaacgtttaccgttcgttaacgttacccgtaggggttcgggttaccgggggttcgggttaccggttacggggtaacgttaaggtttaacgtttacccggttaacccttaccgttacccctaaacccttacggtttaacccgacggtaacccgtcggttacccgtcggttaacccgttccggtaaccgtacggtaaacggttacgttaccgtacgttacgttaaccgttaacctttaacgttaaccgttaacgttaaacgtaaacgttacgttacggaacgttaccgggtccggttaccggtaacgggttcccgtaccgggtaacccggtaacgggaacccggttaaacgggtacgttaaaaccggtaacctaaaccggtaacgttccgggtcgtacccggg

SEQ ID NO: 27021 - DNA, 897 bp, Homo sapiens
  misc_feature: GYAE6OF01B3QPY.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatcgacccagtcctccactccctccctgtctgcatcgtgtaggagacagacgtcaccatcacgttcggaccgggcgagtcaggggctagttaggcctaatttatttacgtccgttaggtactacaaaccgacggaccggtaaccccggggggtaaggtttcccgtaacgtaccgttcccgttaggtaacttaccgttaagttcggtaattcggtacctaactttaacccgtaaaagttttaaacggaaacccggtaaccggggttacccctaacgttaccttaccggtaactttacgtacggggttcggggtccgggggtttacggggttccggttaagggggaacctaaggttacgtttttcccaccgtttccgtaccaacccgttactacgtaacgccgtaaccgtcccgttcggtccgttaccggaccccgttaaggtaaaggtacgttacggtcccgtttaacgtaaacccgtttaaacccgttttaacgttttaaccggttaacgtttaaaacccgtaaaaagggttttacgttaaccggtaaacccgtttaaccggggtttccgggttaaaccccccgggggttacgggttaacccccggggtttacccgggaaacccccggggttaaaaccgggggtaaccccggtttaaaaagggggtaacccgggttaaaaaaccgtaacccgggttaaaaaacggttccgggttaacggggttcccgggtaacccg

SEQ ID NO: 27022 - DNA, 1028 bp, Homo sapiens
  misc_feature: GYAE6OF01AER9B.39.53.E09.1.454.CMB.1.raw
tcagtcgcactagtcacgaccggtgctcgatttagagagagtgtgttgggtttggggcagaagtctctctcagtcagggcacagcatggacatgagggtccctgctcagctcctgggactcctgctgctcgtggcctcccagactaccgagtagtgtagactactccagactcgacccagttcctaccactcccgtccgtgtactgctactcgtaggtacggactacgagtacgtccaacctatccgtacgttcgggccggacgtacggtacgacggtcctaagttacggtacttaactttacgtttaacgcgttaggtacctaccgaaacgtacccgggtacccgggtaaacccggggttacgttacccgtacggttaacccgtccgttaagttacgtaccgttaggtagtaaccgttcggtaaccgttaaccttaaccgttaaacgtttaacccgggaaccccgggttaaccgggttcctaacgttaccggttaacccgttaccgtttaggtaccggggtttaacggggtccgggtttacggggttaccgttaaacggggttaacccgttaacgttttacccgtttaccgtaaccctttacccgggtaacccgttaaacccggtttaacgtaccccgtaaaccgggtcccgtttaaacccgggtccccgtttaggtacccccggttaacccggttaaacccgggttaaaggttaaacccggttcggttaaccccgttcgtttaaaacccgttcgtttttaaaaaccctaaccgggtttttaacccgtaaaagggttttaaacccgtaaacgtttacggtaaccccgggttaaacgtttcccggggtttaaccccgggtacccggggttaaacccgggtttttcccccggggaacccgggaaacccccggggttaaaagggtttaaacccccgggtttaaaacgggaaaccgggttttaaaaacccggtaacccggttaaaccgggggtttaacccctttcgggggtaacccgggttaaacccccgg

SEQ ID NO: 27023 - DNA, 744 bp, Homo sapiens
  misc_feature: GYAE6OF01EF7A4.39.53.E09.1.454.CMB.1.raw
  modified_base (204)..(204): a, c, t, g, unknown or other
  misc_feature (204)..(204): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctccagataccagatgtgacatccagatgacccagtctccactccctccctgtctgctatcgtgtagganacagagtccaccatcacttcggccgggcgagtcgagggctaagttaggctaactttatttagccttaggtatacaacgcggaccggaacccgggggtaacggttccgaagtaccttccgtagattctatagtatcgactataccctaaagtttaacggaacccgtacggggtcccaatcgtacgtacttcgagggtcgggtcggggttaggtcgtagggactacgtacgtttccaccgttactaccaccgtaattaccggaacgaccgtaccggtccttacggtcccttcgggtacccgttaagggaaagttcgtaccgtacttaacggttaaccctttaaacgttttacgtttaaaccgttagttaaaaccgtaaagggttattaccggggaacttaccgggttacccgggttacccggttaacgggggttcccccggttaccgggggaaacccccgggtaaggggtaaaaccccggtaaaggggtaaccggtaaaaactaaacccggaaaccggttaacgttgggggtaccgtaccgg

SEQ ID NO: 27024 - DNA, 747 bp, Homo sapiens
  misc_feature: GYAE6OF01CGTHX.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctactgctctggcctcccagataccagatgtagacatccagatcgacccagtctccatccctcctgtctcgactatcgtaggtaggacgacgagtacgtaccaacctactcctacgttcgggccgggacgtacggtacgaagggctaagttacggctaatttacgtttaacgccgttaggtaacttaccgaaacgtacggaccggaaccccgggggtaacggttacccgtaacggtaccgtacccgtagtaacttacgttagtagtagtacgacctaacttaaccgttaaagtttaaccggaacccggtaaccggggttaccctacgttaccgttaacggtacttaccgaagggttcggggtcggggtttacgggtcggtacgggtaacgtagttactttaccgtactcctaccgaacctacgtcgtacacgtacgccctgtccgttacgtaccgtatacggtagtcgtacgtacgtaacttaactttagttacgttacgtaaagtaaagttacgtacgaacgtacggttcggtcccggttacggtaccggtcccggaaccggtaacgggaccggtaaaggtaacgtaaaccgtacgaaacggtagtaccggtgtccgtaaccgg

SEQ ID NO: 27025 - DNA, 261 bp, Homo sapiens
  misc_feature: GYAE6OF01DUROT.39.53.E09.1.454.CMB.1.raw
  modified_base (250)..(261): a, c, t, g, unknown or other
  misc_feature (250)..(261): n is a, c, g, or t
tcagtcgcactagtcacgaccggtgctcgatttagagagagtgtgttgggtttgggacagatttcactctcaccatcagcagcctgctgcctgaagatgctgcaacttattactgtcaaaagtatgacagtgtcccgtggacgttcggcccagggaccaaggtggaaatcaaacgaactgtggctgcaccatctgtcttcatcttcccgcatctgaactgtgcgactgagcggctggcaaggcgcatagnnnnnnnnnnnn

SEQ ID NO: 27026 - DNA, 713 bp, Homo sapiens
  misc_feature: GYAE6OF01C6BYP.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggcctcccagataccagatgtgacatccagatcgacccagtcctccatccctccctgtctgctatctaggtaggacgacagacgtccactatacacgttcgggccggcgagtaccgagggctagttaggctaatttacgttacgtccgtaggtactacaacgtacgaccggtaaccgggtaacgttacctacgaactccgtagtactctagtgatcgactactacgtaacgtttaacgaaccgtacgggtaccctacgtactacgtacttcggaggttcgggtacgggtcggtacggtacggaacgttacgtacgtttactaccgttcctaccgaacctacgtacgaacgaccgtaacgtcccgtacgtccgttaccggtaccgtaaggaaacgttgtaccgacgttaccgtaacttacgtttaatacgttaacgtaaacgttaagtacgtaacgtacgttacggtacccgttaccggtacgggttaaccggtacccggaacccggtaacgggtaaacccggtaagggttaaaacgtaaaccggtaaacgaaaccgggttacgttcgggtcgtaaacccgg

SEQ ID NO: 27027 - DNA, 870 bp, Homo sapiens
  misc_feature: GYAE6OF01CYX7V.39.53.E09.1.454.CMB.1.raw
tcagtcgcactagtcacgaccggtgctcgatttagagagagtgtgttgggtttgggggcagaagtctctctcagtcagggcacagcatggacatggacgggtccctgctcagctccgtgggactcctactgctctcggctcccagactaccagatgtacgacatccagtactacgacccctagtcctaccctacctcccgttccctggttcctcgcctagttcgttaggaaggacgacaaggtctaccaacctactcgtacgtcgggccgggacgacggtacggacgggacgtaagttacggtacttaacgtttagtttaccggtaccggttaggtaactaccgtaacgaccgggaaccccggtaaacccgggggggtaaccgtttaccgtaccgtaccgttaccctaggttacttaccgtaattcgagttacgtactaaccgtttaaaccgttaaacggtttaaaccggaaccggtaacccggggttaacctacgttacccggttacgtacgttacggtacggttcggggtcggggtttacgggtaccgggtagggtaaccggttaacgtttaccgtttaccgtaacccgttaccgttaaccctacccgtaagttacccgacggtaccgtaccgtccgtacggtacccggtttgaacccgttaaggacgttaaacggtcgtaacggttacccgttaacgttaaaaccgttaccgtttaacggtaaacgtttaaacgtaaacgttacggtaaccgtaacgggtacgtttacccgggtaccggtacccgggttacccgggtacccgggaacggtaacccgggtaaggttaccggtaagtaacgtaacgtacgtacggtagcgtactaccgg

SEQ ID NO: 27028 - DNA, 725 bp, Homo sapiens
  misc_feature: GYAE6OF01EIJ34.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctactgctctggcctcccagataccagatgtgacatccagatcgaccctagtcctccactccctccctgtctgcattcgtgtaaggagacagacgtcacatcacgttcggccgggacgtagtcgagggtactagttaacggcttatttaagtttacgccgttaggtactacaaacgacggaccggaacccgggggtaaggttcccgtaacgtacccgtaccgttagtaacgtttaccgtaagtacgtatcggacttaacttaacctaaacgtttaacggaaacccgtacggggtaccctacgttccttaccggtatttaccggtaggtacgggtcggggttgggtacggtagggtaacgtacgtacgtttccaaccttcgtaaccaccgtatacgagcctacgtccctgtactacgcgtagagtatcgtctacgtactaacgtttacttaacgtacgttaaaccgtaaagttcgtacgaacgttacgtacccggttaccggtacggttacccgggtacccggtaaccgggtaaccgggtaaacccgaagggttaaaccggaaacttaaccggaaaccggttaagttcggtacgtcgtaaccgg

SEQ ID NO: 27029 - DNA, 726 bp, Homo sapiens
  misc_feature: GYAE6OF01D53MS.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgacatccagatcgacccagtctccatccctccctgtctgcatcgtgtaggagacagactcaccatcacgttggccgggcgagtcgaggcagttaggactatttatttacgcctaggtatacaacaggaccgtacccgggggtaagttcctagtacctccgtgtactctagtgtatcgactacttacctaaagttacgaaccgtacggggtacccattccgtacgtacgttcgtaggtcggggtcgggtgggttccgtaggggtactaacggttactttccgtaccttacctaccgaactacttaccgagtaccgtacgcccttagtccgttcgtaccgttaggaacgtagttcgtacctacggtaaccttaacctttaacgtttaaccgtaaggttaaaccgttaaaagttacgtacgggtaacgtacgggtttaccggttaccccggggttaacgggttacccggttacccgggtaccccgggtaaggggtaaaccccggtaaacggggtaacgttaaaaccgttaacccgtaaaaaccgggtacggttacgggtaccggaccgttaacccgg

SEQ ID NO: 27030 - DNA, 712 bp, Homo sapiens
  misc_feature: GYAE6OF01EVAZ3.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctactgctctggcctcccagataccagatgtgacatccagatgacccagtctccatcctccctgtctgcatcgtagtaggagacagacgtcaccatcacgttcggccgggacgagtcgagggcagttaggctaagtttatttacgccgtaggttactacgaacacggacccgaacccgggggtaaggttccgtaacggtacctccgtagaacttcgtaattggaactggtacctaacgttaccctaaaacgttttaacggaaacccggtacggggttacccacgttctacgtaagttaccgtaggtgggtaccggggttacgggttcggtacgggaaactaggttaccgtttactaccttacctaccgtaaccgtactacgacgtacgacgtcccgtagtccgtacgtaccgtagaagtcgtctacgtacgaacgttaactttaacgttacgttaacgtaaacgtaaacgtcgtaagtacgaacgttccggtacggtacggttaccgggttcccggaccggtaacgggaacccggtaaagggtaaaccgtaaagtaaccgtaaaaccgaaggtcgtacggcgtaacccgg

SEQ ID NO: 27031 - DNA, 731 bp, Homo sapiens
  misc_feature: GYAE6OF01A57S9.39.53.E09.1.454.CMB.1.raw
  modified_base (617)..(617): a, c, t, g, unknown or other
  misc_feature (617)..(617): n is a, c, g, or t
  modified_base (629)..(629): a, c, t, g, unknown or other
  misc_feature (629)..(629): n is a, c, g, or t
tcagtcgcactagtcacgaccggtgctcgatttagagagagtgtgttgggtttgggggtctcagagaggagccctagccctggactccaaggcctttccacttggtgatcagcactgagcacagaggactcaccatggaagttgggctgagcttgggttttccttgttgtcttagttttagaaggtgtccaagtgtgaggcgactaacgtggtcggtcgtcggtgggggagtcgttggtccgagccggttcggggggtcccctagacgtacctccgtcctagtaccgaggtccctgtggtacttcgtaggtttagtcgtaccgtccgtaggtaactaaaccggtcggggtacccgccgtacggtccgtaccggaagggggtaacgggtcggtagggaggttccgggtacgtaccccgaaagtaacgttaaaaggaaagtacgtaagggaagtaagaaagtaaaacgtgtggacgtaactcgtaggtacggtaacgggtcgttaaccattccggtaccgaaggtaaccacgtaccgagtacgacttaagttacgcttattactagtactaaaacagtatacgagtaacgagaccgagaccgacgttacctataacgtntacgacgttcgnggtacgtcggtacggacgtacgttaggtgtaacccggttcgggaaccgggaaccggtaaccgggtaccgtaacccgggtccttacccggtcccgttacccgg

SEQ ID NO: 27032 - DNA, 815 bp, Homo sapiens
  misc_feature: GYAE6OF01DNGIA.39.53.E09.1.454.CMB.1.raw
  modified_base (574)..(574): a, c, t, g, unknown or other
  misc_feature (574)..(574): n is a, c, g, or t
  modified_base (740)..(740): a, c, t, g, unknown or other
  misc_feature (740)..(740): n is a, c, g, or t
tcagtcgcactagtcacgaccggtgctcgatttagagagagtgtgttgggtttggggtctcagagaggagccctagccctggactccaaggccctttccacgttggtgatcagcactgagcacagacggactcaccagtggaagttggggctggacgcgtttcggttttccttggttgcttagtttttagaaggttgtaccaatgtgacggcgactaacgtggtcggcgtcggtagggggcgtcgttcggtccgacgtccggtcgggggtccctggaacgtctccgtaccgtcgtactacggtcccttgtaggttacgttcgttaagggttttaacggtacggtaccgccgttagggtaacgttaaaacggtccggggtcccaccgtaacgggtccgtaccggggaacggggtacgggcggttacgggtacggtacggggtcccaaccgtaaacgtaaggtttaaaaaggaaaggtaaggtaagggaaaggtaacggaaaacgtaaaaaacggtcgtaaggttacggtaaccttcgggttaaggtacggggtaacggttacccggtttaaaccncgtaccggtaccgaacgggtacccgaaccgtcctagtacgtcgttaagttcaacttagttaattacggaacttaaaacgaaacgtcgttaacgaggtacgtaaccggggaccaaccgggtacgtacccggtcctttacgaaacttgtacccctaggttcgcggtcncgggtgaacgttcgtatgggtcccgttggaccgggaccgtaacgggaccgtacccgtacggtcccttagtccccg

SEQ ID NO: 27033 - DNA, 947 bp, Homo sapiens
  misc_feature: GYAE6OF01ECOAL.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatcgacccagtctccactcctccctgtctgccagtctgtaggagtacagtacgtaccacctacttcgaccgtttcggaccccggggtacgacggttaccggaacggggtcctaaggtttacggtaccgttaagtttaacgttttaacggtcccgtttagggtaaaccttaccgaaaacccggacgggtaacccccgggtaacccccgggggggttaaaacggtttaccccggtaaacgggtacccccgttcccggttaaccggtaactttacccgttaagttaccgtaacgttaccggtacctaaacgtttaaccccttaaaacggttttaaccggaaacccggttaccgggggttaccccctacgttaccgttacggttaaccgtttccggtaaggttccggggttcgggggtttaccggggtcggttaacggggtaccgttaagggttaaccgtttttcccgaacccgtttcccttacccgtaaaccccgttacgtaaccgtaaccgaccgttaacccgtcccggtttccgtaccgttaccgtacccggggttaagtaaaccggtgtcccgtaacgttacggtaaccttaaacctttacgttaaccgttaaacgttaacgtaaaagttacgtacggtaaccgtttagggttaccccgggttaccgtagggtttcccccgggtaaccggtacccccggggtaaaagggaacccgggttaaaggtaaaccccgggtaaagttaaacccgaaaacccggtttaacgggtaccggtacgggtacccgg

SEQ ID NO: 27034 - DNA, 729 bp, Homo sapiens
  misc_feature: GYAE6OF01EP02W.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgacatccagatgacccagtctccatcctcctgtctgcatctgtaggagacagagtcaccatcacgttcggccgggcagtcgaggcagttaggctattagtttagcctaggtactacaacgtacgccgtaacccggggtaaggttcctaaggaccttccgtagtactcgtatagtatgactactacctaaacgtttacgaaaccgtacggggtccctagtaccgtacgtacttacgtaggtcggggtacgggttcgggtacgtacggggtaacctaaggttacttttacccgaaccgtttaccctaccgtaaaccctacgttacccgaaacggtccgaaccggttaccccgtcgggtaccgttaccggtaccgtaacgggtaaacgtacgtccggtaccgttacgtaaacctttaacgtttacgttaaccgttagtaaaacgttaaagtacgtaccggtaacgttcggttaccggttacccggtaacgggttacccggtacccggaaccgggtaacgggtaaacccggtaagggttaacgaaacgttaacgaaacggttagtcggacgtcgtaacccg

SEQ ID NO: 27035 - DNA, 839 bp, Homo sapiens
  misc_feature: GYAE6OF01A85VF.39.53.E09.1.454.CMB.1.raw
  modified_base (211)..(211): a, c, t, g, unknown or other
  misc_feature (211)..(211): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggcctcccagataccagatgtgacatccaagatcgacccagtcctccactccctccctgtctcgcatcgtggtaagganactagacgtaccacctatctacgtcggccggacgagtcgaggctaagttacgacttagtttacgttacgtacgttaggtactacgaaacgacgggtacccggtaaccgggggtaacgttaccgtaacgtacccgttcgtacgtacgttaccgttaagtacggtactacgtaacctaactaacccgttaaaacgtttaaccggaaaacccggggtaccgggttaacccctacgttaccgtacccggttaaggtttaacccggtagggggttacccgggggttcggggtttaccggggtttacgggtaaccgggtaaccgtttacggtttaacgtttacccgttaaccgtttacccgtaaccgtaaccgtaacgtacgtacgtaccgtaaccgttccgtacggtccgtcgtaaccgtaggtaacgtcgtacgtccttaacgtaactttaacctttacgttaaccttaagttaaacgtaaagttacgtaacgtaacggttaccggttacccggttaaccgggttccgggttaaccggtacccgggaacccgggtaaacgggtaaaccgggtaaaggttaaacggttaaacctaacgggtaaaaccgtacggttaacgggtcgtaacccggg

SEQ ID NO: 27036 - DNA, 742 bp, Homo sapiens
  misc_feature: GYAE6OF01EKQTN.39.53.E09.1.454.CMB.1.raw
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
tcagtcgcactagtcacgaccggtgctcgatttagagagagtgtgttgggtttgggggcagaagtctctctcagtcagggcacagcatggacatgagggtccctgctcagctccgtgggactcctgctgctcgtgcctcccagactaccagatgtgacatccagatcgacccagtcctccactccctcctgtcngctntcgtaggtaggagacagacgtaccaacctntaccgtacgttcgggccgggacgtacgtacggaggtacgtaagttacggtacttaagtttacgttacgtccgttagtactaccgaacgacggtacccgggtaacccggggtaacggttacccgtaacgtacccgtccgttacgtacgttacttagtacgtacgtacgtacctaacttaccgtaaaggtttaacccgaacggtaccgggtaccctacgttcgtacgttacgttcgtacgggtcggggtcgggttcggtacggtacgggtacttacgttacttccgtaccttccgtacgacctacgtaccgacgtccgtaccgcctacgtaccgtcgtccgtaagtacgacttcgtactaaccgtactttaaccgtttactaacggttacgtaaagttaacgttacgtacgtaccgttacggttcccggtaccggtaccgggtacccggtccgggtaaccggaacggtaaaccggtaaggacgtaaacgtaaccggtaagtccggttgaccgtacg

SEQ ID NO: 27037 - DNA, 835 bp, Homo sapiens
  misc_feature: GYAE6OF01D9MDT.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagactaccagatgtgacatccagatcgacccagtcctccactccctcctgtctgcctagtcgtaggtaggaacgtacgagaacgtccaacctactcgtaccgttcgggaccgggggctaggtacggacgggctagttacggacttatttacgtttacggccttaggtactacgaacgtacggaccggtaaccgggggtaacggttaccctacggtaccgttccgtagtacttacttagtagtacgtacgaccttaccgtaactaaacggtttaaccggaacccgggtaccgggggttacccctacgttacctacggttacgttacggaacgggttcggggtcggggttagggtccggttaacggggtaactaacgtttacgtttaaccgtacccttaccgtaaccgtaacccgtaacttaccgaacggtaccgtaacccggttcccgtaccgggttccttaccggtaccgtaaggttaacgttacgtcgtacgttaaccgttaaacttaacgtttaacgttaacctttaacggtaaacgttaaagtaccgtaacggttaccgttaccgggttcccgggttaacccgggttacccgggttccgggtaacccggggtaacccgggtaacggggtaaaccggtaaagggtaaacggtaaacctaaacgggtaacggtaaccggtaggtcggttaaccgg

SEQ ID NO: 27038 - DNA, 714 bp, Homo sapiens
  misc_feature: GYAE6OF01BF41E.39.53.E09.1.454.CMB.1.raw
  modified_base (290)..(290): a, c, t, g, unknown or other
  misc_feature (290)..(290): n is a, c, g, or t
tcagtcgcactagtcacgaccggtgctcgatttagagagagtgtgttgggtttgggggcagaagtctctctcagtcagggcacagcatggacatgaggtccctgctcagctcctgggactcctgctgctctggcctcccagataccagatgtgacatccagatcgacccagtctccactccctccctgtctgcatctgtaggagacagacgtaccaccatcgacgttcggcccggggcgacgtcgacgggctagttaggctattatttacgccgttaggtactacaacgnggaccgaacccggggtaagttcccgtagtacctcgtgacttactagtagagtcgtactaacgttacctaaagtttaaccggaaccggtaaccggggtaccctaacgtccttacgtaatttacggtacgggttcggggtacgggttgggttcggtagggtactaggttacttcctaccgttcctaccgtaaccgtactacgacgtaccgacgtccgtcgtccgtacgtaccgtaaggaacgtacttcgggacttacgtaaccttaacgtttaacgtttaccgtacgttaaaccgtaaagttacgtacgtaaccgttaacggtccggttaccccggttaggggttaccccggttaccgggacccgggtaacggaacccgtaagggtaaccgtaaaccgtaccgtaaacgtcggtacggtggtaccg

SEQ ID NO: 27039 - DNA, 842 bp, Homo sapiens
  misc_feature: GYAE6OF01AIDT2.39.53.E09.1.454.CMB.1.raw
  modified_base (193)..(193): a, c, t, g, unknown or other
  misc_feature (193)..(193): n is a, c, g, or t
tcagtcgcactagtcacgaccggtgctcgatttagagagagtgtgttgggtttgggggtctcagagaggagcctagccctggactccaaggcctttccacttggtgatcagcactgagcacagaggactccaccagtggaagttggggctgagtccgttggttttccttgttgtcttaagttttaggaaggtntccgtaattgtggaggcgcaacgtggtggtcgtcgtgggggaggtcgttcggtccaggtccggtcgggggtccctggacgtacttcctcgtggtaactcgcctcgttggtatttacggtacggttagtcgaccgtacgtacggtaataaccggttccggtaccgtacccgacgggttccgtacgggacggggaacggggtcgtggggtaacggttcggtccgacccggtaaacgttaaaggttaaacggaaagtagtaggtaaaggtagtaaaacgaaaaagttggtaggtcgtaaccgtgtacgggtacgtaaaccggggttccttaacctcgaaccgttacgaacgggacgtaaccggactaaggtctacgttaagtcgttaacgtgtttaagtaccgttaaactaaacgtttaaacgtaccggttatacggttaacggaaccgttaaccgacgtaaccggtaccgttaacgttactaacgttacgtaacgtacgttccggtagtaccggtacgggttaacccgggaattaccggtttaacgtacccggggttaacgtttacccggggtacccggggtaaaccggttaacccggggtaaacccgggttaccccttacccggtaacccgggttacccctaacccccgg

SEQ ID NO: 27040 - DNA, 674 bp, Homo sapiens
  misc_feature: GYAE6OF01BVEQ8.39.53.E09.1.454.CMB.1.raw
  modified_base (198)..(198): a, c, t, g, unknown or other
  misc_feature (198)..(198): n is a, c, g, or t
tcagtcgcactagtcacgaccggtgctcgatttagagagagtgtgttgggtttggggcagaagtctctctcagtcagggcacagcatggacatgagggtccctgctcagctcctgggactcctactgctctggctcccagactaccagatgtgacatccagatgacccagtctcatcctcctgtctgcatctgtaganacagatcaccatctacttggccggcgagtcgaggcagttacggctattagtttacgtccttaggtaactacgaacgacggtaccggtaacccgggggtaacggttacccgttacggtaccttcccgttacggtaacttaccgttaagtacgtattaccggtctaacttacccttaaacgtttaaccgaaccggtaaccggggtaccctacgtccgtacgtacgttacgacggttcgggcgggttcgggttcggtaggtacgtagttactttacgtcttacctacctacgtactacgagcctacgtacctcgtctacgtccgtaggacgtgtacgcgtagactaacgttacgttacgtagtaacgttaatagtacgaacgttacgtacgttcccggtacggtaccgtccggaccgtaacgggccgtaaaggtaaccggtaactaaccggtaaacgtaagttcggcggtcgtaacccg

SEQ ID NO: 27041 - DNA, 825 bp, Homo sapiens
  misc_feature: GYAE6OF01AHNEB.39.53.E09.1.454.CMB.1.raw
  modified_base (121)..(121): a, c, t, g, unknown or other
  misc_feature (121)..(121): n is a, c, g, or t
  modified_base (152)..(152): a, c, t, g, unknown or other
  misc_feature (152)..(152): n is a, c, g, or t
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (249)..(249): a, c, t, g, unknown or other
  misc_feature (249)..(249): n is a, c, g, or t
tcagtcgcactagtcacgaccggtgctcgatttagagagagtgtgttgggtttgggggcagaagtctctctcagtcaggcacagcatggacatgaggtccctgctcagctctggactcctnctgctcgtggacctcccagactaccagatgngacatccagtatcgaccctagtcctccatcccctcctntacngcctatcgtaggtaggacacaggcctacaacctattccaacgttcgggcccgggntaacgtcgagggtacaagtttacggactagtttacgttacgccgttaggtacctaccgaacgaccgtaccccgggtaaccgggggttaaccgttccgtaacggtaccctttcgtagtactaccgttataggtactgaccttagtacccttaaacgtttaccggaaccccggtcggtcccctagttacccgtacgttacgtcgtagggtcgggtacggtcgggtcggtacggtactacggttacttcaacccttcgtaccccacgttactacgacgtggtaacccgtccgtggtacccgtacgtacccgtaagtacgacggttaccgacgtttacccggaactttaaacccggtttcctaaaccgttaacccgtaccttaaacggttaaaccgttaaagttttaaacccgttaccgttttaagttaaacccccggtttaacgtttacccggggtttttaaccggggaaaacccgggtaacccgggttaaccccggtaaaacccggtttgggtaaaccccgggtaaaacgtttaaccccggtaaaacccggtaaaccggggtttgttaacccccgggg

SEQ ID NO: 27042 - DNA, 857 bp, Homo sapiens
  misc_feature: GYAE6OF01DDDDD.39.53.E09.1.454.CMB.1.raw
  modified_base (130)..(130): a, c, t, g, unknown or other
  misc_feature (130)..(130): n is a, c, g, or t
  modified_base (158)..(158): a, c, t, g, unknown or other
  misc_feature (158)..(158): n is a, c, g, or t
  modified_base (179)..(179): a, c, t, g, unknown or other
  misc_feature (179)..(179): n is a, c, g, or t
  modified_base (658)..(658): a, c, t, g, unknown or other
  misc_feature (658)..(658): n is a, c, g, or t
  modified_base (664)..(664): a, c, t, g, unknown or other
  misc_feature (664)..(664): n is a, c, g, or t
tcagtcgcactagtcacgaccggtgctcgatttagagagagtgtgttgggtttgggggcagaagtctctctcagtcagggcacagcatggacatggaggtccctgctcagctcctggactcctgctgctntcggcctccagactacagatgtacgacntaccgagactcgaccattccncctactcccgtcctagtctgacctattccgtaggtaaggacgaacgacggtacttaccacctaacgttacgtaaccggttccgggaccccggggaggttaacggtacccggtaagggtacctttaaggttaacgggtaacccttttaggttttaaccgtttaacggtcccggttaaggttaaccgtaaccgaaccggaaccggtaacccgggtaaaccgggggtttaacgttacccgtacggtaaccctttacgttacggtaacttacgttagtacggtactcgtaacttacccgttaaaagttcggtttaaaccggaaccgggtaacgggtttaccccagtttcccgttaacgttcggtaacggtcgggtacgggtccggggttaggttcccgggtaagacggttaactttcgttaacccggttacctctacccgacgtagttacgcgtaacgccgtacccgtgtccgtacgacgtanaacgtntacgacttaacgtaacttacgtttacgttagtaaccggttaataggtacctaacgttacggtccgtaccgggttacccggtaacgggtaccgggttaacccggggaacccggttaaccggttaaacggggaacgttaaacccggtaaacgggttaaaccgaaacccgggtaggtttccgtcccgggtaaccgg

SEQ ID NO: 27043 - DNA, 718 bp, Homo sapiens
  misc_feature: GYAE6OF01ES9JH.39.53.E09.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctccagataccagatgtgacatccagatgacccagtctccatcctcctgtctgctatctgtaganacagactcaccntcatcggccggnagtcaggctagttaggactatttacgttagccttaggtactaccaacgacggtaccggtaacccggggggttaagtttacccgtaaggtacccttacccgtaggtaacttcgtaagtcgtacgttacgcctaaacttacccgtaaagtttaaccggaaccggtacggggtaccctaagttcctaacggttacttacgtacgggttcgggggtccgggtttcgggtcgtacggggtaactacgttaccgttaccgtaacccttcgtaccgtaccgtacgtaccgaaccggtccgtaaccgtcccgtacggtcccgtaccgttccggtaacgtaacggtacgtcgtaccgtaacgtaaccgttaaccttacgttacgttacgttaacgaaacgttgacgttacgtaacggttcggtaccggtacggtaccggttccggaccggtaacgggacgttaaagggaacgtaacgtaacgaaaaggtctacggtgtacccgg

SEQ ID NO: 27044 - DNA, 840 bp, Homo sapiens
  misc_feature: GYAE6OF01CUFHE.39.53.E09.1.454.CMB.1.raw
  modified_base (120)..(120): a, c, t, g, unknown or other
  misc_feature (120)..(120): n is a, c, g, or t
  modified_base (834)..(834): a, c, t, g, unknown or other
  misc_feature (834)..(834): n is a, c, g, or t
tcagtcgcactagtcacgaccggtgctcgatttagagagagtgtgttggggtttgggggcagaagtctctctcagtcagggcacagcatggacatggacgggtccctgctcagcctccgngggactcctactgctcgtcggcctcccaagactaccagtatgtcgaactactccaaggtactacggaacccctacgtaccttccctactccccttcccgttcgtcctgacctattaccgttaggtaagggaacgtaccgaacggtacgttacccaaccctacttaccgtacggttccggggacccgggtacggtaacggtccggaagggtaccttagttaccggtactttaagttttaactttacggccgttaggttaactaacgaaaccggccggggaacccgggttaaccccggggggtttaacgtttacccgtaaccgtaccgttaccgtaagtacgtttactaggttacgtacttacacttaaccgttaaccgttaaagtttaaccgggaaccgttaccgggttaccctacttaccgttacggtaattccgggtaggtcgggggtcgggttacgggtcggtaggtacctaggttacctttaccgacgttcccctaacgtaacacggtaaccgacgtccgtaacgtcccgttcgggacccgttgccgggtaaagtgttacggtcctacggtaacttaaaccgtttactttacttaacccgtaaagttacgtaaagttcacggtaacgtcggttaccggtccggtccgggtaacgtacccgggtagaacggggtacaacgggaaagacccttaaagggacttggcgacggtntacccg

SEQ ID NO: 27045 - DNA, 1031 bp, Homo sapiens
  misc_feature: GYAE6OF01D3W57.39.53.E09.1.454.CMB.1.raw
tcagtcgcactagtcacgaccggtgctcgatttagagagagtgtgttgggtttgggggtctcagagaggagccctagccctggactccaaggcctttacacttggtgatcagcactgagcacagaggactcaccagtggaagttggggctggagtcgtttcgggtttttccttggtttgtactttaagttttaggaaggttcgtacctaatggtggaggccgactaacggttgggtcgggtccggttacggtggggggtagtccgtttcgggtcccgtacggtcccggttcgggggggttcccctaggacgtaccttccgttccgttaggtaaccgacgtcccttcgtggtaactttaccgttaagggttttacggtcggtaacccggtaccgttacgggtaaacttaaaaccggtccggggtaccccgtacccgacgggtaccgtaccggggaaagggggtaacgggggtcgttaggggacgggttcggggtaccgaccgtaaaactaaggttaaaacggaaaaggtacgtagggaaacgtaggaaaacgtaaaaacgtagtaggtacggtaactacggttagggtacgggtaacggggttacccggtttaaacccgtacgttacccgtaacccgggaacgggtaaaccgtaaacccgggtacccgtaacggtacgttaaccgttaacgttttaacggtaaccgttaaagtttaacgttttacggtaaaccgttaaaaaacgttaaaaccggtacggttaacgttacggaacgggtaaccgggaacccgggtaaacgggaacccggtaaccggttaccgtttaaccgtaacgtttaaccgttacgttaaccgttcgggtaacccggtccgggttccgggtacggggtaacccgttaacggttacgggttacggtttaacccgggtttacccgggggtaaccggggggaaacccccggttaaaccgggggtaaacccccgttaacccggggttacccccgttaacccggtttccccggttaacccccccgg

SEQ ID NO: 27046 - DNA, 769 bp, Homo sapiens
  misc_feature: GYAE6OF01DFKD5.39.53.E09.1.454.CMB.1.raw
  modified_base (167)..(167): a, c, t, g, unknown or other
  misc_feature (167)..(167): n is a, c, g, or t
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
  modified_base (554)..(554): a, c, t, g, unknown or other
  misc_feature (554)..(554): n is a, c, g, or t
tcagtcgcactagtcacgaccggtgctcgatttagagagagtgtggttgggtttgggggcaagaagtctctctcagtcagggccacagcatggacagtgacgggtccctgctacagcctcgtggactcctgctgctcgtcggcctaccaagtactacgagtagtganacacgtcgagtacgtccgacctaacgtccttacncccgtttcccgtccttagttcccgngtacttacgttacggttacgggaaacggtacacggtaaggacccttacaacccagtttaccggttccggcgggggaccggtaccgtaaggtaccggacggttaacgttaggttaaccgtattttaaacggtttttacgtacgttaccggttacggtaaacaacgtaacccgggacgggtaaccccggggttaccgtacggttacgaaccgtcgttactacgtacttagtataggactcgtactaactaacgtacgtaaccggacgtacggtactacgttntactggngtacggggtgacgggtttgacgaggttaatacgtccttacnccgttacacgttacagtcgaacgtccgcgttacctgtacttacgtgtaacagggttcacgttgtaaccttaacttttaacgtagttaaataaccgtaaagtttaaccgacggtacttaccgttcgggtaacgttacccgggtacgtttaccgggaccggttaaacgcgggttaaaggtaacggtaacaaacgttacgaggtaacctggacctcgg

SEQ ID NO: 27047 - DNA, 839 bp, Homo sapiens
  misc_feature: GYAE6OF01EW1UC.39.53.E09.1.454.CMB.1.raw
tcagtcgcactagtcacgaccggtgctcgatttagagagagtgtgttggggtttgggggcagaagtctctctcagtcagggcacagcatggacatgagggtccctgctcagctcctgggactcctgctgctctggcctcccagactaccagatgtagacatccagactacgacccagtctccactccctcctgtctgacattcgtaggtagagacagtacgaccaacctactaccgacgttcgggacccggggagacggttcgacgggtactaagttacggtaccgttaattttacgtttacggtaccgttaggttactaaccgtaaacggtaccggaaccccggggtaaccgggggttaaccggtttacccgtaacggtaccttccgtacgtaacttactagtagttaacgtacgtacctaacttaaccgttaaacgttaaccggtaaccggttaccgggtacccttacgttaccgtacgttacgttacggtaggggttcggggtacccggggttgggtacccggtaaggggtaccttaacgggtttacctttaccggtaacctcccgttaacccaacgtcgtaccggaacggtaccgtaccggttcccgtacgttcccggtacgtacccgtaaggacgtttacgtccggttataacccgtaacttttaaccggttactttaaaccggtaattaaaacgttaacgtacgttaaccgtacggttacggttacccgggtacccgggtacggggtttacccggtaccgggaacccgggtagggaaaaccggtaggtaaacggtaaacgtaacggtaaaccggtcggtcggttcggaacccg

SEQ ID NO: 27048 - DNA, 761 bp, Homo sapiens
  misc_feature: GYAE6OF01D65EB.39.53.E09.1.454.CMB.1.raw
  modified_base (156)..(156): a, c, t, g, unknown or other
  misc_feature (156)..(156): n is a, c, g, or t
  modified_base (205)..(205): a, c, t, g, unknown or other
  misc_feature (205)..(205): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacntccagatcgacccagtcctccactccctccctgtctgcatctgtagganacagacgtcaccatccacgttcggcccgggagacgtcgaggactagttacggactatttatttacgccttggtaactacaacgacgaccggaacccgggggtaacgtttccgtacgtacctccgtagtactcttagtgtagtcgactatacctaaagtttaaccggaaccgtacgggtaccctacttacgtcgtagttcgtaggtcgggtcgggttagggtcgtaggggactaaggtttctttaccgtaccttacgtaccgtaacctaagtaccgaacgtccgtaaccgtccgttacggtccctaacggtccgtaacgggtaaatcgttcggtaacttcgtaaacctttaacgtttaactttacgttaaacgttaaacgtaaaagtttctaaggtaccggttaacggtttcccgggtacccgggtttaacggggtccccgggtttaaccccggggaaccccgggtaaacgggggtaaccccggttaaaagggttaacccggtaaaaacgttaaacccgaaaacccggggttacggttcccgggtacggtaacccgg

SEQ ID NO: 27049 - DNA, 517 bp, Homo sapiens
  misc_feature: GYAE6OF02IQLKY.39.53.E09.1.454.CMB.1.raw
  modified_base (438)..(438): a, c, t, g, unknown or other
  misc_feature (438)..(438): n is a, c, g, or t
tcagtcgcactagtcacgaccggtgctcgatttagagagagtgtgttgggtttggggcagaagtctctctcagtcagggcacagcatggacatgagggtccctgctcagctcctgggactcctactgctctggctcccagataccagatgtgacatccagatgacccagtctccatcctccctgtctgcatctgtaggagacagagtcaccatcacttggccgggcgagtcgagggcattaggcattattagcctggtatcaacagcacccggggaagttcctagactcctgatctatgatgcatccaaatttagaaccgtaggggtcccatctcgattcagtggcggtgggtcgtgggacgagtatttcactctccactatcagcagcctgctgcctagaagtatcgctgactaactttattactagtacaaagttntagacagtcgtcccgtaggtaccggttcggacccgagggaccgtaaggtaggaataccgaaacgaacgtgtaggctacg

SEQ ID NO: 27050 - DNA, 615 bp, Homo sapiens
  misc_feature: GYAE6OF02JS0XK.39.53.E09.1.454.CMB.1.raw
  modified_base (249)..(249): a, c, t, g, unknown or other
  misc_feature (249)..(249): n is a, c, g, or t
tcagtcgcactagtcacgaccggtgctcgattagagagagtgtgttgggtttggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcacatcacttggccgggcgagtacgagggctagttaggctatnttagtttacgtccgtaggtactacaacgacgaccggaaccggggtaacggttaccgtacgtacctcctagtatactagtagtagtgactactactaacttaacgtaacgtacggtacctactcgtacgtacgtacgtaggtgggtcgggtcgggtcgtacggtacgtagtacttactactctactaacctactacacgacgacgtcgtcgtcgtcgtcgtagaagtagtgtacgtacgtactaacttaacttaacgttacgtaacgtaaagtaagtacgtacgtacgtacggtccggtacggtacggtaccggtaccggaacggtaacggtaacggtaaggtaacgtaacgtaacgtaacgtacgg

SEQ ID NO: 27051 - DNA, 486 bp, Homo sapiens
  misc_feature: GYAE6OF02GJPH2.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaaggttcctagactcctgatctatgatgcatccaatttagaaccaggggtcccatctcgattcagtgcggtgggtctgggacagatttcactctcaccatcagcagcctgctgcctgaagatgctgcaacttattactgtacaaaagtatgacagtgtcccgtggaccgttcggcccagggaccaaggtggaaatcaaacgaactgtgtcg

SEQ ID NO: 27052 - DNA, 485 bp, Homo sapiens
  misc_feature: GYAE6OF02FPBM5.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaaggttcctagactcctgatctatgatgcatccaatttagaaccaggggtcccatctcgattcagtggcggtgggtctgggacagatttcactctcaccatcagcagcctgctgcctgaagatgctgctaacttattactgtcaaaagtatagacagtgtccgtggtacgttcggcccagggaccaaggtagaatcaaacgactgtgtcg

SEQ ID NO: 27053 - DNA, 529 bp, Homo sapiens
  misc_feature: GYAE6OF02H7CJN.39.53.E09.1.454.CMB.1.raw
  modified_base (410)..(410): a, c, t, g, unknown or other
  misc_feature (410)..(410): n is a, c, g, or t
  modified_base (440)..(440): a, c, t, g, unknown or other
  misc_feature (440)..(440): n is a, c, g, or t
tcagtcgcactagtcacgaccggtgctcgatttagagagagtgtgttgggtttggggcagaagtctctctcagtcagggcacagcatggacatgagggtccctgctcagctcctgggactcctgctgctctggctcccagataccagatgtgacatccagatcgacccagtctccatccctccctgtctgccatcgtgtaggagacagagtcaccatcacgttgccgggcagtcagggcattaggctattatttagcctggtatcaacagcgaacccggggaagttccagactcctgatctatgatgcatccaatttagaacctagggtcccatcgtcgattcgagtggcggtggtctgggactagtactttcacttctacacatcaagtcagtcctgactgcctgaaanctgctgacaatttatactagtacaaaagtntacgatcgtacgtccccggtggtaaccgtcggtacccgaacgggacgtaacggtacggaaactacaaaaccggtaacgtaggtggtacc

SEQ ID NO: 27054 - DNA, 492 bp, Homo sapiens
  misc_feature: GYAE6OF02IXFVQ.39.53.E09.1.454.CMB.1.raw
  modified_base (424)..(424): a, c, t, g, unknown or other
  misc_feature (424)..(424): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgacatccagatgacccagtctccatcctccctgtctgcatctgtaggagacagagtcaccatcacttgccgggcagtcagggcattaggcattatttagcctggtatcaacagcacccggggaaggttcctagactcctgatctatgatgcatccaatttagaaccaggggtcccatctcgattcagtggcgtgggtctgggacagatttcactctcaccatcagcagcctgctgcctgaagatgctgctaacttattactgtacaaaagtntgacagtgtcccgtggtacgttcggcccagggacctaaggtcgaaactcgaaacgactgtggctacgg

SEQ ID NO: 27055 - DNA, 499 bp, Homo sapiens
  misc_feature: GYAE6OF02HR6DP.39.53.E09.1.454.CMB.1.raw
  modified_base (396)..(396): a, c, t, g, unknown or other
  misc_feature (396)..(396): n is a, c, g, or t
  modified_base (426)..(426): a, c, t, g, unknown or other
  misc_feature (426)..(426): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaagttcctagactcctgatctatgatgcatccaatttagaaccaggggtcccatctcgattcagtggcggtgggtctgggacagtatttcactctcacatcagcagcctgctgctgaaagntgctgctaactttattactgtacaaaagtntagactagtgtcccgtaggaccgttcggacccgagggaccaaggtaggaactacgaaacgtactgtggtaccg

SEQ ID NO: 27056 - DNA, 518 bp, Homo sapiens
  misc_feature: GYAE6OF02GF0FE.39.53.E09.1.454.CMB.1.raw
  modified_base (398)..(398): a, c, t, g, unknown or other
  misc_feature (398)..(398): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaaggttcctagactcctgatctatgatgcatccaatttagaaccaggggtcccatctcgattcagtggcggtgggtctgggacagtatttcactctcaccatcagcagcctgctgcctgaagntgctgactaacttattactagtacaaaagtagtagactagtcgtcccggtgggtaccggttccggcccgaagggtaccgaagggttacggaaactaccgaaacgtacgttaggtggtacg

SEQ ID NO: 27057 - DNA, 503 bp, Homo sapiens
  misc_feature: GYAE6OF02I1XGC.39.53.E09.1.454.CMB.1.raw
  modified_base (397)..(397): a, c, t, g, unknown or other
  misc_feature (397)..(397): n is a, c, g, or t
  modified_base (426)..(426): a, c, t, g, unknown or other
  misc_feature (426)..(426): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgacatccagatgacccagtctccatcctccctgtctgcatctgtaggagacagagtcaccatcacttgccgggcgagtcagggcattaggcattattagcctggtatcaacagcacccggggaagttcctagactcctgatctatgatgcatccaatttagaaccaggggtcccatctcgattcagtggcggtgggtctgggacagtatttcactctcaccatcagcagcctgctgcctagaagntgctgactaacttatactgtacaaaagtntacgacaggtcgtaccgtggtacgttccggccgtacgggaccgaaggtcgaaataccgtaaacgactggtggctacg

SEQ ID NO: 27058 - DNA, 528 bp, Homo sapiens
  misc_feature: GYAE6OF02H38KN.39.53.E09.1.454.CMB.1.raw
  modified_base (406)..(406): a, c, t, g, unknown or other
  misc_feature (406)..(406): n is a, c, g, or t
  modified_base (440)..(440): a, c, t, g, unknown or other
  misc_feature (440)..(440): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacgttgccgggcgagtcagggcattaggcattattagcctggtatcaacagcgaccggggaaggttcctagactcctgatctatgatgcataccaatttacgaaccaggggtccatctcgattcagtggcggtgggtctgggacagtatttcacttctacgaccactcagacagtcctgcttgcctgaagntagtctgactaacttattactagtactaaaagtntacgactagtcgtcccggtaggaccgtttccggacccgtaaggtaccgaagggttaggaaactacgaaaaccgaacgttcggagtacg

SEQ ID NO: 27059 - DNA, 550 bp, Homo sapiens
  misc_feature: GYAE6OF02JLLVQ.39.53.E09.1.454.CMB.1.raw
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (429)..(429): a, c, t, g, unknown or other
  misc_feature (429)..(429): n is a, c, g, or t
  modified_base (442)..(442): a, c, t, g, unknown or other
  misc_feature (442)..(442): n is a, c, g, or t
tcagtcgcactagtcacgaccggtgctcgatttagagagagtgtgttgggtttgggggtcgagaagtctctctcagtcagggcacagcatggacatgagggtccctgctcagctcctgggactcctactgctctggctcccagataccagatgtgacatccagatgacccagtctccatcctccctgtctgcatctgtaggagacagagtcaccatcacttgccgggnagtcaggcattaggcattattagcctggtatcanagccacccggggaagttcctagactccngactctatgatgcactcctaaatttacgaaccgaggggtcccattcctcgtaattcgagttcgggcgggtaggggtctaggggaccaggtatttacacttctcaacccgtatcgagcacgtcctgcttcgcctagaagntgctgctaacttntactagaacaaagtcagactgtcgtccggtaggtaccggttcggtacccaaggggaaccctaagggacggtaaactccgaaaacgttacgtacggtgggtacctacgg

SEQ ID NO: 27060 - DNA, 553 bp, Homo sapiens
  misc_feature: GYAE6OF02F8S7C.39.53.E09.1.454.CMB.1.raw
tcagtcgcactagtcacgaccggtgctcgatttagagagagtgtgttgggtttgggggtctcagagaggagccctagccctggactccaaggcctttccacttggtgatcagcactgagcacagaggactcaccatggaattggggctgagctgggttttccttgttgctattttagaaggtgtccaatgtgaggcgcaactggtggcgtctgggggaggcttggtccagcctggggggtccctgagactctcctgtacagcctctggattcaggtttagtgacgcctggataaactgggtccgccaggctccagggaaggggctggagtgggtcgccaacattaagaagatggaagtgagaaaaactatagtggactctgtagaagggccggtttaccatctccagggacaacgccatgcatttagcatattgactaaataacagtactagagagccgaggaccacggcttacatatacactgtgcgcgtggggacacgtatggtattcgtaggggccgaacgggacccgacgggtaccacccgtctacccg

SEQ ID NO: 27061 - DNA, 567 bp, Homo sapiens
  misc_feature: GYAE6OF02GKO3K.39.53.E09.1.454.CMB.1.raw
tcagtcgcactagtcacgaccggtgctcgatttagagagagtgtgttgggtttgggggtctcagagaggagccctagccctggactccaaggcctttccacttggtgatcagcactgagcacagaggactcaccatggaattggggctgagcgtgggttttcctgttgctattttagaaggtgtccaatgtgaggcgcaactggtggcgtctgggggaggcttgggtccagcctgggggggtccctgagactctcctgtacagcctctggattcaggtttagtgacgcctggataaactgggtccgccaggctccagggaaggggctggagtgggtcgccaacattaagaaagatggaagtgaagaaaaactatgtggactctgtgaagggccggtttacatctccagggacaacgccatgcatttagcatattgactaaataaacagtctagagagccgaggacacggcttcgattactcacgtgtgacgtcggtcgggactacgtagtcggtacgtttcggacgggacggaacgggaccgtacggtacccgtaccgttctacccg

SEQ ID NO: 27062 - DNA, 492 bp, Homo sapiens
  misc_feature: GYAE6OF02G9PLS.39.53.E09.1.454.CMB.1.raw
  modified_base (427)..(427): a, c, t, g, unknown or other
  misc_feature (427)..(427): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaaggttcctagactcctgatctatgatgcatccaatttagaaccaggggtcccatctcgattcagtggcggtgggtctgggacagatttcactctcaccatcagcagcctgctgcctgaagatgctgactaactttattactgtacaaagtntagacagtgtccgtggacgttcggccgaggaccgaaggtaggaactacgaacgacgtgtggtacg

SEQ ID NO: 27063 - DNA, 612 bp, Homo sapiens
  misc_feature: GYAE6OF02JCU06.39.53.E09.1.454.CMB.1.raw
  modified_base (202)..(202): a, c, t, g, unknown or other
  misc_feature (202)..(202): n is a, c, g, or t
tcagtcgcactagtcacgaccggtgctcgatttagagagagtgtgttgggtttgggggtcgagaagtctctctcagtcagggcacagcatggacatgagggtccctgctcagctcctgggactcctgctgctctggctcccagataccagatgtgacatccagatgacccagtctccatcctcctgtctgcatctgtagganacagatccaccatcacttgccgggcagtcagggcattaggcattattacgcctggtatctaacacgtacacccggggaaggttcctagtactcctacgtactcttatgtattgcactcctaatttacgaaccgtacggggtaccctactcgttcgtatttactagtagggtcggttgggtcgtagggtaccaggtactttacgacttctaccacctactcagacctcgcctgctcgaccgtacgaagtactcgcttagtcctaacgtttactttaacgtacgtttaacaaaagtttactacgtacctaggttacgttacccggtacgggtaccggttccgggacccgtaacggggacccgtaaggttacgggaaacgtacgtaaaccggtaaccgttaggtacggttacg

SEQ ID NO: 27064 - DNA, 510 bp, Homo sapiens
  misc_feature: GYAE6OF02F8FKX.39.53.E09.1.454.CMB.1.raw
  modified_base (430)..(430): a, c, t, g, unknown or other
  misc_feature (430)..(430): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaagttcctagactcctgatctatgatgcatccaatttagaaccagggtccatctcgattcagtggcggtgggtctgggacagtatttcactctcaccatcagcagcctgctgccgtagaagtatgctgactaactttattactagtacaaaagtntagacagttcgtccggtaggtaccggttcggacccgagggaccgaaggtacggaaactaccgaaagacgttaggacgtcg

SEQ ID NO: 27065 - DNA, 270 bp, Homo sapiens
  misc_feature: GYAE6OF02FIAK2.39.53.E09.1.454.CMB.1.raw
  modified_base (253)..(270): a, c, t, g, unknown or other
  misc_feature (253)..(270): n is a, c, g, or t
tcagtcgcactagtcacgaccggtgctcgatttagagagagtgtgttgggtttgggacagatttcgactctcaccatcagcagcctgctgcctgtaagatgctgcaacttattactgtcaaaagtatgacagtgtcccgtggacgttcggcccagggaccaaggtggaaatcaaacgactgtggctgcaccatctgtcttcatcttcccgccatctgaactagtgcgactgagcgggctggcaagcgcatagnnnnnnnnnnnnnnnnnn

SEQ ID NO: 27066 - DNA, 538 bp, Homo sapiens
  misc_feature: GYAE6OF02FHAVW.39.53.E09.1.454.CMB.1.raw
  modified_base (400)..(400): a, c, t, g, unknown or other
  misc_feature (400)..(400): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcatttatttagcctggtatcaacagcacccggggaaggttcctagactcctgatctatgatgcatccaatttagaaccaggggtcccatctcgattcagtggcggtgggtctgggacagatttcacttctcgaccatcagcagcctgctcgcctgagntgctgactaactttattactgttacaaaagttatagactagttcgtacccgtgggtaccggtttccggacccgtacgggtacccgtaaggggtacggtaaacgttaccgaaaaccggtaacgttgggtacggtaccgg

SEQ ID NO: 27067 - DNA, 498 bp, Homo sapiens
  misc_feature: GYAE6OF02F12ZQ.39.53.E09.1.454.CMB.1.raw
  modified_base (432)..(432): a, c, t, g, unknown or other
  misc_feature (432)..(432): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaaggttcctagactcctgatctatgatgcatccaaatttacgaaccaggggtcccatctcgtattcagtggcggtgggtctgggacagatttcactctcaccatccagcagccctgctgcctgaagatgctgactaacttattactgtacaaaagtntgactagtgtcccgtggtacggttcgacccgtaggaccgaaggtggaaactcaaacgactgtaggc

SEQ ID NO: 27068 - DNA, 525 bp, Homo sapiens
  misc_feature: GYAE6OF02FVVPZ.39.53.E09.1.454.CMB.1.raw
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
  modified_base (441)..(441): a, c, t, g, unknown or other
  misc_feature (441)..(441): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatccctccctgtctgcatctgtaggagacagagtcaccatcacttgccgggcgagtcagggcattaggcatttattagcctggtatcaacagcgacccggggaggttcctagactcctgatctatgatgcatcctaatttacgaacctaggggtccccatctcgtattcgagtggcggtgggtcgtgggacagtctttcnctctcaccntcgagcacgcctgctgtcctgaantgctagctaactttattactgtaacaaaagttntagactagttcgtacccggtggtaccggttccggaccgtaacgggaaccaagggtacgaacgtacgaaacgacgtgtcggtacg

SEQ ID NO: 27069 - DNA, 657 bp, Homo sapiens
  misc_feature: GYAE6OF02JN4MD.39.53.E09.1.454.CMB.1.raw
  modified_base (226)..(226): a, c, t, g, unknown or other
  misc_feature (226)..(226): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagtcgcactagtcacgaccggtgctcgatttagagagagtgtgttgggtttgggggcagaagtctctctcagtcgagggcacagcagtggacatggacgggtccctgctcagcctccgtgggactcctactcgcttcgtggcctcccgagactaccagatgtagacatccagatacgacccagtcctaccactccctccctgtctgacctatcgtaggtagganacaggactccacctatacctacgttcgggccgggcgagtcgagggctagttacgactatttagttacgccgtaggtactacaacgacggaccggaacccggggtaacgttaccgtacgtacctccgtagtactctagtcgagtcactatacctaagttacgacgacggtacctatctagtntacgnggtgggtacggttggtacggtaggactagttcttaccacgttcacctacgtacacgtacgcctacgtccctcgtacgtcgtacccgttagaagtcgtcgtacgtacgtaccttaactttacgtttacgaagttaaccgtaaagttgtaacgacggtacttccggttacggtacggtaccggtcgggaaccgtagggtaaccgtaggtaacgtaacgtacgaaccgttaggtcggactacggtacg

SEQ ID NO: 27070 - DNA, 256 bp, Homo sapiens
  misc_feature: GYAE6OF02HZLNT.39.53.E09.1.454.CMB.1.raw
  modified_base (252)..(256): a, c, t, g, unknown or other
  misc_feature (252)..(256): n is a, c, g, or t
tcagtcgcactagtcacgaccggtgctcgatttagagagagtgtgttgggtttgggacagatttcactctcaccatcagcagcctgctgcctgaagatgctgcaacttattactgtcaaaagtatgacagtgtcccgtggacgttcggccagggaccaaggtggaaatcaaacgaactgtggctgcaccatctgtcttcatcttcccgccatctgaactagtgcgactgagcgggctggcaaggcgcatagnnnnn

SEQ ID NO: 27071 - DNA, 716 bp, Homo sapiens
  misc_feature: GYAE6OF02JZ08X.39.53.E09.1.454.CMB.1.raw
  modified_base (387)..(387): a, c, t, g, unknown or other
  misc_feature (387)..(387): n is a, c, g, or t
tcagtcgcactagtcacgaccggtgctcgatttagagagagtgtgttgggtttgggggcgagaagtctctctcagtcagggcacagcatggacatgagggtccctgctcagctcctgggactcctgctgctctggctcccagataccagatgtgacatccagatgacccagtcctccatccctccctgtactgacatcctgtagagacagagtcaccatcacgttcggccggtcgagtcagggctacgttaggctattattaggcctaggtatcaacacgacgtacccggggagttccagactcctgatacgatcgatgcatcctaatcgaaccagggtaccatcctagacttcgagtggtcggttagggtctagggtacctaggtnttttccacgtttccgttacaaccgtagtccgtaagccgtagtccctaggtcctttacgacccgtaggtaaagacgttcgaccgttaacggaaccctttaaagttttaaccgtttaacggtttaacgttaaaccgtaaaaacggggtttaaccttcgggttaaaccgttaccgggttacggtttaccccccgggtaggggtttaaccccggtttaacccgggaccccgggttaaaccgggggtaaaccgtaaaccgggggtttaacggtaaaacccttaaacccggtaaaacccgggttaacggtttacccggggtaacggttaacccgg

SEQ ID NO: 27072 - DNA, 711 bp, Homo sapiens
  misc_feature: GYAE6OF02I2RWB.39.53.E09.1.454.CMB.1.raw
  modified_base (237)..(237): a, c, t, g, unknown or other
  misc_feature (237)..(237): n is a, c, g, or t
  modified_base (336)..(336): a, c, t, g, unknown or other
  misc_feature (336)..(336): n is a, c, g, or t
tcagtcgcactagtcacgaccggtgctcgatttagagagagtgtgttgggtttgggggtctcagagaggagccctagccctggactccaaggcctttccacttggtgatcagcactgagcacagaggactcaccatggaagttggggctgagcgttgggttttccttgttgtcttattttagtaaggtgtccaatgtgaggcgcaacgtggtggcggtcggtgggggaggtcgttcngggtcccaggggtccccttggggggggtacccctgtacggtacccttcgtaccctggtaccacgtccgtacttcgggaagttttcgagggttttaacgngtacggtacccttagggagttaaaaccgtcggggtacccggccctacgggaccgtaccggagggtaagggggctggggacgtcggggtaccgaccgtaaacgaagttaaggaaaaggagtaggaaagtaagaagaaaaacgtagtaggtaggacgtacgtagggtacgtaacgggccggtttaccacgtacgtaccgaagggaccaaacggccaagtcgtcgaatttagactatattaagaactaaagtaaacagtactagacgagaccgaaggaccacggtacttacgatagtactacgcgtagccgacgtaggtcacgttactgggacgttcggacggggtaccgaacgggtacccacgggttccaccggtcc

SEQ ID NO: 27073 - DNA, 501 bp, Homo sapiens
  misc_feature: GYAE6OF02FIIKO.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttggccgggcgagtcagggcattaggcattatttagcctggtatcaacagcacccggggaaggttcctagactcctgatctatgatgcatccaatttagaaccaggggtcccatctcgattcagtggcggtgggtcgtgggacagatttcactctcaccatcagcagcctgctgcctgaagatgctgctaacttattactgttacaaaagtatgacagttgtccgtggtacgttcggcccgacgggaccgaaggtaggaactacgaaacgaacgtagtggtacg

SEQ ID NO: 27074 - DNA, 632 bp, Homo sapiens
  misc_feature: GYAE6OF02IJC17.39.53.E09.1.454.CMB.1.raw
  modified_base (147)..(147): a, c, t, g, unknown or other
  misc_feature (147)..(147): n is a, c, g, or t
  modified_base (201)..(201): a, c, t, g, unknown or other
  misc_feature (201)..(201): n is a, c, g, or t
  modified_base (425)..(425): a, c, t, g, unknown or other
  misc_feature (425)..(425): n is a, c, g, or t
  modified_base (452)..(452): a, c, t, g, unknown or other
  misc_feature (452)..(452): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccngatgtgacatccagatgacccagtctccatccctcctgtctgcatctgtagganacagagtcaccatcacgttgccgggcagtcgagggctagttaggctatttaattagccttaggtaatacaacgacgaccggaacccgggggtaagttacctagtacctctagatctagtgatgactagtacctaaagtttaacgaacccggtacgggtcccattctacgtattcgaggtgggcggttggtacgtgggactagtactttccactctacaacctancagcacgcctagctacgctagacgttncggtctacgtaaccttaacttttacgttacgtaagtttaaaccaaaaggttcgttaacgacgttacgggttccgttacccggtaggggtaccccggttcccgggaacccggtaacgggtaacccggtaagggttaaccgaaaacgttacccggaaaacggtaccgttagggtacggtccg

SEQ ID NO: 27075 - DNA, 544 bp, Homo sapiens
  misc_feature: GYAE6OF02FPWQS.39.53.E09.1.454.CMB.1.raw
  modified_base (413)..(413): a, c, t, g, unknown or other
  misc_feature (413)..(413): n is a, c, g, or t
  modified_base (450)..(450): a, c, t, g, unknown or other
  misc_feature (450)..(450): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcatttattagcctggtatcaacagcacccggggaagttcctagactcctgatctatgatgcatcctaatttacgaaccgtaggggtcccatctcgattcgagtggcggtgggtcgtgggacagtatttcacttctcaacctatccgagccagccctgcctgcctgaacgtntgcttagactaactttattacctgttaacaaaagttntagactaggttcgtacccggtagggtaccgttccggacccgaaggggtaccctaagggtacggaaacgtaccgaaacgtacgtcggtggtaccg

SEQ ID NO: 27076 - DNA, 777 bp, Homo sapiens
  misc_feature: GYAE6OF02HTAS8.39.53.E09.1.454.CMB.1.raw
  modified_base (207)..(207): a, c, t, g, unknown or other
  misc_feature (207)..(207): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatccctccctgtctgacatctgaggagacagntcacatcactgccggcagtcaggcattaggcattattagcctggtatacaacagaccgaccgggaagttccagacctcctgatctatgatgcactactaatttaacgaaccgtaaggggtcccctaatcctacgtaacttacgtacggttggtaccgggttggggtaccttaggggaaccgtaggtacttttccgtaacgttcccgttaaccaaccctaagttccgaaacggaccgtaaacggttcccgttaacggtaccgtttccggtacccgtttaacggaaaacggttagtccggttacgtaccgggttaaacctttaaaacccgttttaactttaacccgtttaacggttaaaacccgtttaaaaaagggttaacgttaaacgggtaaaccgtacggggtttaacccgggtttcccccgggtttaaggggttaaccccgggttttacccgggtaaccccgggaacccggggttaaacccggggttaaaccgggtaacgggttaaaaccggtaaaaccgttaaaaacccggggttaaaccgttaacgggttccgggttaaacccggg

SEQ ID NO: 27077 - DNA, 617 bp, Homo sapiens
  misc_feature: GYAE6OF02HTP66.39.53.E09.1.454.CMB.1.raw
  modified_base (441)..(441): a, c, t, g, unknown or other
  misc_feature (441)..(441): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgacatccagatgacctagtctccatcctccctgtctgcatctgtaggagacagagtcacatcacttgcggcgagtcaggcattaggcattattagcctggtatcaacagcacccggggaagttcctagactcctgatctatgatgcatccaatttagaaccgtacggggtccagttcctacgattacgaggtgggcgggttgggtcgtggggactaggtacttttcgaacttcctaccgtaaccatccaaggtaccaggtcccgtggccttcggaccctaggtaaacgntacggccttagacctaaactttagtttaaccgtagtaacctaaaaggttactaggacgttagttccgtacccggttagggtacccggtttacccgggaaccccggttaagggaacccgttaaagggtacggtaaaacgtacccgtaaaaaccggtacgtcgggtcggacttaccgg

SEQ ID NO: 27078 - DNA, 491 bp, Homo sapiens
  misc_feature: GYAE6OF02HH3KF.39.53.E09.1.454.CMB.1.raw
  modified_base (478)..(491): a, c, t, g, unknown or other
  misc_feature (478)..(491): n is a, c, g, or t
tcagtcgcactagtcacgaccggtgctcgatttagagagagtgtgttgggtttggggggaagaggaagactgacggtccgccaggctccagggaaggggctggagtgggtcgccaacattaagaaagatggaagtgagaaaaactatgtggactctgtgaagggccggtttaccatctccagggacaacgccatgcatttagcaatatttgacaaaataaaacagtctgagagccgaggacacggcttcatatcactgtgcgctggggcactatggattctggggccaagggaccacggtcaccgtctcctcacgcctccaccaacgggccccaagtccggtccttcccccctgggccgtcccctgcctccgaggacgccaccctccgagacgcacagccggccctggggctgcctgggtcaaacggactaccttccacttagtgcgactggacgtcgggctggacaaggcacatagnnnnnnnnnnnnnn

SEQ ID NO: 27079 - DNA, 626 bp, Homo sapiens
  misc_feature: GYAE6OF02H5M34.39.53.E09.1.454.CMB.1.raw
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
  modified_base (355)..(355): a, c, t, g, unknown or other
  misc_feature (355)..(355): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatccctcctgtctgcatctgtagagacagagtcaccatcacgttgccggcgagtcgaggctagttaggctattattacgctggtatcaacngaccgaccggggtagtcctagactctnatctatgatgactatacctaagtttacgaaccgtacgggtaccctactctacgtacgttacnggttgggacgggttggggtcgtcggggacgtaggttactttcgactcgtaccacctatcagcacgtcctncgtacnccgttagaagcgtgcttacgaaccttaactttagttacgtaagtaaacctaaagttctaacgacgtacggttccggttacccggtacgggttaaccggttaccccgggacccggtaacggggtaacccgtaaagggggttaaccgaaacgttaacccggtaaaaaccggtacggtttaccggaccggttaacccg

SEQ ID NO: 27080 - DNA, 643 bp, Homo sapiens
  misc_feature: GYAE6OF02HR3XB.39.53.E09.1.454.CMB.1.raw
  modified_base (267)..(267): a, c, t, g, unknown or other
  misc_feature (267)..(267): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgacatccagatgacccagtctccatcctcctgtctgcatctgtaggagacagagtccaccatcacttggccgggcgagtcagggcagttaggctattattagcctggtatcaacngaccgacccggggaggttcctagacctcctagactctatgatgctactacctaattacgaaccgtacggggtaccatcgtacgtattcgaggtggcgggtgggtcgtcgggactaggtactttcaccttcaccactactcagccacgtcccgtagtccgttagtcccgtaggtaaacgtagtcgtccgttacgtaacctaacgtttatttaccgtacgttaaactaaaagttacgtacgaaccgttaggtccggtttacccggttacgggttacccgggttacccgggtaccccggtaaccggggtaaccggtaacgggtaacggaaacgtttaaccgaaaccggttaccgttacgggttccgtacggtaacccgg

SEQ ID NO: 27081 - DNA, 596 bp, Homo sapiens
  misc_feature: GYAE6OF02JNRI5.39.53.E09.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctactgctctggcctcccagataccagatgtgacatccagatgacccagtctccatcctcctgtctgcatctgtagganacagatcaccatcacttggccggngagtcagggcagtaggcattattagctggtatcacagacaccggggagtcctagactcctgatctatgatgacatacctaattacgaaccgagggtccctatctacgattcgagtgggtcggtggtcgtgggactagtactttcacgttctcgacctactacgagtacgagtcccgtagcctacgtccaggtaagtactcgtacgtagtaccttaaactttacgttaactacgttaactaaaagttctaacggtacgtaacggttcggttacccgtagggtaccccggttaccgggtaacccgagggtaacccggtaaggtaaccggtaaacgtaccgtaaaaccggaacgttacggtacggtctaaccgg

SEQ ID NO: 27082 - DNA, 685 bp, Homo sapiens
  misc_feature: GYAE6OF02GVBK5.39.53.E09.1.454.CMB.1.raw
  modified_base (199)..(199): a, c, t, g, unknown or other
  misc_feature (199)..(199): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctcctgtctgcatctgtaggnacagagtcaccatcacttggccggcagtcagggcattacggcattatttacgcctggtatcaacagcgacccggggaaggttcctagacctctgattctatgatcgcacttcccaaagttttacgaaacccgtacgggggtacccattccgtacgtatttcgaaggttcgggccggggttagggttccgtagggggtaacctagggtactttttaccgaccttcctaccgaaccctagtacgtacgtacctacggtacccttgaccgttaccggtcccgttaggaacgtagttcgccgttacgacctttaaaccgtttacgttttaaccgtagttaaaccgtaaaagttagttacgaaccgttacggttacggttccccggttagggtacccgggtttcccgggtaccccggtaacgggggtaaccccaagggggttacgtaaaaccgtacccgtaaaaccgggtacgttacgggtacggtacccg

SEQ ID NO: 27083 - DNA, 726 bp, Homo sapiens
  misc_feature: GYAE6OF02JRRUV.39.53.E09.1.454.CMB.1.raw
  modified_base (200)..(200): a, c, t, g, unknown or other
  misc_feature (200)..(200): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaggngacagagtcaccatccacgttcggccgggtcgaacgtcgacggggtcctagttacggtccgtaatttacgtttaagcccgttaggttacgttcaaaccacggtacccggtaacccgggggtaaccggtttaccgtaacggtaccttaccgtacggtacttcgtaatgtaactcgctactactaaatttacgaaccgtaacggggtaccctagtacctacgtacttacgagtacgggtcgggttgggtcggtcgggactaggtactttccgactaccgtacacccgtaagttcaaacgttccgaacgccctgtaccgtcgtaccctaggacgtatcgtctacggtaccttaacgttaacttacgtacgttaaacaaacggttctaaacgtacgtccggttacgtcccgggttacggtacccggtttaacccgggtccggtaaaccggggttaacccgtaaaggttaaccggggtaaacttaaccggtaaaacccggttaacgttaccgggtaacggttaaccccggg

SEQ ID NO: 27084 - DNA, 740 bp, Homo sapiens
  misc_feature: GYAE6OF02JQFO5.39.53.E09.1.454.CMB.1.raw
  modified_base (321)..(321): a, c, t, g, unknown or other
  misc_feature (321)..(321): n is a, c, g, or t
tcagtcgcactagtcacgaccggtgctcgatttagagagagtgtgttgggtttgggggtcgtcagagaggagccctagccctggactccaaggcctttccacttggtgatcagcactgagcacagaggactcaccatggaattggggctgagctgggttttccttgttgctattttagaaggtgtccaatgtgaggcgcaactggtggcgtcgtgggggaggtcttgggtccagccgttggggggtccctggagactctccgtgtacagcctctggtattcgaggtttagtgacgtccgtggtaactaacgtcggggtccncaggcctccgaaggggtaacgggctgggaacggtgggtccgaccgaaactaagttaaaggaaacgtagttagggaaacggttaggaaacggtaaaaaacttacggtaggtacgggtaacttaccggttggtaacgggtaaacggggttacccggttttaaccacgtttaccgtaccggaacggggaacctaaaccggcctaagtcgactaagtttacgactaagtttacttacggtaactaaaaacttaaacgtacgttacgtaagtaacggacggacggtaacggaccgtaaccggtcttacgaacgttactaccgacgttagtacgccggtcgtacggggtcctaacgttaagtcggtaacgtttacggacggggaccgaacggggcccgtaacggttaccaccggtttcctaccgg

SEQ ID NO: 27085 - DNA, 701 bp, Homo sapiens
  misc_feature: GYAE6OF02G65VY.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatcgaccctagtctccactccctccgtgtctgcatcgtggtaggagacagacgtccaccatctacgttcggccgggcgagtcgagggcagttacgctattacgttcgcgtgtactcaacgcgaccggtaccggggtacgttaccgtagacctcgtacgtactcgtatcgtatcgtactaactacctaaagtttaaccgaaccggtacggggtacccagttaccgttacgtacgtttacggtagggtccggggtcgggtcgggttccgtagggtactacgttaacgtttaccacgtttacctaccgaacccgtataccggacgtaccgtaccggtccgttagccgttacgtaccggtaagaacgtgttaccgccgttaagtacccttaacgtttaagtttacgaacgtttaacaaaacgttcggtaacgtaacgttccggttacggttacccggtacgggttacccggttcccgggaaccggtaaacgggacttaacggggtaacgaaccgtaacgtaaaccggtggttaccgtggtaccg

SEQ ID NO: 27086 - DNA, 292 bp, Homo sapiens
  misc_feature: GYAE6OF02HKSQL.39.53.E09.1.454.CMB.1.raw
  modified_base (126)..(126): a, c, t, g, unknown or other
  misc_feature (126)..(126): n is a, c, g, or t
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (272)..(292): a, c, t, g, unknown or other
  misc_feature (272)..(292): n is a, c, g, or t
tcagtcgcactagtcacgaccggtgctcgatttagagagagtgtgttgggtttgggacagatttcactctcaccatcagcagcctgctgcctgaagatgctgcaactttattactgtacaaaagtntgacagtgtcccgtggacgttcggcccagggaccaaggtggaaatcaaaacgtactggtggctgacacctatctgttcttacncgtccttcccgctatctgaacttagngacgtactggagcgggntggacaagggccatanagcnnnnnnnnnnnnnnnnnnnnn

SEQ ID NO: 27087 - DNA, 643 bp, Homo sapiens
  misc_feature: GYAE6OF02IPQGV.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatcgacccagtctccatcctccctgtctgctatctgtaggagacagacgtccaccatacctacgttcggccggggacgagtcgagggactagttaggactattattacgcctagtactacaacgacgaccgtaacccgggggtacgttccagtacctccgtagtactcgtatacgtatacgactactacctaaagtttacgaaaccggtacgggtaccctactcgtacgtatcgtacggtacggtcgggttacgggtcggtagggtacgtagttagtttacaaccgtctaccacctactactacgacgacgtccgtgcgttacgaccgtagaacgtacgtgtacgtacgtacttaactttacttacgtacgttaactaaagtgtaacgtacgtacgtaccggtaccgtacggtaccggttaccggaccggtaacgacggtaaggtaacgaacgtaccgtaaaccggaacgtcggtacgtacg

SEQ ID NO: 27088 - DNA, 638 bp, Homo sapiens
  misc_feature: GYAE6OF02HZ9HS.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatccctcctgtctgcatctgtaggagacagagtcaccatcacttgccgggtgagtcaggcattaggcattattagcctaggtatcaacagaccaccggggaggttcctagacctcctagatctatgatgcatccaatttacgaaccgaggggtcccagtctacgattcgagtgggcggtgggtccgtgggactaggtaactttcgaacttccgtcaaccctataccagccaggtccctagccgttacgccttaggaaacgtgtaccgtcgtacgtaacctaaacttttaacgtttaacgtacggttaaaacctaaaaggttactacggtaaacctaggtttacgttacccccgggttagggtaacccgggtttcccgggacccgggtaaaccgggtaacccggtaaacggggtaacggttaaaacgtaaccgtaaaaccggtaacgttcggtacggtaacccg

SEQ ID NO: 27089 - DNA, 635 bp, Homo sapiens
  misc_feature: GYAE6OF02HX7CG.39.53.E09.1.454.CMB.1.raw
  modified_base (209)..(209): a, c, t, g, unknown or other
  misc_feature (209)..(209): n is a, c, g, or t
  modified_base (353)..(353): a, c, t, g, unknown or other
  misc_feature (353)..(353): n is a, c, g, or t
  modified_base (550)..(550): a, c, t, g, unknown or other
  misc_feature (550)..(550): n is a, c, g, or t
  modified_base (626)..(626): a, c, t, g, unknown or other
  misc_feature (626)..(626): n is a, c, g, or t
tcagtcgcactagtcacgaccggtgctcgatttagagagagtgtgttgggtttgggggcagaagtctctctcagtcagggcacagctatggacatgagggtccctgctcagctcccgtgggactcctactgctctcggctcccagatacccagatgtgacatccagagtcgacccagtctccactcctcctgtctgcatcgtgtagganacgagacgtacaaccatacctacgttcggccggtcgagtcgaggacagtacggactacgtttacgttacgccgttaggtactcgaacgacgaccggtaacccggggtaacggttaccgtacggtacctccgtacgactactagngtacgtgacgtacgtacgtaaagttacggaaccgtaccgggtcctacgtctacgtacttacgtacggtcggtcgggtggtacgtaggacgtagtacgtttcacgttcctactacactgactaccgagtcccttgtaccgtccggtactacgtacgtgtcgtcgtacgtacctaacgttatacctagtaataaacgtntacggtactcggtccttaccggacggttaccgcggtaccgaaggtacctaaggtacaacgtaccaagtaccgtggngtacctacg

SEQ ID NO: 27090 - DNA, 579 bp, Homo sapiens
  misc_feature: GYAE6OF02JVYBS.39.53.E09.1.454.CMB.1.raw
  modified_base (142)..(142): a, c, t, g, unknown or other
  misc_feature (142)..(142): n is a, c, g, or t
  modified_base (461)..(461): a, c, t, g, unknown or other
  misc_feature (461)..(461): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
tcagtcgcactagtcacgaccggtgctcgatttagagagagtgtgttgggtttggggtcgagaagtctctctcagtcagggcacagcatggacatgaggtccctgctcagctcctgggactcctactgctctggctcccagntaccagatgtgacatccagatgacccagtctccatcctccctgtctgcatctgtaggacgacagtagtcaccagtcacttcgccgggcagtcgaggcagtaggctattattacgcctgtactctaacagccgacccgggtagttaccgtacgactcctgtacgtctactgatgcagtcctaattacgaaccgtacgggtccctaagtctacgtatcgtagtacggtgtcgggtactgggtacacgtacgtttacgacctcgtcgaacctagtccgtagacgtacgtcctggtacctcgtccgtacgatagtcgtactanaccgttaacttattaccgtagtactaaacgtntacgtanagttaccgcgtacggtgtacccggtacgacggtaacgtacgtaggaacctaacgtaaccgtacgtagtcgtacgtaacg

SEQ ID NO: 27091 - DNA, 714 bp, Homo sapiens
  misc_feature: GYAE6OF02JWA7Q.39.53.E09.1.454.CMB.1.raw
  modified_base (179)..(179): a, c, t, g, unknown or other
  misc_feature (179)..(179): n is a, c, g, or t
  modified_base (301)..(301): a, c, t, g, unknown or other
  misc_feature (301)..(301): n is a, c, g, or t
  modified_base (504)..(504): a, c, t, g, unknown or other
  misc_feature (504)..(504): n is a, c, g, or t
tcagtcgcactagtcacgaccggtgctcgatttagagagagtgtgttgggtttgggggcgagaagtctctctcagtcagggcacagcatggacatgagggtccctgctcagctcctgggactcctgctgctctggctcccagataccagatgtgacatccgagatgacccagtctaccncttccctcctgtcctgcactctgtagagtacagacgtccaccattcacttcgggcccggcgtagtcgaggggctacgttaggcctaagtttactttacggccgttaggttacttaccgaacnccggaccggtaacccggggtaacggtttaccctagtaacccgtccttggaacttaccttagtgaactcggtcctaactaccgttaattaaccggtaaccgacggggttacccattccgtacgtacttacggtacggtggtcggggtacggttcggtacggggtaaccaggtttacctttacgtacgttccgtaccgtaacccngttacgaaccgtccgaacggtccctggtaccccgttgaacccgttagtaaacgtcgtcgggtaccttacgacctttaactttacgttagttacgtaactaaaacgtttgaacgtacgttaacgtccgttaccggtaccggttacggttacccggaccgtacgggaaccgtaaggttcgtaaaccgtcgaaacgtacggtcgttagaccgg

SEQ ID NO: 27092 - DNA, 779 bp, Homo sapiens
  misc_feature: GYAE6OF02JWJT1.39.53.E09.1.454.CMB.1.raw
  modified_base (201)..(201): a, c, t, g, unknown or other
  misc_feature (201)..(201): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtagganacagacgtcaccatccacgttcggccgggcgagtcagggacagttaggctattactttagtcctggtatcaacgacgaccgaccggggaacgttccgtacgtactccgtgactactatcgagtcgactactacctaacgtttaacgaaccgtacgggggtaccctacgttacctacgtacgttaccgtaggtacgggtcggggttcggggttaccggtcggggtacgtacggtaagttttcctaaccgttcccttacgtacccgtaacttacgtaacgaccgtaacggtccccgttcggtaccgtttaccggtaccgttaaccgggtaaagtaccgttagtcccgttaacgtaaccgttaaaccttttaaaccggtttaaccgttaacggtttaaaccgtaaaacgggtttaacgtaacggttaaaccgtaccgggtttaaccgggttcccggtttaaccgggtacccgggtttaaccgggtaccccgggtaaccggggtaaacccggttaaacgggtaaccgggtaaacgttaaccgtaaaccgggttaaaccgttacggggtaccgttaacccggg

SEQ ID NO: 27093 - DNA, 813 bp, Homo sapiens
  misc_feature: GYAE6OF02ITJ99.39.53.E09.1.454.CMB.1.raw
tcagtcgcactagtcacgaccggtgctcgatttagagagagtgtgttgggtttgggggcagaagtctctctcagtcagggcacagcatggacatgggggtccctgctcagctcctgggactcctgctgctctggcctcccagataccagatgtgacatccagatgacccagtctccatcctcctgtctgcatctgtaggagacaggatcaacctatcacgttcggccgggacgtagtcgagggctaagttaggctaagtttaacgtttacgccgttaggtaactaccaaacgtacggtacccggtaaaccccggggggttaaaggtttacccgtaacggtaacccttacccgttaggtaaacctttccgttaagttacgtacgttacggaccttaacgttaaacccgttaaaacggttttaaaccggaaacccggttacccgggggttaacccctaagttcccgttaaccggtaacgttttaccgaacgggtttcggggtaccggggtttcggggttaccggttacggggtaaacccttaagggtttaaccttttacccgaacccgtttaccgtaaccccgtaaccgtaacgttacggtaaccgaccgttaccgtaccgttacggtcccgtcggtacccgtaagaaaccgtcgtacgccgttaacgtacctaaacgtttacgtacgttaacgtaacgtaaaagttctaacggtaacgacggtttccgtaccgggtacggtaaccgttcccgggaccgaagggtaaccgtaaggtacgtaaacgtaccgaaagtacgtacggtaggacctacgg

SEQ ID NO: 27094 - DNA, 669 bp, Homo sapiens
  misc_feature: GYAE6OF02FIBIF.39.53.E09.1.454.CMB.1.raw
  modified_base (225)..(225): a, c, t, g, unknown or other
  misc_feature (225)..(225): n is a, c, g, or t
  modified_base (398)..(398): a, c, t, g, unknown or other
  misc_feature (398)..(398): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctactgctctggctcccagataccagatgtgaccatcccagatgaccccagtcttacccatccctccctgtctgcatctagtacggagaccagacgtccaccntcacttcggcccgggtgacgtcgacgggcattacggctagtacttttagcctggtactccaacgacgtaccgacccggggtaacgttcctaacgtacttcctgacttctatcagtagcctaactacctaacgtttaacgaacccgtacggggtcccagtccttacgattacgnggtacggtcgggttcgggtccgtacggggactagtacgtttaccacgtcctccaccctacgtcagtccgtacgcctagccttcgacccgtagaacgtctcgaccgttcgtaacctaactttaacttaccgttagtaactaaacgtactaccgacgtacggtaccggttcccgtacggtaccggttacccggaccggtaaccggtaaccgtaacgggtaacgaaacgttaacccgaaaccgggtacttaccgggtacggtaccgttaaccgg

SEQ ID NO: 27095 - DNA, 562 bp, Homo sapiens
  misc_feature: GYAE6OF02HB3MU.39.53.E09.1.454.CMB.1.raw
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
  modified_base (465)..(465): a, c, t, g, unknown or other
  misc_feature (465)..(465): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatcgacccagtcctccatccctcctgtctgcatctgtaggagacagagtcaccatctacttggccgggcgacgtcagggcattaggcattatttagctgtagtcaanagccaccgggaaggttcctaggacctctgagtctacgtnatgcatacctaaagtttacgaaccgtacggggtaccacttactcgtattcgagtgggtcggttgggtcgtagggataggtattacgactcgtcacctatcacgcacgcgtgctgcctgaaagctgtctagtactaacttatactagtactaaaacgtntagtacagtaccggttccgtacggtaccggttccgaccggtaaccgggaaccgtaaggtacggtaaacgtacgaaaccgtaacgtggtaccggtacg

SEQ ID NO: 27096 - DNA, 597 bp, Homo sapiens
  misc_feature: GYAE6OF02HTLIB.39.53.E09.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (455)..(455): a, c, t, g, unknown or other
  misc_feature (455)..(455): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatccctccctgtctgcatctgtagganacagagtcaccatcacttgccgggngtagtcgagggcagttaggntattagttacgcctggtaatacaacacggaccgaaccccgggggtaaggttcctaacgaccttcctgactctatgatcgactatacctaagtttaacgaccgtacggggtccctagtcgttacgtattcgaggtgggtcgggttggggtcgtagggactagttattcacttctacacctatcagccagtcctacgctcgctagaaagngtacgctacgaacttaactttattacgtagtaacgtaaaagtatacgacttacggtacgttcccggtaggtaccggttacccggacggtaaccgggaaccgtaaggtacggtaaacgacgaaaccggtcgtacggtcggtac

SEQ ID NO: 27097 - DNA, 766 bp, Homo sapiens
  misc_feature: GYAE6OF02JR3NI.39.53.E09.1.454.CMB.1.raw
tcagtcgcactagtcacgaccggtgctcgatttagagagagtgtgttgggtttgggggcgagaagtctctctcagtcagggcacagcatggacatgagggtccctgctcagctcctgggactcctgctgctctggctcccagataccagatgtgacatccagatgacccagtctccatccctcctgtctgctatctaggtaggacgacagacgtccaccgatccagttacggccgggacgtacgtcgtacgggactacgttacggacgtaagtttacgttacgaccgttggtaacttaccgaaacgtacgacccggaaacccggggttaaacggtttccgtaacggtaccttaccgtaggtacttacgttaagttcggtaacgttgacctaacttaaccgttaaagttttaaaccggaaacccggttacggggttaacccctacgttaccgttacgtaacgtttaccgagggtttcggggacgggttcgggtacggtacgggtacgtaacggtttacgtttacctacgttcctacccgtaactacgttaccgcgtactacgtaccgtgtaccgtcgtaccgtaggtacgtaacgtccgtgttacgtaccttaacgtttcttaacgtaaccgttaagttaaccgtagtaaccgttataccggtcgggttacgtacccgggtaccggttaacccggccggttaaacccggggaacgttaaacgggcggttaaacctaccggaaacggttaccggtagtaccggtacgg

SEQ ID NO: 27098 - DNA, 642 bp, Homo sapiens
  misc_feature: GYAE6OF02GEOM9.39.53.E09.1.454.CMB.1.raw
  modified_base (201)..(201): a, c, t, g, unknown or other
  misc_feature (201)..(201): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtagganacagagtcacctatcacgttggccgggcgagtcgagggcagttaggctattagtttagccgttaggtactcaaacacgacgacccgggggtaacgttcctaggacctcctgactctatgatgacatacctaaatttaacgaaccgtacggggtcccatccgtacgtacttacaggtcgggtcgggttcgggtacgtacggggaactagtagtttaccacttcgtactacctatcgacggcacgtcctgtcgtcgtaccgtagaaacgacgttcgctacgtaccttaaacgtttacttaacgttagttaaaccttaaaagtacgttacgaacgtacgtccggttacccggtacgggttcccggttaccgggaccggtaaccggggtaacgtaacgggtaacggtaaccgtaaccggaaacggtaacgtacggtggtaaccgg

SEQ ID NO: 27099 - DNA, 707 bp, Homo sapiens
  misc_feature: GYAE6OF02FLT0J.39.53.E09.1.454.CMB.1.raw
  modified_base (211)..(211): a, c, t, g, unknown or other
  misc_feature (211)..(211): n is a, c, g, or t
  modified_base (431)..(431): a, c, t, g, unknown or other
  misc_feature (431)..(431): n is a, c, g, or t
tcagtcgcactagtcacgaccggtgctcgatttagagagagtgtgttgggtttgggggcagaagtctctctcagtcagggcacagcatggacatgagggtccctgctcagctccgtgggactcctgctgctctggcctcccagataccagatgtgacatccagatcgaccccagtcctccacttccctcccgtgtctgcatctggtagganacagacgtcaccatccacttcggccgggacgagtccaggggcagttaggcaatttatttagccttggtataccaacacggcgaacccggggtaagttccgtagaccttcccgtagacttactatgatgcactacctaagtttaacggaaccgtaccggggtccctatccttacgtatttcagttgggtacggttcggggtcgtagggacagtacttttcnccttactaccacgtctcgacgccgtaccgccgtacgtctaccggtaccacgtaacgtagttcgtaccgttacgaaccttaacgttttaaaccgttttacgtaacgtttaaaccgtaaaaacgttcaacggttaccgaacggttcccggttaccggtaccggggttacccgtaccgggacccgggtaaaccgggttaacccgggtaaacggggtttaaacggaaaccggtttaaaccggaaaacccggttaacggttcgggttaccggttaacccgg

SEQ ID NO: 27100 - DNA, 619 bp, Homo sapiens
  misc_feature: GYAE6OF02G700Z.39.53.E09.1.454.CMB.1.raw
tcagtcgcactagtcacgaccggtgctcgatttagagagagtgtgttgggtttgggggtctcagagaggagccctagccctggactccaaggcctttccacttggtgatcagcactgagcacagaggactcaccatggaattggggctgagctgggttttccttgttgctattttagaaggtgtccaatgtgaggcgcaactggtggcgtcgtgggggaggcttggtccaggccgtggggggtccctggagactctcctgtacagcctctggattcaggttttagtgacgccgtggaataaacgtcgggtccgccaggcctccgaggggaaggggctgggaggtgggtcgacaacagttaaagaaagataggaagtgaaagaaaaactatggtaggactcgtaggtagaacggggtcccggtttaaccattccgtaccgacggggaaccaaaccggcctaagtcgactaatttagactaattactttagaactaaaagtaaacagttactagagacgccggaaggaccgacggtcttacgatactacactgtgcgcgtgggacgtatagtggtacttcggtacgggacgaacgggaccgacggtccaccgttctacccg

SEQ ID NO: 27101 - DNA, 741 bp, Homo sapiens
  misc_feature: GYAE6OF02FV6EW.39.53.E09.1.454.CMB.1.raw
  modified_base (200)..(200): a, c, t, g, unknown or other
  misc_feature (200)..(200): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatcctccctgtctgcatctgtaganacagagtcaccatcacttgccggcagtcagggcattaggcattattagcctggtatcaacacgcgacccggggtaagttcctagacctcctgatctatgatgacatacctaatttacgaaccgtacggggtacccattccgtacgtatttcgaggttcgggtcgggttacggggttccgtacggggaactaggttacttttaccgaacctttccgttaccaacccgtagttaccgacgtaccgtaacggtccccgttggacccttcggtacccgttaagggaaacgtacgttacggtaccttacggtaacccttaaaccgttttaacgtttaaccgttaacggtttaaaccgttaaaaaacggttacgttaacggttaaccgttaacggggtttaccggttaccccggggttaacggttaaccccggggtttacccgggtaaccccggtaaacgggggttaaaccccgtaaaggggttaaccggttaaaaccgttaacccggtaaaaaccggttacccgtttaggggtaccggttacccgg

SEQ ID NO: 27102 - DNA, 700 bp, Homo sapiens
  misc_feature: GYAE6OF02F7UCF.39.53.E09.1.454.CMB.1.raw
  modified_base (500)..(500): a, c, t, g, unknown or other
  misc_feature (500)..(500): n is a, c, g, or t
tcagtcgcactagtcacgaccggtgctcgatttagagagagtgtgttgggtttgggggcaggaagtctctctcagtcagggcacgagcatggacatgaggggtccctgctcagcctcctcgggacctcctgctggctcgtggcctccgagataccagatgtagacatccagactgacccagtctccactcctcctgtctgcatctgtacgagacagagtcaccataccacgttcggccgggtccgtagtcgaggacctagttacggctaattacgtttagaccgttggtaacgtaccaaccacgtacccggacccggggttaacggttaccgtacggtaccttaccgtgtacttcctagtcgagttgacgtactacctaaagtttacgaaccgtacggggttacccacgtttaccgtacgttacgttcgtacgggtcggggtcgggttacgggttcgtacgggacgttagttccgtttacaccgttccgtacccacctanacccgtaagacgtaccgccgtcgtcgtcgttaccgtacgtagtacgtgtaccgtcgtaacctttaagtttaaccttacgttaacgtacttaaagtcgtagtacgtcgttaccggtaccgtcgggtacccggtaccggaccggtaaccgggtaactacggtaacggaacgtaacgtaaccggtaccgtaggtacggtaccg

SEQ ID NO: 27103 - DNA, 697 bp, Homo sapiens
  misc_feature: GYAE6OF02H8CYE.39.53.E09.1.454.CMB.1.raw
  modified_base (176)..(176): a, c, t, g, unknown or other
  misc_feature (176)..(176): n is a, c, g, or t
  modified_base (690)..(690): a, c, t, g, unknown or other
  misc_feature (690)..(690): n is a, c, g, or t
tcagtcgcactagtcacgaccggtgctcgatttagagagagtgtgttgggtttgggggcagaagtctctctcagtcagggcacagcatggacatggagggtccctgctcagctcctgggactcctactgctctggctcccagataccagatgtgacagtccagatcgacccagtcnccatcctccctgtctgctatctggtaggacacgagtcgtaccaccgtactcgtacgttcgggcccggggtcgtacgtcgaggggtcctaaaggtttacgggaccttaagttttaagtttacggtaccgttacggtaacttcaaaccgacgggaccgaaccccgggggtaaggtttccctagtaacctccgttgacgttccttagtcgtaatcgtactaacttacctaaattaacggaccgtaaccgggttcctactcttacggacttcgtagggtccgggtggtcggtcgtacggacgtacggtactttcgactccgtactaaccatccaagtcctaacggtcctagtccgtcggtactacgggatacgtgtaccgtagtaaccttaaaccgtttattaacttagtaaaccttaagtagtacgtacgtacgttcggtacccgttcgggttaaccggtccggaacccggtacgggaagtaacggtaacgacgtaacgaaccgttagtcggtacgngtaaccg

SEQ ID NO: 27104 - DNA, 957 bp, Homo sapiens
  misc_feature: GYAE6OF02H5BKG.39.53.E09.1.454.CMB.1.raw
tcagtcgcactagtcacgaccggtgctcgatttagagagagtgtgttggggtttgggggcagaagtctctctcagtcagggcacagcatggacatgagggtccctgctcagctcctgggactcctgctgctctggctcccagataccagatgtgacatccagatcgacccagtctccatccctcctgtctgctatcgtaggtaggacgacagtacgtccaacctattaccgtaccgttcgggccccggggacgtaacggtccgaacggggtacctaagtttacgggacctttaagttttacgtttaccggcccgttagggttaactaccgtaaaccgtacggtaccccgggtaacccggggggttaacggtttacccgtaacggtaacccgttccgtaggtaaccttaccgttaagttacggaacgttacgtaacctaacgtttaacccgttaaacggttttaaccggaaacccgggttaccgggggttacccctaacgtttccggtaacggttaacgtttaaccggtagggttaccgggggtacggggttacgggggttacggtacgggggtaaccgttaacgggtttaaccgttttacccgtaaccgtttccccgtaacccgtaacccgttaacggttaccgtaacccggtaccgtaacccgggttcccgttacgggtacccgtttacggtacccggttaaaggtaaccggtacgttacgggtaccgttaccgttaacccgtttaacgtttaacgtttaaccgttaacgttaaaccgtaaaagttaccgtaacggtaaaccgtttccgggttacccggttaccccggggttaacgggttacccggttaacccggggtaaaccccgggtaacggggtaacccggttaaaacggggtacggtaaaccgttaaacccgggtaaaaccggtttaccgggttacgggttacggtacccgg

SEQ ID NO: 27105 - DNA, 763 bp, Homo sapiens
  misc_feature: GYAE6OF02JLRS2.39.53.E09.1.454.CMB.1.raw
  modified_base (163)..(163): a, c, t, g, unknown or other
  misc_feature (163)..(163): n is a, c, g, or t
tcagtcgcactagtcacgaccggtgctcgatttagagagagtgtgttgggtttgggggcagaagtctctctcagtcagggcacagcatggacatggagggtccctgctcagctcctgggactcctgctgctctggctcccagataccagatgtgacatccagntcgacccagtctcatccctcctgtctgcatctagtagagacgagagtcaccatctacgttggccgggacgagtcgagggctagttaggactaatttagttacgcgttaggttataccgaacacggacccggtaacccgggggtaagttcccgtaacgtaccgttaccgtagtacgttacttaagtcggtaacttcgtacctaacttaccgttaaaacgtttaacggtaaaccggtcgggggtttaccccagtttaccctacggttaactttacggtaacgggttccggggtacggggttacgggttcggtaccggggaccgttaagttacgtttaccgtacctaccgtacacctacgtacgtacgcgtacgtccgtacgtcccgtgtacccgtaggtaacgtacgtacgtctacgtaccttaacgttttaacgtaacgttacgtaaacttaaacgttactacgggttaacgttacggttacccgttacgggttaccggttacccgggttaaccgggaaccggttaacccggggtaaaccgtaacgggttaaacggtaaaccgttaacggtaaaaccgtacggttacggtcggtaacccgg

SEQ ID NO: 27106 - DNA, 709 bp, Homo sapiens
  misc_feature: GYAE6OF02IFJBV.39.53.E09.1.454.CMB.1.raw
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
  modified_base (319)..(319): a, c, t, g, unknown or other
  misc_feature (319)..(319): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctccagataccagatgtagactatccaagactcgacccagtcctccactccctcctgtctcgctattctaggtaggacacgagacgtacaccatcctacgttcggccgggntagtcgagggctagttaggctaattnttagctggtatcaacacgccgaccgggtaagttcctagacctctacgntctatcgatcgactatacctaaattaacggaaccgtacggggtccctagtacctcgtacttacgagggtcggtcgggttcgggtctacggggtactacgttactttcgtaaccttccgtacctaaccgtattaccgaacgtaccgtcggtacccttcggtccgttaccggtcgttaacggtaaacgtacttacggtccgttaacgtacctttaaacgtttaacttttaacgtaaccgtttaaacgtaaaacgttactaacggttaacgttaccggttacccggttccgggttaccggtaacccgggtttacccggacccgggtaacgggtaaccggtaacgggtaacgtaaacgtaacccggtaaaaggtccgttacggacgttacccgg

SEQ ID NO: 27107 - DNA, 802 bp, Homo sapiens
  misc_feature: GYAE6OF02HJU6U.39.53.E09.1.454.CMB.1.raw
  modified_base (227)..(227): a, c, t, g, unknown or other
  misc_feature (227)..(227): n is a, c, g, or t
tcagtcgcactagtcacgaccggtgctcgatttagagagagtgtgttggggtttgggggcagaagtctctctcagtcagggcacagcatggacatgagggtccctgctcagctcctgggactcctgctgctctggctcccagactaccagatgtcgacactccagatcgacccagtctccatccctccgtgtctgctatcgtaggtagacgacagacgtccaacctntccgtaccggttcgggccccgggtacgtaacggtaccgacgggtactaacgttaacggacttaagtttaacgtttacggtcccgttaggttactaccgaacgtacggacccggtaacccggggtaacggttaccgtaacgtaccgttccgtaggtactacgtacgtggtacgtcgtactacttaccgttaagttaaccgaaccggtaccgggtcctacgttacgtacgtacgtacgtacgggtcgggtacgggttcgggtacggtacgggtactaacggttacgtttaccgtccgttaccgtacctaaccggtacttacgacgactaccggtccgtcgtaccgtcgtacgtaacgtagtcgtaccgacgttaccgtaacctttaaacgtttaacgtttacgtaacgttaaacggttaaacgtcgtaaacggtaccgttaggttaccccggttaccggttacccgggttaccgggttacccgggaacccggttaaccgggtaaaccggttaacgggtaacggtaaacccgttaacgggtaaaacccggttacgggttacgggtaccggtaacccgg

SEQ ID NO: 27108 - DNA, 598 bp, Homo sapiens
  misc_feature: GYAE6OF02FS61V.39.53.E09.1.454.CMB.1.raw
  modified_base (445)..(445): a, c, t, g, unknown or other
  misc_feature (445)..(445): n is a, c, g, or t
  modified_base (485)..(485): a, c, t, g, unknown or other
  misc_feature (485)..(485): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatcgacccagtcctccatccctcctgtctgcatctgtaggagacagagtccaccatccgacttggccgggcgagtcgaggctagttacggctaatttatttacgcccttaggtatccaacagaccggaacccgggggtaagttccgtacgtacctcctgactactatgatcgctactacctaattaccgaaccgacggggtcccatccgtcgtatcgtaggtcggtcgggttgggtcgtaggggactacgttattccaccttcctaccacctactccgacgacncggcccttggctcgaccgtgaagtctcgctgactaacttnttaccgttagtaacaagtactagacgtagtccgttccggtcggtaccggttacccgggaccgtaacgggaaccgaagggtacggaacgtaaccggtaacgacgtggtacgacg

SEQ ID NO: 27109 - DNA, 768 bp, Homo sapiens
  misc_feature: GYAE6OF02GRLWM.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatcgacccagtctccatccctccctgtctgcatctggtaggagacagagtcaccatcacgttcggccgggcgagtcgaggggcctattagggcctaatttaagtttacggcccttaggttactacctaaacaacggacccggaaccccggggggtaacggttacccgttaacggtaccttcccgtagtaacttccgttagtacgtagtcggtacctaacgttaccttaaaacggttttaaacggaaacccggtaaccggggggtaccctaaccgttacttacccggtaattttccggtaacggggttcggggtacgggttgggggttaccggtcggggtaactaggttacgttttcccaccgttaccttaccaccgtacaccagaaccgtcgtacccgtagtccgtcgtaccgttagtaacgattcggccttagtacccttaaaacgtttcgttaaccgttagtaaaacgttaaagttacctaggtaacctcggtacgggttcccgtacgggttacggtcccgggtaaccgggaaccgggttaaccgggtaaggttacgggtaaaccttaaaccgggaaaccgtaagttcggggtaacgttacccgg

SEQ ID NO: 27110 - DNA, 746 bp, Homo sapiens
  misc_feature: GYAE6OF02GIMZL.39.53.E09.1.454.CMB.1.raw
  modified_base (131)..(131): a, c, t, g, unknown or other
  misc_feature (131)..(131): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctntggctcccagataccagatgtgacatccagatcgacccagtctccactccctccctgtctgcatctagtaggagacagacgtccaccatcctacgttcggaccgggacgaggtacgaggggctaagttagggctaatttaacgtttacgtaccgttaggttaactaccgtaaaccgaccggaaccgggtaacccccggggggtaacggtttacccgtaaccggtacccgtttcccgtagtacgttacctagtacggtaatcgtacctaacgttaaccgttaaacgtttaaccggaaacccggtaccggggtaccctacgttccgttaccgtacttacgtagggtcgggtacggggttacgggtccggtagggtaccgtaggttaccgtttacgacctttacccgtaccaacccgtaacgttcgacggttaccaccgtccgtcgtacgtccgcgtaagacgtatcgtactacgtacctaagtttacttacgtaacttaaagaaacgtcgtaactacgtacgttaccggtccggtacggttaccggtacccggacccggtaaagggaaccgttaaggaacggtactaacccggaaacgtcggtaggtacgtaaccgg

SEQ ID NO: 27111 - DNA, 731 bp, Homo sapiens
  misc_feature: GYAE6OF02G1J9X.39.53.E09.1.454.CMB.1.raw
  modified_base (574)..(574): a, c, t, g, unknown or other
  misc_feature (574)..(574): n is a, c, g, or t
  modified_base (592)..(592): a, c, t, g, unknown or other
  misc_feature (592)..(592): n is a, c, g, or t
tcagtcgcactagtcacgaccggtgctcgatttagagagagtgtgttggggtttgggggcagaagtctctctcagtcagggcacagcatggacatggacgggtccctgctcagctcctgggactcctggctgctctggcctcccagactaccagagtgtcgacatccaggtactcggaccctagtcctcctacttccctcccgtgtcgtagcctatcgtggtaacggacgacgaggtacacctaacctagtccaacggttcggccgggtacgtacggtacgaacgggtctaaggttacggtaaccttaagtttacgtttaccggtcgttacggtaactaaccgaacgtaccggggacccggttaaacccgggggttaacgttcccggaacgtaccgtccgttaggtacttacggtaagtcgtacgactacgttaaccgtaccgttaagttaaaccggaacccggttaaccgggtacctacgttactacgttaacgtcggtaccgttcgggtcgggttcgggtacgacgggtacgtacgtacttcgtactcgtacgtacgctcgacgtcgcgtcncgtcgtgtaccagtacgntcgtctacgtaactcgtaattcgtagtaaactacgtagtaccgtagtcggttccgtacggttacgggacccgtaccggaccgttaacggaccgggttaaggacggtacgtaaaccgtaccggtacggtcgaggtacccg

SEQ ID NO: 27112 - DNA, 706 bp, Homo sapiens
  misc_feature: GYAE6OF02FOSNJ.39.53.E09.1.454.CMB.1.raw
  modified_base (211)..(211): a, c, t, g, unknown or other
  misc_feature (211)..(211): n is a, c, g, or t
  modified_base (491)..(491): a, c, t, g, unknown or other
  misc_feature (491)..(491): n is a, c, g, or t
  modified_base (524)..(524): a, c, t, g, unknown or other
  misc_feature (524)..(524): n is a, c, g, or t
tcagtcgcactagtcacgaccggtgctcgatttagagagagtgtgttgggtttgggggcagaagtctctctcagtcagggcacagcatggacatgaggtccctgctcagctccgtgggactcctgctgctctggcctccgagactacagatgtagacatccagactcgaacccagtcctccacttccctcctgtctgcactcgtcggtagngtacagtacgtccaccgtatccgtaacgttcggacccgggacgtacgtacgacgggactagttacggtactatttatacgtccgtagtactacgaacgacggccggaccggggtaactcgaacgtccgtacgagtactctagtagtaacgtcgtaccgtaatacctaaacgttacggaaccggtaacgggtcctacgttacgtcgtaatcgtacggtgggcggttaggtccgtaggtacgtagttactttacgccttcaccgtacctagtcgaaccgtanaccgcttgtccgtacggtaccaggtaataccgnggttacctacgaacttaaccggtttaattaccttaacgtaaacctaaagtttacgacgttaagaccggtttaccgaccggtttacggaccgggttaccccggtaaccggtaaagggtaacccggttaaaagtaacggttaaacccgtaaaccggaaccggttaccggttaagcggttaaccc

SEQ ID NO: 27113 - DNA, 779 bp, Homo sapiens
  misc_feature: GYAE6OF02G04WU.39.53.E09.1.454.CMB.1.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagactaccagatgtgacatccagatcgaccagtctaccactcctcctgtcngcacgtntacggtagganacagtacgtcaccatcctacttcggccggtagaccccgtgagggctagtacgactatttagttacgtcctaggtaactacgaacgacggtaacccggtaaccgggggtacgtttaccgaacgtaccttaccgacgttactaccgtaagtacgtagtacgactaacttaccgtaagtttaaccggaaccgtacgggtaccctagtcgtactacgtaggtacggtcgggacgttcgggtgacggtacgtaacgtacgttactacgtaccgtacctacgaacgttacgacgtacgtaccgtccgtacgttaccggtctaaccggtacggtaaaacgtgttacgaacggttccgttaaccgttaacgttttaaccgttaacttaaacggttaaacgttaaacgttaacggttaaccgtaaccggttaggtttacccggtaccgggtttaaccgggtaacccggttacccgggtaaacccgggttaaaccgggtaaacccgggtttaaacggtaaaccgggttaaaaccgaaaccggtaaacggtttacccggttaacgggtacccggttaaccgg

SEQ ID NO: 27114 - DNA, 768 bp, Homo sapiens
  misc_feature: GYAE6OF02HTJEM.39.53.E09.1.454.CMB.1.raw
  modified_base (429)..(429): a, c, t, g, unknown or other
  misc_feature (429)..(429): n is a, c, g, or t
  modified_base (564)..(564): a, c, t, g, unknown or other
  misc_feature (564)..(564): n is a, c, g, or t
tcagtcgcactagtcacgaccggtgctcgatttagagagagtgtgttgggtttgggggcagaagtctctctcagtcagggcacagcatgacatgagggtcctgctcagctcctgggactcctgctgctctggcctcccagactaccagatgtgacactccagatcgacccagtctccactccctccctgtctgcattcgtagtaacggagaaccagtaacgtccaacctaacttaccgtaccgttcgggcccgggggacgtaacggtcggagggggtaccttaaggttaacggccgttaattttactttacgtcccgttagggttacttaaccgaaaccgacggacccgggtaaaccccggggggtaaccgtttaccgttaacgtacccgttcctacggtacttactttagacggttagtcggtaaccncgttaaccttaaagtttacggaaccggtaccgggtcctacgtcgttacttagttaccggaggggtcgggtcggggttacgggtacggtacgggtaacgtagttaccgtttaccaccgttccttacccaccgttanacccggagtacccgtacgtccgtcgaccgttccgacgtagagtagtcgtcgtactaactaagtttacgttagtaacgttaactaaacgttataccgtagtacggttaccggttacggttacgggtaaccgtaccgggtacccggtaacgggaacgtacggtaacggaaacggttaccgaaacggttacgtcggtacggtaaccg

SEQ ID NO: 27115 - DNA, 715 bp, Homo sapiens
  misc_feature: GYAE6OF02G8ZPP.39.53.E09.1.454.CMB.1.raw
  modified_base (202)..(202): a, c, t, g, unknown or other
  misc_feature (202)..(202): n is a, c, g, or t
tcagtcgcactagtcacgaccggtgctcgatttagagagagtgtgttgggtttgggggcagaagtctctctcagtcagggcacagcatggacatgagggtccctgctcagctcctgggactcctgctgctctggctcccagataccagatgtgacatccagatgacccagtctccatccctccctgtctgcatctgtagganacagagtccaccatcacgttcggccgggagtagtcgaggggtctagttaggctaatttatttacgccttaggtactacaaacagaccggaacccggggaacgttacctacgtacctccgtagtactctagtgatgacatacctaatttaacgaaccgtacggggtaccctacttccgtacgtacgtttcgtacggtcgggtaccgggttcggggtacgttacggggaacgttagttaaccgtttttccgaacccgtttccgttaacccgtaacccgttacttacccggtaagtcccgtaaacgtccccgttaggtacccgtttaccgggacccgttaaggtaacgtaacgtcgttaccgcgttaacctaaacgttttacttaacgttacgtaaacgtaaaagttcgtaacgtacgtaacggtttccgtaccggtttacggtaaccgggttcccggaccggtaacgggaccgtaagggtacggtaactacgaaacggtacggttggacgtaccg

SEQ ID NO: 27116 - DNA, 778 bp, Homo sapiens
  misc_feature: GYAE6OF02GFNOK.39.53.E09.1.454.CMB.1.raw
  modified_base (182)..(182): a, c, t, g, unknown or other
  misc_feature (182)..(182): n is a, c, g, or t
tcagtcgcactagtcacgaccggtgctcgatttagagagagtgtgttgggtttgggggtctcagagaggagccctagccctggactccaaggccctttaccacttggtgatcagcactgagcacagagactcaccatggaattgggctgagcgtgggttttcttgttgcttatttagaggtntccagtgtgaggtgcagctgggtggagtcgtgggggagtcgttggtccagcagtcgggggtccctgagtactctccgtggtcgacacgcctgtgattacctaccgttaagtaactacgttgtactggtacgtttcgggtacccgcccgtaggaccgtggacggtaaggggaaggggtccgtagggtggttacggggtacgtacccgaaacgtaggtaagggtaacggttaaggaacgtagggaaacggtaaagggtaaagtaaacgttaaccgtaaggttagtacgggtacctttcggttagggtaacggaaacggggtacccgtagttacccaacctagtacccgtaccgaaaggtaaccaacccggtaaccgacccgtaaaaggtaactttaccgaacctttagttaaactttaacccgaaaagttccgaaaacgtcgaccgttaggaacgacggaccggtaaagcccgtaacttacggttattaaaccgttcttaacggtttaacgggacggtaaccggggtaaagggtccgttaacgggtacggtcggtaacggggtccgttaccggtacccggggacccgtaaccccgggg

SEQ ID NO: 27117 - DNA, 695 bp, Homo sapiens
  misc_feature: GYAE6OF02FMFWG.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagctcctgggactcctgctgctctggcctcccagataccagatgtgacatccagatcgacccagtcctccactccctccgtgtctgctatcgtgtagagacagacgtacacctactcgacgttcgggccggcgacgtcggaggactagttacggacttaagttttacttacggtccgtagtactaccaacgtacggaccggtaacccggggttacgttacctacgtacctacgtcgtactcgtatgtatacgtactactaccgtaagttaaccggaaccggtaccgggtacctacgtccgtacgtacttacgtagggtcgggtcggggttacggtcggtacgggtactacgttacgtttcctacgtcctacctactacgccgtacgaccgtaccgcgtccgtacgtccgtacgtcggaagtcctcggtacttacgtaacttaacgtttactacgtaagttaaacgaacttacgacgtacgttaccggtaccgtacggtaccgggtaccggtacccggaaccgggtaaccggtaaccggtaacggtaacgtaaccgtaaccggtaacgtacggttcgtaccggtaccg

SEQ ID NO: 27118 - DNA, 786 bp, Homo sapiens
  misc_feature: GYAE6OF02HH35R.39.53.E09.1.454.CMB.1.raw
tcagtcgcactagtcacgaccggtgctcgatttagagagagtgtgttgggtttgggggcagaagtctctctcagtcagggcacagcatggacatgaggtccctgctcagctcctgggactctgctgctctggctcccagataccagatgtgacatccagatgacccagtctcatccctcctgtctgcatctggtaaggacgacagacgtcaaccatctacgttggccgggacgagtcgacgggcaacgttaggactagtttacttagccttaggttactacgaaccgtaggacccggtaacccgggggttaacggtttccgtaacggtaccgttaccgtagtaacttcgttaacgtcgtacgtcgtacctacttaccgttaaacgtttaacggaacccggtacggggttacccctacgtttaccgtacgttattcggtagggttcggggtcggggttcgggtacggtacgggtaacgtaggttacttttaccgaccgtttaacctaccggtaacctacgtaccgtacggaccgtacggtacccgtggtaccgttacggtacccgttacggaacgtacggtaccggtaccgttaacggaaccgttttaaacgtttaacgttaaccgttagtaaaccgttaaaagtttccgtaaggtacgttaccgggttccggttaccggtaacgggttaacccggttcccggggaaacccggtacggggttaaaccggtaaccgggttacggtaaactaaccggttaaacggttccggtacggtacggttaaccgg

SEQ ID NO: 27119 - DNA, 751 bp, Homo sapiens
  misc_feature: GYAE6OF02JYG77.39.53.E09.1.454.CMB.1.raw
  modified_base (557)..(557): a, c, t, g, unknown or other
  misc_feature (557)..(557): n is a, c, g, or t
  modified_base (587)..(587): a, c, t, g, unknown or other
  misc_feature (587)..(587): n is a, c, g, or t
  modified_base (744)..(744): a, c, t, g, unknown or other
  misc_feature (744)..(744): n is a, c, g, or t
tcagtcgcactagtcacgaccggtgctcgatttagagagagtgtgttgggtttgggggcagaagtctctctcagtcagggccacagcatggacatggacgggtccctgctcagcctcctgggacctcctgctgctctcggcctcccagactaccagtatgtacgacatccagacgtcgacccacgtcctaccactccctccctgtcctcgctacgtctaggtaggacgactagacgtacaactactcgaccgttacgggccgggacgacggtaccgacgggtaccgtagtacggtacttagtttaacgttacggtccgttacggttacaactaacggacggaacccgggtacccggggtaacgttaccgtacgtaccgtccgttacggtatactagtacgtatcgtacgtaactacgtaaacttaacggtaaccggtaccgggtacctactaccgttacgtacgttacggtcgggttacgggtaccggggttgggtacggtacgggtaacgtacgttacgttacctaccgccttaccaccgtctaccgacggtaccnccggtacctcggtacctccggtacggtaanacggtactccggtacgtacgttaaccttacgtttacgtaacgttaaacgacgtaaatcggttaacgtcgtaccggtcgtaccggtacgggtaccggtacccggacgggtaaccggtaacgtacgggtaactaaccgggtaacaacggtacggttacncggtacg

SEQ ID NO: 27120 - DNA, 884 bp, Homo sapiens
  misc_feature: GYAE6OF02HH7BS.39.53.E09.1.454.CMB.1.raw
tcagtcgcactagtcacgaccggtgctcgatttagagagagtgtgttgggtttgggggcagaagtctctctcagtcagggcacagcatggacatgagggtccctgctcagcctccgtgggactcctgctggctcgtcggccttcccagactaccagtatgtacgacactccgagtacgtacgaaccctacgttccctcctaccttccccttcccgttgtacctcgactacgttcgtacgggtaaggaacgtaaccgtaaggtaccgtaccaaacccgttacttaccccgttaaccgggttccggggaccccggggtacgtaacgggttaccggaacgggttaccttaaggttaacgttacttaagttttaaccgttacggtccgttaggtaactaccgaaacggtaccggaccccgggtaaccggggtacgttaccgtacgttaaccgttccgtagtaccttacgtagttaccggtactacgtacctaccgttaacgttaaccggtaacgacccgggtaccgtaccttacgtccgttaacggtatacgggttcggggtacggttccgggtaggtacggtaacgggtacttagttaccgttccgtaccttacgtaaccctacgtaccgtaacggtacctaccgggtccgtccgttacggttaccgtacggtacgttagtaaccgttacgaccgttaccttaacgttaacctttaacgttacgttaacggttaccttaacgttaaacggttacgaacggttacggttaccggttaccggttaccgggttacccggttaaccgggacccgggtaacggtaacgggttaaacgggtaaccgtaacggttaaccggaaaccgttcggtacgggttaccgacgttacccg

SEQ ID NO: 27121 - DNA, 821 bp, Homo sapiens
  misc_feature: GYAE6OF02JMGPT.39.53.E09.1.454.CMB.1.raw
tcagtcgcactagtcacgaccggtgctcgatttagagagagtgtgttgggtttgggggcagaagtctctctcagtcagggcacagcatggacatggagggtccctgctcagctcctggactcctactgctctggctcccagataccagtatgtgacatccagatcggacccagtcctccgactccctcctggtcctagcctattctggtaaggacgacaggtatccaacctaattctaccgttgggacccgggtagtacgttcggaacgggtcgtaagttacggacttagttagtttacgccgttaggtatcctaacgacggccgtaaccggggtacgttacgtaacgtacctccgtacgtacttactagtacgtacgtcgactaacgtaccgttaaagtttaaccggaaccggtaacgggtacccgtagttccgtacgttaaacgttcgtaacgggtcgggtcgggtttaccggggtacggttacggggtaacctacggtttaaccgtttccgaactttccggtaaccttaaccgtaccgttacgaccggttaacgaccgggtttcccttacggtaccgttacggtccgttaaacggtacgggttacttacggtcggtttaacctaccggttaactttaacggttaaccgttaaacgtaaaccgggtaattaaacggtcctaaacggtccgtttacccgggttacgttaccggggttacccggttacccgggtaacccggtaacgggtaccggttaaacgggttaaccggaaacggttaaaccccgttaagggtacccgttagggtaccgttacgacccg

SEQ ID NO: 27122 - DNA, 716 bp, Homo sapiens
  misc_feature: GYAE6OF02HO7V4.39.53.E09.1.454.CMB.1.raw
  modified_base (86)..(86): a, c, t, g, unknown or other
  misc_feature (86)..(86): n is a, c, g, or t
tcagtcgcactagtcacgaccggtgctcgatttagagagagtgtgttgggtttgggggcagaagtctctctcagtcagggcacagnatggacatgaggggtccctgctcagctcctgggactcctgctgctctggctcccagataccagatgtgacatccagatgacccagtcctccatccctccctgtctgcatctgtaggagacagactcaaccatccacgttaggccggggactagtacgagggactaagtttaggaccttaagtttaacgttttacgcccggttaggtactaaccgtaaacgacgggtaccgaaccccggggggtaacgtttccctaacggtaccgtcctaggaacttacgtaatgatcgactactaacctaagtttaacgaaccggtacgggtacctaagttcctacgtattcgtaggtcgggtacggttggacggtggtaacgtagttacgttacctacttcctaccgaactacgtcgaagtacgtaacgtccgtcgacgttacgaccgttagggaatacgttcgacgttaccgtaaacttacgttactttaacgtaagttaacgtaaaagtacgtaagaacgtaggttaccggtaccggtttaccgggtaacccggttacccgggaaccgtaaccgggtaaaccgtaaagggtaacgttaaacggaaacccgtaaaacggtacgtacggtacgtaccgg

SEQ ID NO: 27123 - DNA, 191 bp, Homo sapiens
  misc_feature: GYAE6OF01A7ZEJ.52.9.A09.1.454.CMB.1.raw
  modified_base (190)..(191): a, c, t, g, unknown or other
  misc_feature (190)..(191): n is a, c, g, or t
tcagcgcagtacgacacgaccggtgctcgatttagcgagacgcgcagggaccggtgctcgatttagctctacgccagggcacgaccggtgctcgatttagtcacgcgagaaagggaaggggctggccctgacgtgtttctgttccaccctcctctatacgatcgctgagcgggctggcaaggcgcatagnn

SEQ ID NO: 27124 - DNA, 161 bp, Homo sapiens
  misc_feature: GYAE6OF01EEPEV.52.9.A09.1.454.CMB.1.raw
  modified_base (159)..(161): a, c, t, g, unknown or other
  misc_feature (159)..(161): n is a, c, g, or t
tcagcgcagtacgacacgaccggtgctcgatttagcgagacgcgcagggcacgaccggtgctcgatttagtctgacgtcaaagggaaggggctggccctgacgtgttctgttcccgcctcctctatacgatcgctgagcgggctggcaaggcgcatagnnn

SEQ ID NO: 27125 - DNA, 164 bp, Homo sapiens
  misc_feature: GYAE6OF01AJ24Z.52.9.A09.1.454.CMB.1.raw
  modified_base (162)..(164): a, c, t, g, unknown or other
  misc_feature (162)..(164): n is a, c, g, or t
tcagcgcagtacgacacgaccggtgctcgatttagcgagacgcgcagggcacgaccggtgctcgatttagtctgacgtcaaagggaaagggggctggccctgacgtgtttctgttcccgcctcctctatacgatcgctgagcgggctggcaaggcgcatagnnn

SEQ ID NO: 27126 - DNA, 196 bp, Homo sapiens
  misc_feature: GYAE6OF01A2TCK.52.9.A09.1.454.CMB.1.raw
  modified_base (188)..(196): a, c, t, g, unknown or other
  misc_feature (188)..(196): n is a, c, g, or t
tcagcgcagtacgacacgaccggtgctcgatttagcgagacgcgcagggcacgaccggtgctcgatttagctctacgctcagggcacgaccggtgctcgatttagacgcgatcgaagggtttggggatgcgaagttactggcagccggaggtgcatggacggcgggcgtggacgaaggcgactatagnnnnnnnnn

SEQ ID NO: 27127 - DNA, 162 bp, Homo sapiens
  misc_feature: GYAE6OF02HZAOA.52.9.A09.1.454.CMB.1.raw
  modified_base (162)..(162): a, c, t, g, unknown or other
  misc_feature (162)..(162): n is a, c, g, or t
tcagcgcagtacgacacgaccggtgctcgatttagcgagacgcgcagggcacgaccggtgctcgatttagtcacgcgagaaagggaaaggggctggccctgacgtgtttctgttcccaccctcctctatacgatcgctgagcgggctggcaaggcgcatagn

SEQ ID NO: 27128 - DNA, 162 bp, Homo sapiens
  misc_feature: GYAE6OF02FINRZ.52.9.A09.1.454.CMB.1.raw
  modified_base (160)..(162): a, c, t, g, unknown or other
  misc_feature (160)..(162): n is a, c, g, or t
tcagcgcagtacgacacgaccggtgctcgatttagcgagacgcgcagggcacgaccggtgctcgatttagtcacgcgagaaagggaaggggctggccctgacgtgtttctgttcccgcctcctctatacgatcgctgagcgggctggcaaggcgcatagnnn

SEQ ID NO: 27129 - DNA, 166 bp, Homo sapiens
  misc_feature: GYAE6OF02GD2VP.52.9.A09.1.454.CMB.1.raw
  modified_base (163)..(166): a, c, t, g, unknown or other
  misc_feature (163)..(166): n is a, c, g, or t
tcagcgcagtacgacacgaccggtgctcgatttagcgagacgcgcagggcacgaccggtgctcgatttagtcacgcgagaaagggaaagggggctggccctgacgtgtttctgttcccaccctcctctatacgatcgctgagcgggctggcaaggcgcatagnnnn

SEQ ID NO: 27130 - DNA, 513 bp, Homo sapiens
  misc_feature: GYAE6OF01BKSGW.41.53.E09.1.454.CMB.1.raw
  modified_base (305)..(305): a, c, t, g, unknown or other
  misc_feature (305)..(305): n is a, c, g, or t
  modified_base (428)..(428): a, c, t, g, unknown or other
  misc_feature (428)..(428): n is a, c, g, or t
tcagtctatactatcacgaccggtgctcgatttagagagagtgtgttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaaactcatgatttangatgtcagtaatcggccctcgagggtttctaatcgcttctctggctccaagtctggcaacacggcctccctgaccatctctgggcctccaggctgaggacgaggctgatttatactgcagctnatactacaagcagcagctactctgtggtacttcgggcggaggaccaaggctcgacccgtcgtacggcacgcccaaggcctcccgg

SEQ ID NO: 27131 - DNA, 817 bp, Homo sapiens
  misc_feature: GYAE6OF01AC2MA.41.53.E09.1.454.CMB.1.raw
  modified_base (251)..(251): a, c, t, g, unknown or other
  misc_feature (251)..(251): n is a, c, g, or t
tcagtctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcagtgacgttggtgttataactntgtctcctggtaccaacagccacccaggacaaacgccccccaaactcatgatttatgatgtcaagtaactcgggcccctacgtaggggttttctaacgtccgtacctttcttcgtcgggtccttacccgtaaacggttccgttacgggaccgaaacccgtacccggggtcccctttacccccgtacggaacccctaacgttccccttcggttccggggacccttccccggaacggggtcccttagggaacggggaacccgggtaagggtaccgtttacgggttaagtttttaactttaacccgttacggtccgtaacgggcctttaaccaacgtttaactaaaccgtaaacggaccaggtaccgaacgtaccctaccgttaccgttaccgggttagggttaacggtttacccgggggaccggggtaaaccgggggaaaccccggtaaaaggttccccggttaaccgggtaaaccccccggttacccgggttaaacgggggttaccccgtaaacccggggtaccccccggtaaacgggggttccccccgtttaaccccccccggggg

SEQ ID NO: 27132 - DNA, 860 bp, Homo sapiens
  misc_feature: GYAE6OF01BH5Q0.41.53.E09.1.454.CMB.1.raw
tcagtctatactatcacgaccggtgctcgatttagagagagtgtgttgggtttggggggggtctcaggaggcagcgctctcgggacgtctccaccatggcctggctctgctattcctcaccctcctcactcagggcacagggtcctgggcccagtctgccctgactcagcctcgcctccgtgtcgtgggtcctccgtggacagtcgatccaccatctcctgcacgtcggaaccagctaggtcggacggtttgggtaggtttaactaaacttagttcggttccttccgttacggttaaacccaaaccgaacgacccgtaacccgaaccggaaccgaaaacccggtaccccccctaaaacttccgaatttaggttaattttaacgtagtaacgttacggtacgtaacgttaaaccggttcccgggtaccccgtttaccgggtttaacggggtttttaccttaaacgttccgttccgtttccttaccgttacgggtaccttaacccgtaacggtttccgtacggtaaccaaacccggtacccggtcccttaccccgtaccgaacctacgtttccgtccggtcgggtaccctaccgacgggtcgttacgggaaacgggtaccgggaaggtccgttacgttaagtttaacgttacgtacgccgtacggttacctacttaataaccgaacgtaaacggacgaacgtacgtacccgtaacgtaccgttaccgttaccgggttacggtaccggtttaccggggaccgggtaacggtacccggtaaccggtaccggtaccggtaaacccgttacccgggtaccggtaccgtaaccggaccccgggttaacgcccccggttacccccggg

SEQ ID NO: 27133 - DNA, 604 bp, Homo sapiens
  misc_feature: GYAE6OF02IGN0H.41.53.E09.1.454.CMB.1.raw
  modified_base (310)..(310): a, c, t, g, unknown or other
  misc_feature (310)..(310): n is a, c, g, or t
  modified_base (485)..(485): a, c, t, g, unknown or other
  misc_feature (485)..(485): n is a, c, g, or t
tcagtctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacagcaccaggacaaacgcccccaaactcatgatttatgatgtnagtaatccgtccctgtacgggttctaatcgcttctcgtggcctacaagtctggacacgaccggtccctccctacgacctactctcgtggcctccgaggctagggacggacggaggtctggtactttaacgttacgtgcgtacgtctactaataacttaacaacgaccagaccganccgtaactccgttacggttaggttaccggttccgggacgggtaaccgggaacccaaaggtccgtacggtacccgttccgaacgggttccaaccggacccggtaccggtccgtcccccgg

SEQ ID NO: 27134 - DNA, 687 bp, Homo sapiens
  misc_feature: GYAE6OF02HRFR4.41.53.E09.1.454.CMB.1.raw
  modified_base (181)..(181): a, c, t, g, unknown or other
  misc_feature (181)..(181): n is a, c, g, or t
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (311)..(311): a, c, t, g, unknown or other
  misc_feature (311)..(311): n is a, c, g, or t
  modified_base (544)..(544): a, c, t, g, unknown or other
  misc_feature (544)..(544): n is a, c, g, or t
  modified_base (579)..(579): a, c, t, g, unknown or other
  misc_feature (579)..(579): n is a, c, g, or t
tcagtctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgngtctgggtcctcgtggacagtcgatcaccntctctgcactggaaccngcagtgtacgttgggtagttataactntgtctcctgtaccaanacgcaccgagacaacgacccccaatcatcgtaattttagngtatgtactagtaacgtccggcccttaggtacgggttttactaacgtccgtactttcctacgttccggtaccttaccgtaacggtccgttacggacctaaacccgtacccggtcccccttacccgtaccgtaccctaacgttcccgtaccgggttccggggtcccttaacccggacgggtaccgtagggtaacgggtaccggtacgggtcgttaagtaacgtttacgtttacncggtactaaccgtctaacgtacgtaaactaacganacgtaacgaccgtagtacctacgtccgttcgttacggttacgtcggggaccggtacggaacgtacgcgttcggaccttcggtacgccgacgaccgtacgctaccccgg

SEQ ID NO: 27135 - DNA, 413 bp, Homo sapiens
  misc_feature: GYAE6OF01AEZL0.19.60.F05.1.454.CMB.1.raw
  modified_base (408)..(413): a, c, t, g, unknown or other
  misc_feature (408)..(413): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcaacgatatgatgagtcacctccgtggtggacatttggccaggggaccaaggttgaagtcaaacgaactgtggctgcaccatctgtcttcatcttcccgcatctgacacgagagtactgagcgggctgggcaggcgcatagnnnnnn

SEQ ID NO: 27136 - DNA, 411 bp, Homo sapiens
  misc_feature: GYAE6OF01BDZ7W.19.60.F05.1.454.CMB.1.raw
  modified_base (397)..(397): a, c, t, g, unknown or other
  misc_feature (397)..(397): n is a, c, g, or t
  modified_base (402)..(411): a, c, t, g, unknown or other
  misc_feature (402)..(411): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgacacgagagtactgaggcggctggcaaggcnatagnnnnnnnnnn

SEQ ID NO: 27137 - DNA, 435 bp, Homo sapiens
  misc_feature: GYAE6OF01A6SF5.19.60.F05.1.454.CMB.1.raw
  modified_base (287)..(287): a, c, t, g, unknown or other
  misc_feature (287)..(287): n is a, c, g, or t
  modified_base (417)..(435): a, c, t, g, unknown or other
  misc_feature (417)..(435): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagagttcactctcaccatcagcagcctgcagtctgaagtattttgctagtttatactgtcagcagtataatactgcctnagtactttcggcggaggaccaaggtggagatacgaaacgacgtgtggactgcacatctgtctcatccttcccgctctctgacacgagacgtactggacggcgggctagggaccgaaggcgacgtagtagnnnnnnnnnnnnnnnnnnn

SEQ ID NO: 27138 - DNA, 416 bp, Homo sapiens
  misc_feature: GYAE6OF01C5LX3.19.60.F05.1.454.CMB.1.raw
  modified_base (406)..(416): a, c, t, g, unknown or other
  misc_feature (406)..(416): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctgaagattttgcagtgtattactgtcagcagtacggtagttcatctccgacgttcggccaagggaccaaggtgaaatcaaacgactgtggctgcacatctgtctcatcttcccgcatctgacacgagagtactggacggcgggcgtggcgaaggcgacgatagnnnnnnnnnnn

SEQ ID NO: 27139 - DNA, 419 bp, Homo sapiens
  misc_feature: GYAE6OF01EEY18.19.60.F05.1.454.CMB.1.raw
  modified_base (408)..(419): a, c, t, g, unknown or other
  misc_feature (408)..(419): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtggggtctggggacagacttcattctcaccatcagcagactggagcctgaagattttgcagtgtattactgtcagcagtacggtagttcatcgtccgacgttcggccaagggaccaaggtggaaatcaaaacgaactgtggctgcacatctgtcttcatctcccgcatctgacacgagagtactgagcgggctggcgaaggcgacagtacgnnnnnnnnnnnn

SEQ ID NO: 27140 - DNA, 871 bp, Homo sapiens
  misc_feature: GYAE6OF01AZ2EK.19.60.F05.1.454.CMB.1.raw
  modified_base (837)..(837): a, c, t, g, unknown or other
  misc_feature (837)..(837): n is a, c, g, or t
  modified_base (861)..(861): a, c, t, g, unknown or other
  misc_feature (861)..(861): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagaacgtcgtacgtaggtcgacgtagggtcggtcgggtacggacgacgttacctacttacttcctaccaactactacgacgacgaacgtacggtaggaccgtacgtaaggaaagttttagtttccgagtaggttagtttaacttacgttacgtacgacggacgttaaccgggttaacgggtttacgttacttaccgtttcccggtaacccggtttaccggggttccccggaaaccggggtaaaccgggtaaaacccgggtaagggggtaaaacgtaaaccgtaaaacccggaaaaaccggttaacggttacggggtaccggtacgtaccgtaaccccgtaaacgttaaccgtttccggtttaccggttttaccccttaacgttaacccttttcccccccggttaccccccggtaacctttaacccgtttccggttaacccgaaaccccgggtaagggtaacgggtttaaacccgttttcgggaaaggggggaccccgggggggttccccggtttacggggtaccccgggtaaaaaacggggtaccgggggaccccaaacgttttaaaagggggacctcggacgtacgtacgtacgtacgtacgtacgtacgtagtacgtacgtacgacgtacgtacgtcgagtagtagtacgtacgtanacgacgtcgtacgagtacgacganactcgtgacg

SEQ ID NO: 27141 - DNA, 421 bp, Homo sapiens
  misc_feature: GYAE6OF01EAKYO.19.60.F05.1.454.CMB.1.raw
  modified_base (407)..(407): a, c, t, g, unknown or other
  misc_feature (407)..(407): n is a, c, g, or t
  modified_base (413)..(421): a, c, t, g, unknown or other
  misc_feature (413)..(421): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtttattactgtcagcagtataataactggcctcagactttcggcggtagggaccaaggtggagatacgaaacgactgtggctgcaccatctgtcttcactcttcccgcctatctagacacgagacgtactgaggcgggctgggcaaggcganagtagnnnnnnnnn

SEQ ID NO: 27142 - DNA, 438 bp, Homo sapiens
  misc_feature: GYAE6OF01BMFYF.19.60.F05.1.454.CMB.1.raw
  modified_base (242)..(242): a, c, t, g, unknown or other
  misc_feature (242)..(242): n is a, c, g, or t
  modified_base (425)..(438): a, c, t, g, unknown or other
  misc_feature (425)..(438): n is a, c, g, or t
tcagtactctcgtgcacgaccggtgctcgatttagtacgtcatcagggaaagggccaccctctcttgtagggccagtcagagtgttagcgagcaactacttagcctcggtaccagcagacacctggccaggctcccaggctcctcatccatggtgcatccaccagggccactggcatcccagacaggttcagtggcagtgggtctgggacagacttcattctcaccatcagcgagactggancctgaagtattttgctagtgtattactgtcagcagtacggtattcatctccgacgttcggaccaagggaccaaggtgaaatcgaaacgactggtcggctgaccacgatctgtcttcgattcctcccgactatcgtagacacgagacgtacgtggacgcgggctcggacgaaggcgagactgcnnnnnnnnnnnnnn

SEQ ID NO: 27143 - DNA, 522 bp, Homo sapiens
  misc_feature: GYAE6OF01DZ8JD.19.60.F05.1.454.CMB.1.raw
  modified_base (249)..(249): a, c, t, g, unknown or other
  misc_feature (249)..(249): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (493)..(495): a, c, t, g, unknown or other
  misc_feature (493)..(495): n is a, c, g, or t
  modified_base (497)..(522): a, c, t, g, unknown or other
  misc_feature (497)..(522): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagagttcactctcacatcagcagcctgcagtctgaaagtnttttgctagttttattactgtcagcagttaataataacgtggcctgagtacgtttcgggacgggacggaccgtaagggtaggagtactacgaaaacgtacgttggtggctcgaccaccgtattcgtcgttaccttcacgttcccgttccccgactacttccgtacgaaccgacggtaaggtacgttacgtaggacgggccgggtcgtacgggacgaacgggccgactaagtcgngtcngtacgnnngnnnnnnnnnnnnnnnnnnnnnnnnnn

SEQ ID NO: 27144 - DNA, 469 bp, Homo sapiens
  misc_feature: GYAE6OF01AVTBD.19.60.F05.1.454.CMB.1.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
  modified_base (416)..(416): a, c, t, g, unknown or other
  misc_feature (416)..(416): n is a, c, g, or t
  modified_base (435)..(436): a, c, t, g, unknown or other
  misc_feature (435)..(436): n is a, c, g, or t
  modified_base (439)..(469): a, c, t, g, unknown or other
  misc_feature (439)..(469): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatcccaccagggccactggcatcccagacaggttcagtggcagtgggtctgggacagtacttcattcctacaccatcacgcagaccgtggagcctagaanttttgctaggtntattactgtacagcgagtacggttagttactatccgtaccgacggttcggacgtaacgggaccaagggtagaaatcgaaaacgtatgtaggctgacacctatcngtctcactccgtccactatntgactacgacgtagtactgaggcgngtcgacgaaggcacgatgnnagnnnnnnnnnnnnnnnnnnnnnnnnnnnnnnn

SEQ ID NO: 27145 - DNA, 607 bp, Homo sapiens
  misc_feature: GYAE6OF01EIDUX.19.60.F05.1.454.CMB.1.raw
  modified_base (571)..(571): a, c, t, g, unknown or other
  misc_feature (571)..(571): n is a, c, g, or t
  modified_base (574)..(574): a, c, t, g, unknown or other
  misc_feature (574)..(574): n is a, c, g, or t
  modified_base (576)..(607): a, c, t, g, unknown or other
  misc_feature (576)..(607): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtgcaggtgggtctgggacagacttcattctcaccatcagcagacgtggagcctagaagtacgtttttagcctaggttgttaatttacgtcgttcacgtccgaaggttacggttagtttccagttcccgtaccggtacggttttccgggacccgtaaaggggaaccctaaaggggttaggtaaaaactaccgaaaaaccggtaaccttagggtacggaccttggaaccctacctaacgttcttacggtttccttaccgtacttaccccgtttccccgaccttacttcctacggtaaccgtacggaacgttaaacggttaaccgtcgggaacgggtcccggggtactacggggacggtaaacgggccgaaccgtaagtaaggnagngnnnnnnnnnnnnnnnnnnnnnnnnnnnnnnnn

SEQ ID NO: 27146 - DNA, 621 bp, Homo sapiens
  misc_feature: GYAE6OF01BXL4Q.19.60.F05.1.454.CMB.1.raw
  modified_base (210)..(210): a, c, t, g, unknown or other
  misc_feature (210)..(210): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (415)..(415): a, c, t, g, unknown or other
  misc_feature (415)..(415): n is a, c, g, or t
  modified_base (525)..(525): a, c, t, g, unknown or other
  misc_feature (525)..(525): n is a, c, g, or t
  modified_base (537)..(537): a, c, t, g, unknown or other
  misc_feature (537)..(537): n is a, c, g, or t
  modified_base (561)..(561): a, c, t, g, unknown or other
  misc_feature (561)..(561): n is a, c, g, or t
  modified_base (569)..(569): a, c, t, g, unknown or other
  misc_feature (569)..(569): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(584): a, c, t, g, unknown or other
  misc_feature (583)..(584): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (604)..(608): a, c, t, g, unknown or other
  misc_feature (604)..(608): n is a, c, g, or t
  modified_base (613)..(613): a, c, t, g, unknown or other
  misc_feature (613)..(613): n is a, c, g, or t
  modified_base (616)..(616): a, c, t, g, unknown or other
  misc_feature (616)..(616): n is a, c, g, or t
  modified_base (619)..(620): a, c, t, g, unknown or other
  misc_feature (619)..(620): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggcctcccaggctcctcatccatggtgctatccaccgaggtccactggcatcccagactaggttcagtggactaggtgggtcngggatgacttcattctacaccagtccaagtcagactggacgccttgaagtnttttagctaggtnttattacgtgtaccaggtacctaggttaccggtagttctacgttaccgtccggtacggttccggaacccggtaaggggacccaagggttacgaaaacgtaccaaaccggtaacgtcggttcggcctacggaccaaccggtntcggtttccttaactttcaacgggtttacccctttccccggacttaaccgttccgggttactaaccgggtaccgaccgggttaactttggacgggaacgggttcccgggngttaacccgggnaaacgggggccctttaacaggtancccgagcncggtntngcngntnngtgcgtngncgtcgtcgcgnnnnncgcanagngcnng

SEQ ID NO: 27147 - DNA, 468 bp, Homo sapiens
  misc_feature: GYAE6OF01EESNF.19.60.F05.1.454.CMB.1.raw
  modified_base (367)..(367): a, c, t, g, unknown or other
  misc_feature (367)..(367): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (439)..(468): a, c, t, g, unknown or other
  misc_feature (439)..(468): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggcctcccaggctcctcatccatggtgcatccaccagggccactggcatcccagacaggttcagtggcaggtgggtctgggacagacttcattctcaaccatcagcagactggagcctgaagtatttttgctagtgtattacctgtcagtcaagttacggtagttcattcctccgacggttccggaccgaagggaccaaagggtggaaaatcgaaaacgactggtgctgacacctatctntctcatctcccgcatctgacagatagtctgacggcggcgtggacgaaggtcgactaagtctagcgngtangnnnnnnnnnnnnnnnnnnnnnnnnnnnnnn

SEQ ID NO: 27148 - DNA, 411 bp, Homo sapiens
  misc_feature: GYAE6OF02HNTTA.19.60.F05.1.454.CMB.1.raw
  modified_base (404)..(411): a, c, t, g, unknown or other
  misc_feature (404)..(411): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgacacgagagtactgagcgggctgggcaaggcgcatagnnnnnnnn

SEQ ID NO: 27149 - DNA, 410 bp, Homo sapiens
  misc_feature: GYAE6OF02I283I.19.60.F05.1.454.CMB.1.raw
  modified_base (239)..(239): a, c, t, g, unknown or other
  misc_feature (239)..(239): n is a, c, g, or t
  modified_base (403)..(410): a, c, t, g, unknown or other
  misc_feature (403)..(410): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtggaaatcaaacgaactgtggctgcaccatctgtcttcatcttcccgccatctgacacgagagtactgagcgggctggacaggcgcatagnnnnnnnn

SEQ ID NO: 27150 - DNA, 421 bp, Homo sapiens
  misc_feature: GYAE6OF02GCP98.19.60.F05.1.454.CMB.1.raw
  modified_base (405)..(421): a, c, t, g, unknown or other
  misc_feature (405)..(421): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgttcggccaagggccaaggtggaaatcaaaacgaactgtggctgacacatctgtctcatcttcccgcatcctagacacgagactactgagtcgggctgggcaaggcgacatagnnnnnnnnnnnnnnnnn

SEQ ID NO: 27151 - DNA, 420 bp, Homo sapiens
  misc_feature: GYAE6OF02H25LN.19.60.F05.1.454.CMB.1.raw
  modified_base (405)..(420): a, c, t, g, unknown or other
  misc_feature (405)..(420): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctcgagttcggccaagggaccaaggtggaaatcaaaacgaactgtggctgcaccatctgcttcatctttcccgcatctgacacgagagtactgagtcgggctagggcaaggcacataacgnnnnnnnnnnnnnnnn

SEQ ID NO: 27152 - DNA, 565 bp, Homo sapiens
  misc_feature: GYAE6OF02H2AW0.19.60.F05.1.454.CMB.1.raw
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (512)..(514): a, c, t, g, unknown or other
  misc_feature (512)..(514): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
tcagtactctcgtgcacgaccggtgctcgatttagtacgtcatcaagggtaaagggggccaccctactcgttgtagggccagtcaggagtgttacgccaagcgaacctacgttagcctggtaccagcacgacacctggcccaggcctccgaggctccgtcagtcccatggtgccatccaccagggcccactcggccatccccaggaccacggtttcgagttggccgtagtcgggtctcggggtaccaggactttccagttcctccaccagttaccaggtctagtacttaggtagcccttcggaaggtatttttcgaccagttcgtattacctggtacacgactagtacggtagttcattctcgacggttcgactaagggaccgaacggtggaaagttcaaacgactgtgctgcaccatctgtactcgctccttccgctatcctcgacgacgacgagtactggacggcgggcgtggacgtaacggtctacgttagttaggntcagntgtcgcnnnactntntntgngngcngcgcgtcgtncncgacacgacacnctcnctctctc

SEQ ID NO: 27153 - DNA, 410 bp, Homo sapiens
  misc_feature: GYAE6OF02FQ6GX.19.60.F05.1.454.CMB.1.raw
  modified_base (239)..(239): a, c, t, g, unknown or other
  misc_feature (239)..(239): n is a, c, g, or t
  modified_base (391)..(391): a, c, t, g, unknown or other
  misc_feature (391)..(391): n is a, c, g, or t
  modified_base (397)..(398): a, c, t, g, unknown or other
  misc_feature (397)..(398): n is a, c, g, or t
  modified_base (400)..(410): a, c, t, g, unknown or other
  misc_feature (400)..(410): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaaggaccaaggtgaaatcaaacgactgtggctgcacatctgtcttcatcttcccgcatctgacacgagagtactgagcggctggcaaggcncatagnngnnnnnnnnnnn

SEQ ID NO: 27154 - DNA, 431 bp, Homo sapiens
  misc_feature: GYAE6OF02FNJWB.19.60.F05.1.454.CMB.1.raw
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
  modified_base (399)..(400): a, c, t, g, unknown or other
  misc_feature (399)..(400): n is a, c, g, or t
  modified_base (402)..(403): a, c, t, g, unknown or other
  misc_feature (402)..(403): n is a, c, g, or t
  modified_base (405)..(406): a, c, t, g, unknown or other
  misc_feature (405)..(406): n is a, c, g, or t
  modified_base (408)..(431): a, c, t, g, unknown or other
  misc_feature (408)..(431): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcacatctgtctcatcttccncatctgacncgagagtacngagcggctggcaaggcganagtagnngnntnncnnnnnnnnnnnnnnnnnnnnnnnn

SEQ ID NO: 27155 - DNA, 422 bp, Homo sapiens
  misc_feature: GYAE6OF02FHB4G.19.60.F05.1.454.CMB.1.raw
  modified_base (347)..(347): a, c, t, g, unknown or other
  misc_feature (347)..(347): n is a, c, g, or t
  modified_base (399)..(399): a, c, t, g, unknown or other
  misc_feature (399)..(399): n is a, c, g, or t
  modified_base (405)..(422): a, c, t, g, unknown or other
  misc_feature (405)..(422): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaaggggaccaaggtggaaaatcaaaacgaactgtggctgcaccatcngtcttcatcttcccgcatctgacacgagagtactgagcgggctggcaaggcncatagnnnnnnnnnnnnnnnnnn

SEQ ID NO: 27156 - DNA, 454 bp, Homo sapiens
  misc_feature: GYAE6OF02HGEVN.19.60.F05.1.454.CMB.1.raw
  modified_base (393)..(393): a, c, t, g, unknown or other
  misc_feature (393)..(393): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (428)..(454): a, c, t, g, unknown or other
  misc_feature (428)..(454): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagttgtattactgtcagcagtacggtagttcatctccgacgttcggccaagggaccaaggtgaaatcgaaaacgacgtgtggctgacaccatctgtcttcatccttccgcatctgacacgaagtagtactggacgcgggntcgggacgtaagggcgtacgaagttacgngcngannnnnnnnnnnnnnnnnnnnnnnnnnn

SEQ ID NO: 27157 - DNA, 551 bp, Homo sapiens
  misc_feature: GYAE6OF02GPTWA.19.60.F05.1.454.CMB.1.raw
  modified_base (253)..(253): a, c, t, g, unknown or other
  misc_feature (253)..(253): n is a, c, g, or t
  modified_base (519)..(523): a, c, t, g, unknown or other
  misc_feature (519)..(523): n is a, c, g, or t
  modified_base (525)..(527): a, c, t, g, unknown or other
  misc_feature (525)..(527): n is a, c, g, or t
  modified_base (529)..(551): a, c, t, g, unknown or other
  misc_feature (529)..(551): n is a, c, g, or t
tcagtactctcgtgcacgaccggtgctcgatttagtacgtcatcagggaaagggccacccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattcctcaccatcagcagtactggagcctgaaagtnttttgctaggtgtaattacgtgtcagactaggttacggttagtttccattccgtacccggtacggtttccgggaccaaacggggaccctaaaggggtacgggaaaacttacgaaaacggtaactggtacggtctacgccacctattccttaggttccttactaccttccgtttcccccgacctacttccgtacgacctaaccggaacgtacggtactacgggacggcgggtcgtacgggaccgaacgggccgtagacgtagcagannnnncnnncnnnnnnnnnnnnnnnnnnnnnnn

SEQ ID NO: 27158 - DNA, 479 bp, Homo sapiens
  misc_feature: GYAE6OF02H2MY3.19.60.F05.1.454.CMB.1.raw
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (390)..(390): a, c, t, g, unknown or other
  misc_feature (390)..(390): n is a, c, g, or t
  modified_base (426)..(426): a, c, t, g, unknown or other
  misc_feature (426)..(426): n is a, c, g, or t
  modified_base (450)..(479): a, c, t, g, unknown or other
  misc_feature (450)..(479): n is a, c, g, or t
tcagtactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccgagggccaactggcatcccagacaggttcagtggcaggtgggtctggggacagacttnatttccnccacatcagactagactggagcctgaaagtatttttagcaggtgtattacgtgtcagcaggtacggtagttcaagttcctacgtacgttcggaccaagggaaccaaggtagaaatacaaaacgaacgtgtcgactgaccacatctgtcttacgctaccgtcccncctatctacgacacgagtacgtagtgacggcgggtnacggacgaacggcgacgtagtgannnnnnnnnnnnnnnnnnnnnnnnnnnnnn

SEQ ID NO: 27159 - DNA, 628 bp, Homo sapiens
  misc_feature: GYAE6OF02FOKJX.19.60.F05.1.454.CMB.1.raw
  modified_base (386)..(386): a, c, t, g, unknown or other
  misc_feature (386)..(386): n is a, c, g, or t
  modified_base (512)..(512): a, c, t, g, unknown or other
  misc_feature (512)..(512): n is a, c, g, or t
  modified_base (522)..(522): a, c, t, g, unknown or other
  misc_feature (522)..(522): n is a, c, g, or t
  modified_base (549)..(549): a, c, t, g, unknown or other
  misc_feature (549)..(549): n is a, c, g, or t
  modified_base (579)..(579): a, c, t, g, unknown or other
  misc_feature (579)..(579): n is a, c, g, or t
  modified_base (589)..(589): a, c, t, g, unknown or other
  misc_feature (589)..(589): n is a, c, g, or t
  modified_base (614)..(614): a, c, t, g, unknown or other
  misc_feature (614)..(614): n is a, c, g, or t
tcagtactctcgtgcacgaccggtgctcgatttagtacgtcatcagggaagggccacctctctgtaggccagtcagagtgttagcagcaactacttagcctggtaccagcagacacctggccaggctcccaggctcctcatccagtggtgcatccgaccaggccactggcatcccagacaggttcagtggacaggtggtactgggacagaccttctattctaccacgtatcaggtacaggacctggagtcccgtagtaagtagtttgactagtacgttattacctgaccagcaggtacggtattcatccaccggtaccgttacggccaaagggcccgaaaggtagaaatacgaaacgtactacggtacgcgacgctaccgattcgngttactcgtaattcccgtttaccccggatacctacgtacgtaaccgtacggaacggtacgtaacgttacggccggtaccggggtggttaaccgggacgttaaacccggggacgaacccggtttaanaccgggttanaccgtgacgtcagccagtatacgtcgngtactagtacgacgacgtgacctacgtagngtacgtagtntacgtaacgtacgttacggtagganaccgtacgtagtcg

SEQ ID NO: 27160 - DNA, 209 bp, Homo sapiens
  misc_feature: GYAE6OF01AIL8L.44.20.B09.1.454.CMB.1.raw
  modified_base (161)..(209): a, c, t, g, unknown or other
  misc_feature (161)..(209): n is a, c, g, or t
tcagacagtatatacacgaccggtgctcgatttagtgtagtgtgaagggtaaagggtacgacggacttcgaggattaagcgaactgtggctcgcaccatctgtcttcatcttcccgccatctgatatagtactgtctgagcgggctggcaaggcgcatagnnnnnnnnnnnnnnnnnnnnnnnnnnnnnnnnnnnnnnnnnnnnnnnnn

SEQ ID NO: 27161 - DNA, 764 bp, Homo sapiens
  misc_feature: GYAE6OF01B2AI6.44.20.B09.1.454.CMB.1.raw
  modified_base (196)..(196): a, c, t, g, unknown or other
  misc_feature (196)..(196): n is a, c, g, or t
  modified_base (240)..(240): a, c, t, g, unknown or other
  misc_feature (240)..(240): n is a, c, g, or t
tcagacagtatatacacgaccggtgctcgatttagtgtagtgtgaagggggggtacgaacaagaggtcagcgctcgtcgggacgtactacctacatggcctgggctctgctgctcctcactctcctgactcaggacacgagggacctgggcccagtccgcctgactcagccagcctccgtgttggctccgtggacngtcgctcacctctcctgcactggaactatactgatgtagaaatntactgtctctgtacagtactaccagtaaaccccaatccgttacttatagaagtacaagttacgccggtcctcgggtacctagtttcctagtaacgttccgtacgttccgtacgtacggtacctaccgtaacgtcgttacggaccaaccgtaaccgggtccttacggttacgtaacgttaacgtttccgtacggtacccttacgtcgtacccgtacggtaaccggaccggtacggtaacccggttaacgttacgtttaaccggtttcgaaccgttcggtaccttacgtaagttacgtaccgggtacggttacccgtaagtacgtttaggttacgggttccgttacgggtacccgggtaacgggtcccggtaccgttaccgggtaaccgttccggttaacgggttacaccgggtaccgtacggtacccgtccggtcccccgttacggtccctaacggtttccgttcccggttaccccccttccgttaccttaccgtaaccgttcgttaaccgttcggttaacccgg

SEQ ID NO: 27162 - DNA, 786 bp, Homo sapiens
  misc_feature: GYAE6OF01EKUFQ.44.20.B09.1.454.CMB.1.raw
tcagacagtatatacacgaccggtgctcgatttagtgtagtgtgaagggggagagaggagcccagccctgggattttcaggtgtcttcatttggtgaccaggaccgaacagagagaagtctccatggagtttgggctgagctgccttttttcttgtggcttttttaaagggtgtcgtgtgtgaagtgcagttgttggagtcgtgggggggcctgattcggcctggggaggtccctgaccctctcctgtgcggcctctggattcacctttagtgcctatggcatgacctgggtccgccggctccgagggagggactggaggtggtctcgaagtagtcggagctgggtggtcgtctactttcgtacggagtaccgtccggtggaacgggtccgcttccacctactttcccgaagggactaaacgttcgacgaacggtaacctaaaatttcgttttacctacccgtaaaacttaacgtaaaaaacccgttacggtaaaccggaacccggtaacgggaaaccctaaccgaacggggtacccgttaacctttaacgtttaacgtttacggttttaaggaaaccgtacccgaacgggtaacccgaacccgggttacccggaacccccccctagttacccgtaaccgttaaccccgttttaacggtaccggtttaccggggggacccgggggtaccgtaacgggttcgggtcgtacccggttcgttcccgttccgtaccgtccccgttacccgaaccccgaaccgggtacccctacggtcccggtttcccccg

SEQ ID NO: 27163 - DNA, 724 bp, Homo sapiens
  misc_feature: GYAE6OF01CPTR4.44.20.B09.1.454.CMB.1.raw
  modified_base (378)..(378): a, c, t, g, unknown or other
  misc_feature (378)..(378): n is a, c, g, or t
tcagacagtatatacacgaccggtgctcgatttagtgtagtgtgaaggggagctctgagagaggagcccagccctgggattttcaggtgtcttcatttggtgaccaggaccgaacagagagaagtctccatggagtttgggctgagctgtccttttctgtggtcgtttttaaggtgtcgtgtgtgaagtgctagttgttggaggtcggtgggggggtcctgacgttcggcgtgggacggtccctcgaccctctcgtgtcgccggtcctcgtggtacttctaccgtttagtcgtcctagtcggcagtcggaccgtcgggtccggcccgggactccggaggggacgggactgggaggtggtctagtaacgtagtaccggngtcgtggtgtcgtctacgtttcgaacgagtaccgtcggacggacggtccgtccttacctaccttatccggaggtaacctacgtcgacgacgtaacgtaactttcgtacctaactaaataaccgtaaaaccgtagaaccggaaccggaacggtaacgaaccggtacgtacgttacttaagttaccgttagtaacgtaacgtccgaaccggacccgtaaccggtacccgaacccctagtaccgtaaccgttccgttaacggtaccggggttccggggtaccggggacttacgggcggttccggtaccgttcgtccgttacgcccgtcccacccgaaccggtaccccgg

SEQ ID NO: 27164 - DNA, 788 bp, Homo sapiens
  misc_feature: GYAE6OF01EZ0PX.44.20.B09.1.454.CMB.1.raw
tcagacagtatatacacgaccggtgctcgatttagtgtagtgtgaaggggagctctgagagaggagcccagccctgggattttcaggtgtcttcatttggtgaccaggaccgaacagagagaagtctccatggagtttgggctgagctgtcctttttcttgtggtctttttaaagggtgtcgtgtgtgaagtgcagttgtggagtcggtggggggcctgagttcggccgtgggacgtccctcgacccttctccgtggtcgccggtcctcgtggtacttccgtaccttttagtcgacccttaagtcggactaagtcgaccgtcggggtcccgcccggggctacccggaggggagggacgtggaggttgggtctacgaagtagtcggacgtcggtggtcggtcgtactacgtttcgtaacggataccgtccggtaggaacgggcctccgttaccaccgtattccgaagggtaactaacgtcgagaacgaacgtaaattcgtttacaactaaataacgaaaaccgtgaaccgaccgtaaggacaacgacggtactacttaacttacgtacgtttaacgaaacgtaccgacgggtaaccctaccgggtacccgaaccccccgtaagttacccgaaacccgtttaaccgtttaaaccgggttaacccggggttacggggggtaacccgggggtaacggtaacgggtttccgggtaaccggttaccccggttaccgttaccgttacccgttaacccggtcccccgttaaccccggaacccggtaaacccccggg

SEQ ID NO: 27165 - DNA, 589 bp, Homo sapiens
  misc_feature: GYAE6OF02GXDUC.44.20.B09.1.454.CMB.1.raw
tcagacagtatatacacgaccggtgctcgatttagtgtagtgtgaagggggagagaggagcccagccctgggattttcaggtgtcttcatttggtgaccaggaccgaacagagagaagtctccatggagtttgggctgagctgcctttttcttgtggctttttaaagggtgtcgtgtgtgaagtgcagttgttggagtctggggggggcctgattcggcctgggaggtccctgaccctctcctgtgcggcctctggattcacctttagtgcctatggcatgacctgggtccgccggggctcccagggaggggactggagtggggtctcaagtatcggagctggtggtgtcactttctacggagactccgtgaacggggccgcttcaccatttccgagggacaattcgcaggacaaatttgtttctacctaaatagaaaacctgacgaccgagacacagcgtctattactgttgaagccaggaccacggtcgacccccatcgactaccttagtacgttcggggccgggacgaggtggtcgaccgtcgtcgttccgagcctccaccgaacgggccctacgtccgttccccg

SEQ ID NO: 27166 - DNA, 713 bp, Homo sapiens
  misc_feature: GYAE6OF02HDHQA.44.20.B09.1.454.CMB.1.raw
tcagacagtatatacacgaccggtgctcgatttagtgtagtgtgaagggtaaagggggtactggatcaggactccgtcacgtttcaccctttcgtcaccaaagtcgtacggcttcccgtgctcagctcctggggctgctaatcgactctgggtactcggaggtccagtggaggtatattataatgtactcgagtcctcccctctcccgtggccgtcacccctggagagtccggcctccgagtgtcctgcaacgtcgtagtcacgagcctcctgccatagtgatcggaaagacgattactttacgtacgttaggttaccttggactaggaggtccgagggccctagtcctccgcagtccgtcctgacttctatcgtacttctttaccaagtcgtccgtactacgtaggtacgtcggaccgtaagtacgttagggtttcgaagggttcggacgtacgggacccggggtacggggtacctaggtatttaccgaaccgtaacgtacgtaaaacgtaccgtacggccggggttaggacggtccgtaggaacggtattacggttaaggtaacgttttaagttacgtaggtacctaggtacggaaccgttaaggcttaagttaccgtaccggtttaccccggtaccggtttcggacccgtaacggggaccgtagggttacgtaacgttcgaacggttaccggtaacgtttggacggtccg

SEQ ID NO: 27167 - DNA, 708 bp, Homo sapiens
  misc_feature: GYAE6OF02JNYC1.44.20.B09.1.454.CMB.1.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (285)..(285): a, c, t, g, unknown or other
  misc_feature (285)..(285): n is a, c, g, or t
tcagacagtatatacacgaccggtgctcgatttagtgtagtgtgaagggggggtcgacgaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgccactggaactatctgatgtagaaatntaacctntctntgtacaatctacccagtaaccccaatccttacttangaatcaatacgcgtacctcggactatttcactatccgtcttcacgacggtcctaccgaagttcctacggaccaaaccgtcgggtcccttacggtttgaaactttacgttttaccgtcgggtccccttaccgtgtaccccgtttaggaacccggtacgtaacggtcccgtaactttaattacgttcgtccttcgtacctaccgtaattacgttcgggtaccggttacctaagtacttacggtttcgggttccgttcgggaccgggtaccgggtacccggtccgttccggtaccggtccgttacggtaccgaaccgtacccgtaggtacccgttcccggtaccccccggttggtacccgtaccgttcccgttaccggttcccccgtccccttaccgttaccttaaccgttaccgtacctttccgg

SEQ ID NO: 27168 - DNA, 755 bp, Homo sapiens
  misc_feature: GYAE6OF02F88BR.44.20.B09.1.454.CMB.1.raw
tcagacagtatatacacgaccggtgctcgatttagtgtagtgtgaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggaggtccctgaccctcgtcctgtgcggcctcgtggattccacctttagtcgcctatggcatgacctgggtccgccgggctccgaggggaggggaccgtgggaggtgggtctcgaaggtatcggagcgtgggtggttgtctactttcgacggagtaccgtccgtggaacgggtccgtctttcgacctaatttcccgaaggggacctaacgtttcgacgacggaactaaagttttcgttttaccgtacctaaaacgtaacgtaaaaaccttcggaaacgtaaccccggaacggtaaccgaacgacgggtacccgttacttaacgtttacgttcgtttaagaaacgtaccgtaacggtaacccgtaccgggttacccgaacccccccgtaagtaccgaacccttaacccgttttacgttaaccgggtttacggggggacccgggggtaccgtacgggtcgggttaccggtacccggttccgttccgtttaccgacggtaccccgtacccgaacccggtaaccccggg

SEQ ID NO: 27169 - DNA, 892 bp, Homo sapiens
  misc_feature: GYAE6OF02FI516.44.20.B09.1.454.CMB.1.raw
  modified_base (336)..(336): a, c, t, g, unknown or other
  misc_feature (336)..(336): n is a, c, g, or t
tcagacagtatatacacgaccggtgctcgatttagtgtagtgtgaagggggagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtggggggggcctgattcggcctgggacggtccctgacccctctcctgtgccggcctctggacttcacctttagtgcctatggcatgacctggtccgccgggctcgagggaggggactggagtgggtctcaagtntcggagcgttggtggtgtctacttttccgtaacgggagacgttccggtacgaaagggggtccccgtacgtttcccaacccgtacttttcccgaaggggtaaccctaagtttcccggaccgaacgggtaaacctaaaacgttttcgttttacccttaccgtaaaaacgttaacggtaaaaaaacccctttcggaaaccgggtaaaccccggtaacgggtaaacccaaccggtaaacgggtacccgggtttaccttaaaccggttttaacgttaccgggtttttaacgggtaaaaaccggtccccgtaaacggggtaacccccgttaaaccggggttaccccggaaccccccccgtaacgttacccggtaaacccgttaaccccgtttttaacggtttaacccgggttttacgggggggaaccccggggggttacgaacgggtttccggggttaacgggtacccccggttccgttaaccgtttcccggaacgttccccggttacccgtaaccccgggtaaccggggtaccccctaccggttacccggtttccccccgg

SEQ ID NO: 27170 - DNA, 883 bp, Homo sapiens
  misc_feature: GYAE6OF02JVS4F.44.20.B09.1.454.CMB.1.raw
  modified_base (200)..(200): a, c, t, g, unknown or other
  misc_feature (200)..(200): n is a, c, g, or t
  modified_base (247)..(247): a, c, t, g, unknown or other
  misc_feature (247)..(247): n is a, c, g, or t
  modified_base (361)..(361): a, c, t, g, unknown or other
  misc_feature (361)..(361): n is a, c, g, or t
tcagacagtatatacacgaccggtgctcgatttagtgtagtgtgaagggagctctgagagaggggcccagccctgggattttcaggtgtcttcatttggtgaccaggaccgaacagagagaagtctccatggagtttggctgagctgtccttttcttgtggtctttttaaaggtgtcgtgtgtgaagtgcagttgttggngtcggtgggggctgattcggcgtgggacgtcctgaccctctccgtgngccggcctcgtggtacgtctacgttagtcgcctagtggcatcgtaccgtgggtcccgccggcgtccggagggacgggacgtggtacgttgggtcctagaacgtacgttacgggngtcgtacgggtggttcgtacgttacgttacgttacggacgaccgttccgacgggtacgggtcccgtacgttcctacgtacttacccggaacgggtaacgtaacgttccggaacgttacgaaacgttaacgtttccggtttaaccctaaccgtaaacgttaaaccggtaaaaacccttaccggtaaaccggaaaccccggtaaaccgggacgtaaaaccggtaccgggttaaccggtttacccttaaacggttttaccggtttaaacggtttaccggttaaaaccggttacccggtaaccggtaaccccgggtacccggttacccgggttaacccccctaaagggtttcccgtaaaaccgttacccccgttttaggggtttaacccgggttcccggggggtacccggggttaaccggttacgggttccggggtaaaccggttaccccggtttacggtttacccccgtttaaccggtaacccttacccggaacccgtttaccccggaaacccgggttcccccgg

SEQ ID NO: 27171 - DNA, 586 bp, Homo sapiens
  misc_feature: GYAE6OF01CI6GA.6.75.G09.1.454.CMB.1.raw
  modified_base (276)..(276): a, c, t, g, unknown or other
  misc_feature (276)..(276): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctatttagaaggtgtccaatgtgaggtgcaactggtggagtcgtggggggggcttagtccagcctggggactccctaagactctcctgtgcagcctctggattcattctttggctaagttctttgatgggctgggtccnccagattccgagggggccggcgtgggaggtggggtcggaccaacatccgaaacgacgatggacaaaaggacgaacctacttagtttggactcgtggtggagggggtccgttacaccatcctcagagacaacgccgaacaactcaactgtctctgctgatgagcagtctggacgacgcccgacgacacggtctagttcttaagttactgtacgaactaaacttctactactttcccgtatactcgtagtaaattacggtcgggggacccaaggggtaaccccttgggtacccttcgtccctcccgtgaccg

SEQ ID NO: 27172 - DNA, 512 bp, Homo sapiens
  misc_feature: GYAE6OF01E352O.6.75.G09.1.454.CMB.1.raw
  modified_base (310)..(310): a, c, t, g, unknown or other
  misc_feature (310)..(310): n is a, c, g, or t
  modified_base (328)..(328): a, c, t, g, unknown or other
  misc_feature (328)..(328): n is a, c, g, or t
  modified_base (360)..(360): a, c, t, g, unknown or other
  misc_feature (360)..(360): n is a, c, g, or t
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
  modified_base (417)..(417): a, c, t, g, unknown or other
  misc_feature (417)..(417): n is a, c, g, or t
  modified_base (466)..(466): a, c, t, g, unknown or other
  misc_feature (466)..(466): n is a, c, g, or t
tcagatatcgcgagcacgaccggtgctcgatttagtatagacatcaggggctcagagaggagccttagccctggactccaaggccttccacagaggactcaccatggaattggggctgagcggtggtttcgtgtaggcgtatttagaaggtgtccaatgtgaggtgcaactggtggagtctggggggggcttagtccagcctggggactccctaagactctcctgtgcagcctctggattcatctttggcaagtcttggatgggctgggtccgccagattccagggggccgctggagtgggtggccaacntcaacgcgatgcaaaggnacctactatttggactctgtgaggggccgttnaccatctcagagacaacgccganaactcactgtctcngctgatgagcagtctggagngccgacgacacgggctatctattacgtgtgcgaactctacattccgttnatctgattacgtggggaccagggaccctggtccgtctctcctcacg

SEQ ID NO: 27173 - DNA, 538 bp, Homo sapiens
  misc_feature: GYAE6OF01DWY3Y.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtgggggggcttagtccagcctggggactccctaagactctcctgtgcagcctctggattcatctttggcaagtcttggatgggctgggtccgccagattccagggggccggctggagtgggtggccaacatcaacgacgatgcaaaaggagacctactatttggactctgtgaggggccgttcaccatctccagagacaacgccgacaactcactgtctctgctgatgagcagtctgagagccgacgacacggctaatctattactgtgcgaaactctactatttcccgttcaattctagaaattacgtgggggacccaggggaaaccccttgggtaccgtcgtcctccctcgtacg

SEQ ID NO: 27174 - DNA, 575 bp, Homo sapiens
  misc_feature: GYAE6OF01BIS40.6.75.G09.1.454.CMB.1.raw
  modified_base (497)..(497): a, c, t, g, unknown or other
  misc_feature (497)..(497): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggacctccctaagactctcctgtgcagcctctggattcatctttggcaagtcttggatgggctgggtccgccagacttccgagggggccgcgtggaggtgggtcggccaacatccaaacggacgatgacaaaggacgacctactatttggactctgtggaggggtccgttcaccatcctacagacgacaacgccgaacaactcactgtctctgctgatgagcagtctaggagacgccgacgacgacggctagtctattactgtagacgaaactctactacgtttcccgttanactcgtagtaactaccggtcgggggaccctaaacgggggtacccctgggttacccgttccgtccttccgtccgtaccg

SEQ ID NO: 27175 - DNA, 572 bp, Homo sapiens
  misc_feature: GYAE6OF01DR7NM.6.75.G09.1.454.CMB.1.raw
  modified_base (312)..(312): a, c, t, g, unknown or other
  misc_feature (312)..(312): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcatctttggcagtcttggatgggctgggtccgccagattccgagggggccgctggaggtggggtggccaanatcaaacgacgatgacaaaaggacgacctatagtttggactctggtgaggggccgttcacatctccagacgacaacgccgaacaactcactgtctctgctgatgagcagtctgagacgcccgacgacgaccggctaacgttactaatttacgtgtacgacgtaaaccttctactactttccgtactattcgttagaaacttacggtcggggaccctaacgggtaaccccgtgggttccgtaccgttcctccgtcgtaccg

SEQ ID NO: 27176 - DNA, 545 bp, Homo sapiens
  misc_feature: GYAE6OF01CF0C6.6.75.G09.1.454.CMB.1.raw
  modified_base (415)..(415): a, c, t, g, unknown or other
  misc_feature (415)..(415): n is a, c, g, or t
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
tcagatatcgcgagcacgaccggtgctcgatttagtatagacatcaggggctcagagaggagccttagccctggactccaaggccttccacagaggactcaccatggaattgtggctgagctgggttttccttgttgctattttagaaggtgtccaatgtgaggtgcaactggtggagtcgtggggggggcttagtccagcctggggactccctaagactctcctgtgcagcctctggattcatctttggcaagtcttggatgggctgggtccgccagattccgagggggccgctgggagtgggtggaccaacatcaacgacgatgacaaaggacgacctactagtttggactctggtggaggggtcccgttcaccatcctccgagacgacaaccgccgaacaactcactgctcngctgatgagcagtctgagacgccgaacacgacgctatctattacgngtnaccgtaactctctacttccgtacagtctagaacttcggccggggaccaacgggtaccccttggtccgtccgtctccgtacg

SEQ ID NO: 27177 - DNA, 623 bp, Homo sapiens
  misc_feature: GYAE6OF01CJMIX.6.75.G09.1.454.CMB.1.raw
tcagatatcgcgagcacgaccggtgctcgatttagtatagacatcaggggctcagagaggagccttagccctggactccaaggccttccacagaggactcaccatggaattgggctgagctgggttttccttgttgctattttagaaggtgtccaatgtgaggtgcaactggtggagtcgtgggggggcttagtccagccgtgggactccctaagctctcctgtgcagcctctggattcattctttggcaagttcttggatgggctgggtccgccagacttccgagggggcccggcgtgggaggtggggtcggaccaacgagtaccgaaacgacgagtgacaaaaggacgtaccttactagtttcgacttcgtggtcggacggggtccgttcacctatcctaccgagacgaccaaccgccgaacaactcactgtcctctgctgactgacgctagtcgtaggagacgcccgaacgaccgacggtcttaacttacttaacgttacgtggtacgaaccgtaaacttcctactactttcccgttacattaccgtgtaaacttcggtccggggaccctaacggggtaacccccgttgggttccccgttcggtcccttcccgtcaccgg

SEQ ID NO: 27178 - DNA, 583 bp, Homo sapiens
  misc_feature: GYAE6OF01EOYZ6.6.75.G09.1.454.CMB.1.raw
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
  modified_base (487)..(487): a, c, t, g, unknown or other
  misc_feature (487)..(487): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcatctttggcaagtcttggatgggctgggtccgccagattccgagggggccgctggagtgggtggccaacatcaacgcgatgacaaaggacgacctactatttggactcgtggtggaggggtccgttcaccatcctcagacgacaacgccgacactcactgtctntgctgatggancagtctgacgacgccgacgacacggctatctatacgtgtagacctaaacttctactacgtttcccgttanaacgtttccgtagtaacgttaccggtcggggggtaccctaacgggggtaacccccttggggttacccgttaccggttcccttcccgtcgtacccgg

SEQ ID NO: 27179 - DNA, 595 bp, Homo sapiens
  misc_feature: GYAE6OF01BMT2Q.6.75.G09.1.454.CMB.1.raw
  modified_base (440)..(440): a, c, t, g, unknown or other
  misc_feature (440)..(440): n is a, c, g, or t
  modified_base (516)..(516): a, c, t, g, unknown or other
  misc_feature (516)..(516): n is a, c, g, or t
tcagatatcgcgagcacgaccggtgctcgatttagtatagacatcaggggctcagagaggagccttagccctggactccaaggccctccacagaggactcaccatggaattggggctgagctgggttttccttgttgctattttagaaggtgtccaatgtgaggtgcaactggtggagtcgtggggggggcttagtccagccgtggggacctccctaagactctcctgtgcagcctctggattcatctttggctaagtcttggatgggctgggtccgcagattccgagggggccgcgtgggagttggggtggccaaacatcaaacgacgatgacaaaggagacctactagtttggactcgtgtggacggggccgttcacctatcctacgaggacgaccaacgccgaacaactcacgtgtctctgctagatcgagtcagtntggaagacgcccgaacgacaccgggcttatacttaacttcgtgtacgaccgtaaacttcgtactactttccccgtnaattccgttaagaaacttcggtcgggggaccctaaacggggtaacccttgggtaccttaccgttcctcccgtagacccg

SEQ ID NO: 27180 - DNA, 547 bp, Homo sapiens
  misc_feature: GYAE6OF01CJEMA.6.75.G09.1.454.CMB.1.raw
  modified_base (333)..(333): a, c, t, g, unknown or other
  misc_feature (333)..(333): n is a, c, g, or t
  modified_base (426)..(426): a, c, t, g, unknown or other
  misc_feature (426)..(426): n is a, c, g, or t
  modified_base (459)..(459): a, c, t, g, unknown or other
  misc_feature (459)..(459): n is a, c, g, or t
  modified_base (483)..(483): a, c, t, g, unknown or other
  misc_feature (483)..(483): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcatctttggcaagtcttggatgggctgggtccgccagattccgagggggccgctggagtgggtggccaacatcaacgacgatgacaaaaggngacctactagtttcggactctggtggaggggccggttcaccatctcagacgacaacgccgaacaactcaactgtctctgctgatgagcagtcngagagccgacgacacggctatcctattactgtnacgtaaactctacatttcccgtanattcgtagtaatccggtcggggccctaaggggaccccttgggtcccgttgtcctccgtcaccgg

SEQ ID NO: 27181 - DNA, 610 bp, Homo sapiens
  misc_feature: GYAE6OF01CVS31.6.75.G09.1.454.CMB.1.raw
  modified_base (280)..(280): a, c, t, g, unknown or other
  misc_feature (280)..(280): n is a, c, g, or t
tcagatatcgcgagcacgaccggtgctcgatttagtatagacatcaggggctcagagaggagccttagccctggactccaaggccttccacagaggactcaccatggaattgggctgagctgggttttccttgttgctattttagaaggtgtccaatgtgaggtgcaactggtggagtcgtgggggggcttagtccagccgtgggactccctaagactctcctgtgcagcctctggattcattctttggcaagttcgttggatgggctgggtccgcgagngttccgagggggccgtcgtgggaggtgggtcggccaaagatccgaaacgacgagtgacgaaaggcgacctactagtttggacttcgtgtggacggggtccgttacacctaagtcctaccgaagagaaccgaaccgccgaacaactcaacgtcgtcctctcgctgatgagcagtctgagcgaccgacgacgacgctaatcttacgttacgtgtacgacgtaaaccgtctacgtacttcccgtactacgttcgtacgtaattaccggtcggggacccggttaacgggaccccgtttcgggtccgtttacccgtccttcccgtaccgtacccg

SEQ ID NO: 27182 - DNA, 557 bp, Homo sapiens
  misc_feature: GYAE6OF01CLAXT.6.75.G09.1.454.CMB.1.raw
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcatctttggcagtcttggatgggctgggtccgccagattccgagggggccgctggagtggggtggccaacntcaacgacgatgacaaaggacgacctactatttggactctgtggaggggccgttcaccatcnccagacgacaacgccgacaactcactgtctctgctgatgagcagtctgagacgccgacgacacggctatactattactgtagacgaaacttctactacttccgtacattccgtagtaattaccggtcgggggacccaacggggtaacccctgggttaccgtccgttccctcccgtcgtacccg

SEQ ID NO: 27183 - DNA, 597 bp, Homo sapiens
  misc_feature: GYAE6OF01DX3J3.6.75.G09.1.454.CMB.1.raw
  modified_base (275)..(275): a, c, t, g, unknown or other
  misc_feature (275)..(275): n is a, c, g, or t
  modified_base (538)..(538): a, c, t, g, unknown or other
  misc_feature (538)..(538): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcatctttggctaagtctttgatgggctgggtccnccagattccgagggggccgcgtggaggtggggtcggccaacatccaacggacgatggacaaaagggacgacctacgtatttggacttcgtggtggacggggcccgttcaccatccgtaccagacgaccaacgccgaacaactcactgtctctgctagatgacgctagtctaggagacgcccgaacgaccgacggcttaagtccttaattcgtgttacgacctaaactcttacactttcccgtatattccgtagaattaccggngggggaacccctaacggggtaaccccttgggtccgttacccgttcgtccctcgtacccg

SEQ ID NO: 27184 - DNA, 565 bp, Homo sapiens
  misc_feature: GYAE6OF01EHYU0.6.75.G09.1.454.CMB.1.raw
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
  modified_base (462)..(462): a, c, t, g, unknown or other
  misc_feature (462)..(462): n is a, c, g, or t
  modified_base (502)..(502): a, c, t, g, unknown or other
  misc_feature (502)..(502): n is a, c, g, or t
  modified_base (556)..(556): a, c, t, g, unknown or other
  misc_feature (556)..(556): n is a, c, g, or t
tcagatatcgcgagcacgaccggtgctcgatttagtatagacatcaggggctcagagaggagccttagccctggactccaaggccttccacagaggactcaccatggaattggggctgagctgggttttctttgttgctattttagtaaggtgtccaatgtgaggtgcaactggtggagtcgtggggggggcggttagtccagccgtggggacgtccctaacgactctcctgtgcagcctctggattcatctttggcaagtcttggatgggcgtgggtccgccagattccgagggggccggctggaggtggggtggccaacagtcaacggacgatggacaaaaggagacctacttagtttggactctggtggaggggccggttcaccatctccagacgacaaccgcacaactnactgtcnctgctgatgagcgagttcagacgacgcccgaacgacaccggntaatctaatttcgtgttcgacaactctctaattccgttanactcgtgaaatcggtcggggacccagggaaccccttgggtccttcggtcctccnccgtaaccg

SEQ ID NO: 27185 - DNA, 544 bp, Homo sapiens
  misc_feature: GYAE6OF01ECLP7.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagactctcctgtgcagcctctggattcatctttggcaagtcttggatgggctgggtccgccagattccgagggggccgcgtggaggtgggtggccaacatcaacgacgatgacaaaggagacctactattggactctgtggaggggccgttcaccatctcagagacaacgccgacaactcactgtctctgctgatgagcagtctagagacgccgacgacgacggtctatcttattacgtgtcgacgtaactctacactttccgtcatcgtagtaattccggtcggggacccaggggtaacccctgggtccgtaccgtccttccgcgaccg

SEQ ID NO: 27186 - DNA, 672 bp, Homo sapiens
  misc_feature: GYAE6OF01C11FV.6.75.G09.1.454.CMB.1.raw
  modified_base (515)..(515): a, c, t, g, unknown or other
  misc_feature (515)..(515): n is a, c, g, or t
tcagatatcgcgagcacgaccggtgctcgatttagtatagacatcaggggctcagagaggagccttagccctggactccaaggccttccacagaggactcaccatggaattggggctgagctgggttttcttgttgctatttagaaggtgtccaatgtgaggtgcaactggtggagtcgtggggggggcttagtccagccgtggggactccctaagactctcctgtgcagcctctggattcattcgtttggctaagttctttgagttgggctgggtccgccagtacgttccgagggggccggcgtgggaggtggggtcggaccaacgatacgaaacgacgatgacaaaaggacgaccttactagtttggactcgtggtggacggggtccgttacaccgtactccgtccgaagtacgaaccaaaccggcccgaaacaactccaacgttcgtcctacttggaccttggaattcggacgtactaggttctaggaacggaccggacccgtaacggaacnccgggtaaccttagttaccgtttaacgtttaccgttgacggaaccttaaaccgttcctacgttacgtttcccgtataacttcgtaagtaaacgtccggtgggggacccctaaacggggtacccttgggttaccctcggttcccctcctccgtaaccg

SEQ ID NO: 27187 - DNA, 762 bp, Homo sapiens
  misc_feature: GYAE6OF01CW7OP.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttcttgttgctatttagaaggtgtccaatgtgaggtgcaactggtggagtcgtggggggggcttagtccagccgtggggacctccctaagactctcctgtcgcagtcctctggtattctattcgtttggactaagttctttgagtgggcgttcgggtccgaccgagtacgttccggaggggggcccggcgttgggaggttcggggtcggaccaaacgtacgtaccgaaaccgacgaagtagaacgaaaaggtacggtaaccctaacgttagtttacggacttcggttacggtacgggtaacgggggtcccggttaccaaccgtacgttcctaaccgaacggaacgaacccaaaccggacccgtaaacctaacctaccgaacctttggtacccttacgtcgtacgtgaacgtggaacggtctacgggttactaggaacgacggacccgaacgtaacggaccgtacttaagtaccttttaacttaccggttagtaccggaccttaaacctcgttaaccttaaccttcccggtaatacgttaccgtaagtaaccggttcccgggacggggttaacccgaacccgggggttaacccttcgggttacccgttcccgtaccctccccgtcgtaaaccccgg

SEQ ID NO: 27188 - DNA, 679 bp, Homo sapiens
  misc_feature: GYAE6OF01AYMTI.6.75.G09.1.454.CMB.1.raw
  modified_base (278)..(278): a, c, t, g, unknown or other
  misc_feature (278)..(278): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagccgtggggactccctaagactctcctgtgcagcctctggattcattctttggcaagttctttgagtgggctgggtccnccagtacttccgagggggccgcgtgggagtggggtcggaccaacgataccgaacgacgagtcggacgaaaaggacgtaaccttaacgttagtttaggacttcgtaggtcgggtaacgggggtcccgtttacacctagtcccgtaccgaaggtaacgaaccaacccggacccgaaacctaacctccgtaacgttcgttacccttcgtggccttaggagtcggacgtccagttcgtaggaacgaccggcccgaacgaccgaccggtacttacgttacgttaacgttacgtgggttaacaccgtaaactccgttactactttccgtatacttcgtaagtaacgtacggtccgggaccctaacgggtacccgttggtacccggttcctccgttcctcgtacccgg

SEQ ID NO: 27189 - DNA, 601 bp, Homo sapiens
  misc_feature: GYAE6OF01CEDB2.6.75.G09.1.454.CMB.1.raw
  modified_base (468)..(468): a, c, t, g, unknown or other
  misc_feature (468)..(468): n is a, c, g, or t
  modified_base (535)..(535): a, c, t, g, unknown or other
  misc_feature (535)..(535): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactcctaagactctcctgtgcagcctctggattcattctttggcaagtcttggatgggctcgggtccgccgaggacgttccgaggggggcccggcgtggggacggtggggtcggaccaacgataccgaaacggacgaagtggacgaaaagggacgaccttaacgttagtttcggacttcgtggtcggagggggtcccgttacacctatcctaccgaagacgaacgaacgccgaacaactcactgtcctcgtgctgactganctagtcagagacgaccgacgaacgcgctatacttattcgtgtacgaacgtaactctacacttccgtnacgtgtagagttaccggtcggggaccctaagggaccccttgggtcccgtatcccttcgccgtcccg

SEQ ID NO: 27190 - DNA, 572 bp, Homo sapiens
  misc_feature: GYAE6OF01DJIOZ.6.75.G09.1.454.CMB.1.raw
  modified_base (237)..(237): a, c, t, g, unknown or other
  misc_feature (237)..(237): n is a, c, g, or t
  modified_base (324)..(324): a, c, t, g, unknown or other
  misc_feature (324)..(324): n is a, c, g, or t
  modified_base (438)..(438): a, c, t, g, unknown or other
  misc_feature (438)..(438): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (514)..(514): a, c, t, g, unknown or other
  misc_feature (514)..(514): n is a, c, g, or t
tcagatatcgcgagcacgaccggtgctcgatttagtatagacatcaggggctcagagaggagccttagccctggactccaaggccttccacagaggactcaccatggaattggggctgagctggttttccttgttgctattttagaaggtgtccaatgtgaggtgcaactggtggagtcgtggggggggcttaggtccagccgtggggacctccctaagactctcctgtgcagcctntggattcattctttggactaagtcttggatgggcgtgggtccgccagagttccgacgggggccgcgtgggaggtggggtggccaagntaccgaacgacgatggacgaaaggacgacctacgtagtttcggaactcgtggtggaacggggtcccgttacacctatcctacgagacgaacaacgcgacaactcactgctagtnctgatgagcagtctagagacgccganacncggactagtctattacgtgtcgacgtaactctacgtctttccgtctntacgtagaacttcggcggggaccacggaccgttcgggaccttcgtcctcgtcgacccg

SEQ ID NO: 27191 - DNA, 557 bp, Homo sapiens
  misc_feature: GYAE6OF01E06WP.6.75.G09.1.454.CMB.1.raw
  modified_base (227)..(227): a, c, t, g, unknown or other
  misc_feature (227)..(227): n is a, c, g, or t
  modified_base (353)..(353): a, c, t, g, unknown or other
  misc_feature (353)..(353): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (437)..(437): a, c, t, g, unknown or other
  misc_feature (437)..(437): n is a, c, g, or t
tcagatatcgcgagcacgaccggtgctcgatttagtatagacatcaggggctcagagaggagccttagccctggactccaaggccttccacagaggactcaccatggaattggggctgagcgtggttttcgttgttaggctattttagaaggtgtccaatgtgaggtgcaactggtggagtcgtggggggggcttagccagcctggggactccctaagctctctgtncagcctctgattcatctttggtaatcttggatgggctgggtccgccagtacttccgagggggccggcgtgggagtgggtcggaccaacatcgaacgagtatgcaaaggcgacctatattggactcngtgagggtcgttcacatctcgaganaccacgcgaacactcactgtctcngctgangncagtnagacgacgcgacgtacgacgtntactacttagtacgtgtacacgtaactctacttacttcttctacgtcgtaaggtacttaccgggacgggaccgtaccgggtaccgttcggtcccgttactacccttcccacgccgtaccc

SEQ ID NO: 27192 - DNA, 556 bp, Homo sapiens
  misc_feature: GYAE6OF01DV0NH.6.75.G09.1.454.CMB.1.raw
  modified_base (313)..(313): a, c, t, g, unknown or other
  misc_feature (313)..(313): n is a, c, g, or t
  modified_base (335)..(335): a, c, t, g, unknown or other
  misc_feature (335)..(335): n is a, c, g, or t
tcagatatcgcgagcacgaccggtgctcgatttagtatagacatcaggggctcagagaggagccttagccctggactccaaggccttccacagaggactcaccatggaattggggctgagctgggtttttccttgttgctattttagaaggtgtccaatgtgaggtgcaactggtggagtcgtggggggggcttagtccagcctggggactccctaagactctcctgtgcagcctctggattcatctttggcagtcttgatgggctgggtccgccagtattccgagggggccgctggagtggggtggccaagntcgaacgacgatgcaaaagganacctactattggactcgtgtggacggggccggttacaccgtatctccagacgacaacgccgacaacctcaactgtctctgactgatgagcagtctgagacgccgacgacgacggctatctacttatcgtgaactaactctactactttccgttacattcgtagtaaatccggtggggaccctacgggaacccgttgggtaccgtcctcctcgtccgtaccg

SEQ ID NO: 27193 - DNA, 762 bp, Homo sapiens
  misc_feature: GYAE6OF01EIPDV.6.75.G09.1.454.CMB.1.raw
tcagatatcgcgagcacgaccggtgctcgatttagtatagacatcaggggctcagagaggagccttagccctggactccaaggccttccacagaggactcaccatggaattgggctgagctgggttttccttgttgctattttagaaggtgtccaatgtgaggtgcaactggtggagtcggtgggggggcttagtccagccgtgggacctccctaagacctctcctgtgcagcctctggattcattctttggctaagtcgttggagtgggcgtcgggtccgaccagtacgttccggagggggccgtcgtgggaggttggggtcggacccaacgacgtaccgaaacggacgagtcggaacgaaaagggacgtaacccttaagttagtttacggaccttcgtggtacgggaacgggggtcccgtttacaaccctagttcccgtaccgaaggaacgaacccgaaaccggacccgaaactaacctccgaacgttcggttaccttcgtagtaccgttagaacgtaggaacgtactaggttccgtaagggaaccggaccggaaccccggaacgaaccgtaccggttacttaacgttacctttaagttaccgttaggtaaccgaacccgttaaaccttccgttaaccgttacgttttcccgtactacgtttacgtaacggtaaccgttccggggtaccgggaaccccgtaacggggttaccccgttgggttacccgttacccggttcccttccccgtcggtaacccccg

SEQ ID NO: 27194 - DNA, 693 bp, Homo sapiens
  misc_feature: GYAE6OF01DDCMT.6.75.G09.1.454.CMB.1.raw
  modified_base (334)..(334): a, c, t, g, unknown or other
  misc_feature (334)..(334): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaacgtggtggagtcggtggggggggcttagtccagccgtggggactccctaagactctcctgtgcagcctgtggattcattctttggctaagttcttaggatgggtctcgggtccgacgagtagttccggagggggccgcgtgggaggtcggggtcggaccaaacgntaccgaaacggcgagtacggacgaaagggactacctaacgttagtttacggacttcgtaggtcgggacggggtcccggttccaacctactccgtaccgaagacgaaaccgtaaccgcccgtaacaaccgttcaacgttcgtactcgtgtacgttagattacggacgtcgacgtagtcgaacggacgacccggaacgacgacggtctagtaccttagtaacgttgacgacgtaaacttccgtacttacgtttcccgtaactagttaccgtaggtaaaccgtttcggggacccggggtaacccgaaccggggttaacccttcggggttactaccccggttccttaccgtcccggtaccccg

SEQ ID NO: 27195 - DNA, 678 bp, Homo sapiens
  misc_feature: GYAE6OF01DA3RN.6.75.G09.1.454.CMB.1.raw
tcagatatcgcgagcacgaccggtgctcgatttagtatagacatcaggggctcagagaggagccttagccctggactccaaggccttccacagaggactcaccatggaattgggctgagctgggtttccttgttgctatttagaaggtgtccaatgtgaggtgcaactggtggagtcgtgggggggcttagtccagccgtgggactccctaagactctcctgtgcagtcctcgtggtattccattcgtttggactaagttcttttgagttgggcttcgggtccgccagtacttccggagggggcccgtcgtgggaggtggggtcggacccaaagactaccgaaacggaccgagtcggaaccgaaaaggcgaaccttacgtaagtttggactcgtggtcggacggggtcccgttacacctatcctacgaagacgaaaccgaaccgccgaactaactccacttcgccttctcgcgttacgatcggaacgtcgtacgttcgtaggacgacggtacccgacgaaccgacggttactacttacttacgttacgtgtacgtacctaaacttctaaccttacgtttaccctacgtatcgtacgtaacgttcgggtaccgggtacccggtaacgggtaccccggttgggtacccgttccgttaccccgtccgtaccgtaaccccgg

SEQ ID NO: 27196 - DNA, 720 bp, Homo sapiens
  misc_feature: GYAE6OF01CPTP8.6.75.G09.1.454.CMB.1.raw
  modified_base (226)..(226): a, c, t, g, unknown or other
  misc_feature (226)..(226): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
tcagatatcgcgagcacgaccggtgctcgatttagtatagacatcaggggctcagagaggagccttagccctggactccaaggccttccacagaggactcaccatggaattggggctgagctgggtttcttgttgctattttagaaggtgtccaatgtgaggtgcaacgtggtggagtcggtgggggggcttagtccagccgtggggactccctaagctctcctgngcagcctctggtattcattcttggctaagtctttagatgggctgggtccncagtacttccggagggggccgngtgggaggttggggtcggaccaaacngtaccgaaacggaccgtagtcgaacgaaaagggacgtaacccttacttaagtttcggacttcgtaggtgggaacggggtccgttaccgactactcaccgaaggaccgaaccgaaccgccgaaacctaaccgtctaaccgttagttcctaccgtgtaccgtaggtaactaggaacgtaccgtaggttacccgtagggaaacggaccggtccccggaaacggaaccgtaaccgggtactttaacttccgtttaattaaccgggtgttaccggaaaccttaaaccttccgtaaccttaacgttttccccgtaacttagacccgttaggaaacgttccgggtaccgggaccctaacggggtacccttgggttaccttcccgccttcccgtcgtaacccgg

SEQ ID NO: 27197 - DNA, 648 bp, Homo sapiens
  misc_feature: GYAE6OF01AWYPZ.6.75.G09.1.454.CMB.1.raw
  modified_base (273)..(273): a, c, t, g, unknown or other
  misc_feature (273)..(273): n is a, c, g, or t
tcagatatcgcgagcacgaccggtgctcgatttagtatagacatcaggggcgtcagagaggagccttagccctggactccaaggccttccacagaggactcaccatggaattggggctgagctgggtttccttgttgctattttagaaggtgtccaatgtgaggtgcaactggtggagtcgtggggggggcttagtccagcctcggggactccctaagacctctcctgtgcagcctctggattcatcttggcagtcttgatgggctgggtccncagattccgagggggccgcgtggagtgggtggccaacactcgaacgacgatgacaaaggagacctactatttggacttcgtgtggaggggtcccgttacacatctaccgagacgacaacgccgaacaacctctacgtgtcctcgtcgtacctggaactggaacgcgtaacgtcgttaggaaccgacggacccggtaacggaactacccggggtattacgtacgtttaacgtttacgtgggtacgtaaccgtaaaccttcgttacctacgttttcccggttacacgttcgtaacggtaaccttcgggtaccggggacccgtaaccgggtacccgttcgggtacccgttccgtaccctttcccgaacggtacccccg

SEQ ID NO: 27198 - DNA, 637 bp, Homo sapiens
  misc_feature: GYAE6OF01A670K.6.75.G09.1.454.CMB.1.raw
  modified_base (274)..(274): a, c, t, g, unknown or other
  misc_feature (274)..(274): n is a, c, g, or t
  modified_base (461)..(461): a, c, t, g, unknown or other
  misc_feature (461)..(461): n is a, c, g, or t
tcagatatcgcgagcacgaccggtgctcgatttagtatagacatcaggggctcagagaggagccttagccctggactccaaggccctccacagaggactcaccatggaattggggctgagctgggttttccttgttgctattttagaaggtgtccaatgtgaggtgcaactggtggagtcgtgggggggcttagtccagccgtgggactccctaagactctcctgtgcagcctctggattcattctttggctagtcttggatgggctgggtccncagattccgagggggccgcgtggaggtcggggtggccaaacgagtaccgaaacggacgatgacgaaagggcgtacctacttatttacggacttcgtgtggacggggtccggttacacctagttcctaccaggacgaaccgaaccggaccgaaccaactcaacgttcgtctctggacttagactggancgtagtcctaggagacgcccgaacggacacgggtctatcctagttacgtgtacgactaaacttctactacgttccgttacagtttacctaggtaaaccgttaccggttcggggaaccctacccggggttaacccttcgggtacccgtttcccggtccttccccggtgtacccccgg

SEQ ID NO: 27199 - DNA, 871 bp, Homo sapiens
  misc_feature: GYAE6OF01DPG9B.6.75.G09.1.454.CMB.1.raw
tcagatatcgcgagcacgaccggtgctcgatttagtatagacatcgaggggctcagagaggagccttagccctggactccaaggccttccacagaggactcaccatggaattgggctgagctggtttcttgttgctatttagagtgtcaatgtgaggtgcaatggtggagtcggtggggggggtcttagtccaggccgtggggaccttcccgtaagtactctccgtgtcgcacgcctctggtattctattcgtttggactaagttcgttggtagtcggggtcgtcggggttcccgaccgtaaggttaaccgttccgggaacgggggggcccgtcgtaggggtagggttcgggggtacggacccaaaacgtacgtaaccgaaaaccggacggtaagtacggaacgtaaaaacgggaccgtaacccgttaacgttaagttttaccgggaacttccggttaggtacggggtaccgggggtacccgttaccgaacctaacgttacccgtaccggaaacggaaccgaaacccgaaaccggaccccgtaaaactaaccgttaccaaccgttcgtaccgttccgtacggtaccgttaaggtaacgttacggaacgttaccgaacggtacgtaacggaacggaccgacccggaaacgaacggacccgttaactttaacgtaaccctttaagttaccgtagggttaaaccgaaccgttaaacctttcctaccggtttaaccttttccggaactttaaacggttccgttaaacggtaaaacccggttcgggttcccgggggacccctaaaaaccggggggttcccccctttggggttacccccgtttacggttaacccccttcccgttaccggaaccccgg

SEQ ID NO: 27200 - DNA, 704 bp, Homo sapiens
  misc_feature: GYAE6OF01ACS95.6.75.G09.1.454.CMB.1.raw
  modified_base (618)..(618): a, c, t, g, unknown or other
  misc_feature (618)..(618): n is a, c, g, or t
tcagatatcgcgagcacgaccggtgctcgatttagtatagacatcaggggctcagagaggagccttagccctggactccaaggccttccacagaggactcaccatggaattgggctgagctgggttttccttgttgctatttagaaggtgtcaatgtgaggtgcaactggtggagtcgtgggggggcttagtccagccgtggggacctccctaagctctcctgtgcagcctcgtggattcattctttggactaagtcttggatgggctgggtcccgcagtacgttccgagggggccgcgtgggagtcggggtcggaccaaacacgtaccgaaacgacgtaatacggaacgtaaaaggacgtaacccgttaacgttagtttacggaacttcgtagggtacgggaacgggggtcccggttaccaaccgtaacgtccgtaccgaaggacgaaccgaaaccgtacccgaacctaactcctaacgttcgtacctcgtagctaggactggagaccgtagttcaggaacggtacgacccggaacgaacgtaccggtacttactacttaacgtttacgacggtaccgtaaaccgtaacttcccgtaacttaaccggttcccgttanaacgttaccgtaggaaacgttaccgggtacgggacccgtaacggggttaaccctggttacccgtacctccttccgtaccgtacccg

SEQ ID NO: 27201 - DNA, 678 bp, Homo sapiens
  misc_feature: GYAE6OF01DARMX.6.75.G09.1.454.CMB.1.raw
  modified_base (276)..(276): a, c, t, g, unknown or other
  misc_feature (276)..(276): n is a, c, g, or t
  modified_base (493)..(493): a, c, t, g, unknown or other
  misc_feature (493)..(493): n is a, c, g, or t
  modified_base (573)..(573): a, c, t, g, unknown or other
  misc_feature (573)..(573): n is a, c, g, or t
tcagatatcgcgagcacgaccggtgctcgatttagtatagacatcaggggctcagagaggagccttagccctggactccaaggccttccacagaggactcaccatggaattggggctgagctggtttcttgttgctattttagaggtgtccaatgtgaggtgcaactggtggagtcgtgggggggcttagtccagccgtgggactcctaagactctcctgtgcagcctcgtggattcattctttggctaagttcgttggatgggtctcgggtcccnccagtacgttccggacgggggcccggcgtgggaggtggggtcggacccaacgactacgaaaccggacgagtaggaaccgaaaaggtacgtaaccctattaacgtttcggacttcgtggtacgggacggggtacccgttcacccgtatcctaccgaagtacgaaccaacgcccgaacaacctcgaacttcgtccttacgtcggactacggatacgganccgtagttcgaggacgcgcccgaacgaccgacggtacttaagttcctttaagttaccgttgaccgtaacgttaaaccctnttaacctccgttttccgactagttaccgtaagtaacgttacgggtccgggaaccgttaaccggaccgtttcgggttaccttcccgtaccgtcccttacgaccccg

SEQ ID NO: 27202 - DNA, 597 bp, Homo sapiens
  misc_feature: GYAE6OF01EMZ4B.6.75.G09.1.454.CMB.1.raw
  modified_base (424)..(424): a, c, t, g, unknown or other
  misc_feature (424)..(424): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctgggggggggcttagtccagcctggggactccctaagctctcctgtgtagcctctggattcatctttggcagtcttggatgggctgggtccgccagattcccagggggccgctggagtgggtggccaacatcaacgacgatgcaaaggagacctactattggactctgtgaggggccggttcaccatctccagacgacaaccgcacaactcactgtctctcgctgatgagcagttctggaacgnggcccgacgacgaccggcttagtccttattacctgttacgacgtaaacctccttacctatttcccgtttcgaattccttaggaaacgtttaacgtccgggggtcccgaacggggtaaaccccgttggggttaccccggtttcgtacccgttcccctcgtaaccggtccccccg

SEQ ID NO: 27203 - DNA, 686 bp, Homo sapiens
  misc_feature: GYAE6OF01CEWRR.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagccgtggggactccctaagactctcctgtgcagcctctggattcattctttggctaagttctttgatgggctgggtccgccagacttccgagggggccggcgtggagtggggtgccaacatccgaaacgacgatgacaaaaggacgaacctactagtttcggacttcgtggtggacgggggtcccgttacaccgatcctaccgagacgacaacgcccgaacaactcaactgtacctctgctgatgagctaagtctaggaacgtacggacccgaacggaccgtaaccgggctttaacttaccttaacgtttaaccgtggttaacgaacccgtaaaaccttcctaaccgttaaccttttcccggttactaaacgtttccgtaacgtaaaacgttaccgggtccgggggtaccccgtaaacccgggggtttaacccccgttcggggtttaccccgttaccgttacccgttcccgttaccggtaaccccgg

SEQ ID NO: 27204 - DNA, 654 bp, Homo sapiens
  misc_feature: GYAE6OF01BVA0N.6.75.G09.1.454.CMB.1.raw
  modified_base (275)..(275): a, c, t, g, unknown or other
  misc_feature (275)..(275): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagccgtggggactccctaagactctcctgtgcagcctctggattcattctttggcagtcttggatgggctgggtccnccagattccgagggggccgcgtggaggtggggtcggaccaacagtaccaacgacgatggacgaaaggacgaacctactatttggacttcgtggtggacggggtcccggttccaccgtatcctaccgaagaacgaaccgtaaaccgacccgaactaacctcgaacttcggttcctcgtgctagaacttggaagcctaggttcagggaacgacggcccgaacgacgacggtcttaagtaccttagtttaccgtgtacgaccgtaaacttcctacgtacttttcccgtactagttccgtagtaaaccttccgggtcgggggacccctaaacgggggttaccccttgggttacccgtaccgtttccctccccgtcgtacccgg

SEQ ID NO: 27205 - DNA, 830 bp, Homo sapiens
  misc_feature: GYAE6OF01DBQEQ.6.75.G09.1.454.CMB.1.raw
tcagatatcgcgagcacgaccggtgctcgatttagtatagacatcaggggctcagagaggagccttagccctggactccaaggccttccacagaggactcaccatggattggggctgagctggtttcttgttgctatttagaggtgtccaatgtgaggtgcaacgtggtggagtcgtggggggggcttagtccgagccgtggggacctcccgtaagactcctcctgtgcagtcctctggattcattcgtttggctaagttcgttggacgtggggcgtcggggtcccgccgagtacgttccggagggggccggcgttagggaggttcgggggtacggacccaaaacgtacgtaccggaaaccggtaaggacgttaggacgaaaaacgggaccgtaaccttaaccggtttaagtttacgggaccttcgtgggtaacggggacgggggttacccgttaccgtacccgtaactcccgttaccgaagggacgaaaccgaaacccggacccgtaaacccaaccgttccgaaccgtttaccgggttcccttaccgttagtacccgttaggaacgttcggaacgtcgtaacgggtttcgtaaacgggaaccggtaaccggacccgtaaaccccgggtaactaaccgggtaccttaactttacccgttaacgttttacgtacggtacgtaaaccccgttaaactttccgtaaccgtttaacgtttaccccggtataccgttacgtaacggtaaacgtccgggtaaccggggtacccggtaaacgggtttaccccggttcgggttaccgttcccgtttcccgcccgttcccggtaacccg

SEQ ID NO: 27206 - DNA, 706 bp, Homo sapiens
  misc_feature: GYAE6OF01C7X1J.6.75.G09.1.454.CMB.1.raw
  modified_base (625)..(625): a, c, t, g, unknown or other
  misc_feature (625)..(625): n is a, c, g, or t
tcagatatcgcgagcacgaccggtgctcgatttagtatagacatcagggggctcagagaggagccttagccctggactccaaggccttccacagaggactcaccatggaattggggctgagctgggttttccttgttgctatttagaggtgtcaatgtgagtgcaactggtggagtcggtggggggggtcttagtccagccgtggggactcctaagactctcctgtgcacgcctctggattcattcgtttggactaagttccgttggagtcggggcgtcggggtccgccgaaggtacgttccgggacggggggcccggtcggtgggagggtggggtcggaccaaacgctaccgaaacggaccgagtaggacgaaaaggtacgaaccttacgttacgtttacggacttcgttggtacgggacgggggtcccgtactacctactccgtacagacgaaccgaaccgtaccgaactactcgacttcgtctacgtcgtacgtagtagtacgacgctaacgttcgtacggaacggcggaccgtaaccggacgtaccggttacttaacgtacttacgtttacgtggtaccgaacgttaaccctcttaaccgttactttccggtcttaacgtntaaacggtaacgttcggggtaccgggacccggtaacgggtaccccgttggttacccgtacgttacccgccgtacgtccccg

SEQ ID NO: 27207 - DNA, 659 bp, Homo sapiens
  misc_feature: GYAE6OF01EMC7Z.6.75.G09.1.454.CMB.1.raw
  modified_base (490)..(490): a, c, t, g, unknown or other
  misc_feature (490)..(490): n is a, c, g, or t
tcagatatcgcgagcacgaccggtgctcgatttagtatagacatcaggggctcagagaggagccttagccctggactccaaggccttccacagaggactcaccatggaattggggctgagctggttttccttgttgctattttagaaggtgtccaatgtgaggtgcaactggtggagtcgtgggggggggcttagtccagccgtggggactcctaagactcctcctgtcgcagcctctggacttcattctttggcaagttcttggagtgggcgttcggggtccgccgagacgttccggacgggggccggcgtggaggttggggtcggaccaacgaagtaccgaaaccggacgaatacggaacgaaaaggacgtaaccttaacttagtttacggaccttcgtaggtcggacgggggtcccggttaccaaccgtaacttcctaccgaggaacgaaccgaaccggaccgaacctaacctactacgttcgtacncgttgtctgtaagtgaacgacctaggtacgtaggacgaacggacccggaacgaccgacggtcttactacttaagttacgtgtacgtaactaactctactactttccgtctactcgtagtacgtacggccgggacgtacggaaccgttcggtacgtccgtctcgtccacg

SEQ ID NO: 27208 - DNA, 582 bp, Homo sapiens
  misc_feature: GYAE6OF01A2HHU.6.75.G09.1.454.CMB.1.raw
  modified_base (275)..(275): a, c, t, g, unknown or other
  misc_feature (275)..(275): n is a, c, g, or t
  modified_base (337)..(337): a, c, t, g, unknown or other
  misc_feature (337)..(337): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (452)..(452): a, c, t, g, unknown or other
  misc_feature (452)..(452): n is a, c, g, or t
  modified_base (503)..(503): a, c, t, g, unknown or other
  misc_feature (503)..(503): n is a, c, g, or t
  modified_base (573)..(573): a, c, t, g, unknown or other
  misc_feature (573)..(573): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagacctctcctgtgcagcctctggattcattcttggcaagtcttggatgggctgggtccnccagattccgagggggccgctggagtggggtgccaacatccaaacgacgatgacaaaggganacctactatttggactctgtggaggggccgttcacctatctaccgagacgacaacgccacaactcaactgtctctgctgatgancagtcngacgngacccgaacgtacaccggtntagtacttagttaactcgtagaccgtaaacttctcgtaactttcccgttanaagtttcgagtaacctcggtcggggtacccaacggggtacccttcgggttccgttaccgtccttcccgtntaaccccgg

SEQ ID NO: 27209 - DNA, 685 bp, Homo sapiens
  misc_feature: GYAE6OF01BV7WT.6.75.G09.1.454.CMB.1.raw
  modified_base (613)..(613): a, c, t, g, unknown or other
  misc_feature (613)..(613): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgacaactggtggagtacgtggggggggcttagtccgagccgtggggaccttccctaagactctcctgtgcagcctcgtggtacttcgattctttggctaagtcgttggatgggcttcgggtcccgccgagtacttccggacgggggtccgcgtgggaggtgggtcggaccaacgagttaccgaaaccggacgtagtcggaaccgaaaagggacgtaaccccttagttaacgtttagggaccttcggttggtgggtaccgggggttcccggttaccacccgtactccgtaccgaacggaacgtaacccgaaccggaccctaacccgaacctaccgtacttcgttaccttcgtcgtcgttagtacgtacgacgcgtagtcgtagaacgtacggacccgacgaccgacgtactatacctattacgtgtcgaacgtactctctacttccgtntactcgtagtagtccggtcgggtacccgacggtaaccgtcggttaccgtacgttccgtccgtcgtaaccccg

SEQ ID NO: 27210 - DNA, 747 bp, Homo sapiens
  misc_feature: GYAE6OF01D6Z7E.6.75.G09.1.454.CMB.1.raw
  modified_base (280)..(280): a, c, t, g, unknown or other
  misc_feature (280)..(280): n is a, c, g, or t
tcagatatcgcgagcacgaccggtgctcgatttagtatagacatcaggggctcagagaggagccttagccctggactcccaaggccttccacagaggactcaccatggaattggggctgagctgggttttccttgttgcttattttagaaggtgtccaatgtgaggtgcaagtggtggagtcggtgggggggcttagtcagccgtgggactccgtaagctctcctgtgcacgcctgtgattcattcgttggactaagttcttggagtgggcttcgggccncagtacgttccgggacgggggccgcgtagggaggtgggtacggaccaacgtacgtaccgaacggacggtataggaacgaaagggaactaccttacggttatttcggacttcggtaggtggggaccggggttcccgttccaacctacttacccgcgaacggaccgaaccgaaaccggtcccgaaacctaaccgttccgtacgttcggttaccctcgtgtacgttaggaacctaggtacgacccgttagttacccggagtacggaaccggtcccgaacggaacccggtacgttactaacgtttcgtttaacgtcgtttacgtacccggtaacttaacccgttcttaccgtaaccttttacccggtatacgttaccgttaaaggttacccggttaaccgggggcccggtacccgggtaaccgttacccggttgggttacccctcccgttaccgtcctaacggacccccgg

SEQ ID NO: 27211 - DNA, 762 bp, Homo sapiens
  misc_feature: GYAE6OF01CZJ63.6.75.G09.1.454.CMB.1.raw
tcagatatcgcgagcacgaccggtgctcgatttagtatagacatcgagggctcagagaggagccttagccctggactccaaggccttccacagagactcaccatggaattggggctgagcgttgggttttcttgttgcttattttagaagtgtcaatgtgaggtgacaacgtggtggagtcggtgggggggtcttagtccgagccgtggggacctaccgtaagacctctcctgtgcacgcctcgtagtattcattcgtttgacaaggttcgttaggagtgggcgtcgggtccgacgaaggtacgttaccgggacgggggcccgtggtgggagggttcgggacggaacccaaaagtacaccgaaacgacgtaagtacggaacgaaaaggacgtaaccgttaactagtttaggactacgtggacggtacggggtaccgtacaactacgtccgtacgaagaaaccgaaccaacggacccaaactactcgacgttacgtccgtacgtgtacgtagaagtacgagacgacgttacgaaggaacgacggaaccggaacgtacgaaccggtaacttaacgtaacttacgttaacgtcgtaaacggtaacgtaaaccttccgtaacgttacccgtttaccgttacgtaacgtaaccggttaacggtaaacgttacccggggtacggggtaacccgggtaaaaccggggttaccccggtacgggtttacccggttacccgtaccccgtttaccgtaccgttaaacccccgg

SEQ ID NO: 27212 - DNA, 712 bp, Homo sapiens
  misc_feature: GYAE6OF01C0APR.6.75.G09.1.454.CMB.1.raw
  modified_base (694)..(694): a, c, t, g, unknown or other
  misc_feature (694)..(694): n is a, c, g, or t
  modified_base (700)..(700): a, c, t, g, unknown or other
  misc_feature (700)..(700): n is a, c, g, or t
tcagatatcgcgagcacgaccggtgctcgatttagtatagacatcaggggctcagagaggagccttagccctggactccaaggccttccacagaggactcaccatggaattggggctgagctggttttcttgttgctatttagaggtgtccaatgtgagtgcaacgtggtggagtcggtggggggggtcttagtccgagccgtggggacctcccgtaagacctctcctgtcgccacgtcctctggtacttctattcgtttggactagtttcttaggagttcgggtcgttccgggtccgtaccgtagtaccgttccgggacgggggcccgtggtgggtcgggtcggggtacggaccaaactacgtacgaaaccggacgagtacggaacggaaagtacgtaaccgttacttaggtttacggacttccgtagggtacggggtaccggggttacccgttaccaaccgttacgtcccgtaacgaacggaacgaaaccgaaccggaccgaacctaacctcgtacgttcgtccctcttcggattaggtacgtggaccgtacgtacgtccgaagggaaccgaccggtaccgaacgaccgtaccgtcttacgtttacttacgttgtcgtaactacgtaccttcttacgtactttccgacttgtacgtcgtaacgttcggccggaacgtacggccgttggttcncctccncgtccgtacccg

SEQ ID NO: 27213 - DNA, 619 bp, Homo sapiens
  misc_feature: GYAE6OF01CNMBY.6.75.G09.1.454.CMB.1.raw
  modified_base (399)..(399): a, c, t, g, unknown or other
  misc_feature (399)..(399): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagccgtggggactccctaaagactctcctgtgcagcctcgtggtattcattccgtttggactaagtcttggagtgggctgggtccgccagtattccggagggggccgcgtggaggtcgggtgaccaactataccgaacgacgatagacgaaaaggacgtacctaactagttggtactcgtggtgacggggtccgtcaactntctcaagacacaaacgccacaactcactntctcntctnatgagcagtctagagacgaccgacgacgacgtactatacttaattacgtagtacgaacgtaacctaccgtcttaaccttccgtactaagttcgtaacgtaattacggtccggggaacccgtaaacggggtaaccccgttccgggttacccgttaccggttcccttacccgttccgaacccgg

SEQ ID NO: 27214 - DNA, 808 bp, Homo sapiens
  misc_feature: GYAE6OF01E4TM7.6.75.G09.1.454.CMB.1.raw
  modified_base (158)..(158): a, c, t, g, unknown or other
  misc_feature (158)..(158): n is a, c, g, or t
tcagatatcgcgagcacgaccggtgctcgatttagtatagacatcaggggctcagagaggagccttagccctggactccaaggccttccacagaggactcaccatggaattgggctgagctggttttcctgttgctatttagagtgtcaatgtgagtncatggtgagtcggtggggggcttagtccagtccgtggggacctacccgtaagaccttccgtcctgtcgcacgtcctcgtaggtacttctagttcgtttcggactaagttcgtttggacggtgggtccgttcgggtcccgaccgtagtaccggttaccgggacgggggtccgtcggtgggtacggttcgggggtacgaccctaaacgactaccggaaacgacggtagtacgaacggaaacggtacgtaaccttacgttaagtttacggtactttacggtaggtcggggaccggggttacccgttaccgacccgtacgttcctaccggaaggtaccgtaaacccgaaacccggaccgtaaaccgtaaccttccgtacgtccgttacttaccgtacgtcgtaaggtagttacggagtcgtacgttcgtaggaaccggccgaccggaacgtccggaactacgttacgtttacctagtttaccgtacgtaaccggtaacccttaacctcgttaaccgtttccgtaccgtacttaccgaaaggttccttaaaccgggtcccgggttaaccgggaaccccgggtttacccccgggtttaacggttccccggtttacgttaccccggtttcccccgttccggaccccgtaacccccgg

SEQ ID NO: 27215 - DNA, 789 bp, Homo sapiens
  misc_feature: GYAE6OF01COJ74.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcattctttggcagtcttggatgggctgggtccgccagacttccggagggggccgcgtggggaggtggggtcggaccaaacactaccgaaacggacgtagtggaacgaaaaacgggacgtaacccttaacttaagtttcgggaaccttcgttggtcgggaacggggggtcccggtttaccaacccgtattccgtaccgaaggtacgaaacccgtaaaccggccccgtaaaccaaaccttccgaactttcggttacccttccgtacgtaccgttagaagttcggaacgtccgaacgttcgttagggaaacggtacggaccccggtaaacgaacccggtaacccggtacttaacgtttaccttaacgttttaccgtcgggttacgaaacccgttaaactttcccttaaccgttaaccgttttaccccgttacttaacgttaccggtaacggtaacgtttaaccggggtccgggggaacccgttaaacccgggggttaccccgttcggggttacccgttcccgttaccccgttcccgttccggtaaccccgg

SEQ ID NO: 27216 - DNA, 936 bp, Homo sapiens
  misc_feature: GYAE6OF01CPAT8.6.75.G09.1.454.CMB.1.raw
tcagatatcgcgagcacgaccggtgctcgatttagtatagacatcaggggctcagagaggagccttagccctggactccaaggccttccacagaggactcaccatggaattgggctgagctgggtttctgttgctatttagaaggtgtccaatgtgaggtgcaactggtggagtcgtgggggggcttagtcagcctgggactcctaagactctcctgtgcagcctctggtattcattctttggactaagtcttggagtgggctcgggtccgcgagtacttccggacggggggccgcggtagggtaggtcggggtacggacccaaacgtactaaccgaaacgacgagtcgaacgtaaagggacgtaacctaccgttaagtttacggaccttacggttacggtacgggtaacggggggtccccgtttaccgaacccgtaacgtcccgtacgaaacgtccggaaacctaaaccccggaccgtaaaccctaaccctttaccgaaccgtttccggttaccgttaccttacggacgtttacggaaacgttacgggaaccgtcgttaacgggtttacccggtaacggaaaccggggacccgggtaaccccggtaaacccgggaacccgtaaacccgggggttaaccttttaaacccggttaacccgtttttaaaccggttttaaccggttaccgggtttaaaccggtaaaacccccggtttaaaaccctttccccggtttaacccgtttaaacccggttttttcccccgtaaacccggttttaacttttaacccgggttaaacccgggtttaaacccggtttaaaccccggggggttaccccgggggttaaacccccggttaaaccccggggttacccccggtttcggggttaaccccggtttcccgtaccccgttaacccccgtccgggttaaaccccccgg

SEQ ID NO: 27217 - DNA, 959 bp, Homo sapiens
  misc_feature: GYAE6OF01D5KEY.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggtttttccttgttgctattttagaaggtgtccaatgtgaggtgcaactggtggagtcgtgggggggcttagtcagccgtgggactccgtaagactctcctgtcgcagtcctctggtattcattcgtttggactaagttcgttggagttcgggtcgttcggggtcccgaccgtaaggtaccgtttccggacgggggggtcccgtcgtggggaggttcggggtccgggacccgtaaaccgacgtaccgaaacgggaccgtaagtcggtaaaccgaaaagggtaacgtaaccctttaacgtttaacgttttaggaaccgttcgttacgggtacggggtaaccgggggggttccccgttaaccgaaccctacgttacccgtacccgaaggtaaccggaaaccgtaaacccggaccccgtaaaccgtaacccgttaccgtaaccgtttcggttaccctttacggtacggtccgtttaacgggtaacgtacgggttaaccggaaccgttacggtttacccggtaagggaaaccggtacccggaacccccggtaacgggaaaccgtacccgggtaacttttaaccgttactttaaaccgtttacggttacgggttaaccgttaacccgttaaacccgtttccgttaacccgttaaccccggtttttacccgtttaaccgttaagttaccccggtttaaaggtaaaacccggttttaccccggggtaacccggggggtaacccccgggtaaaacccggggtttaccccccccgggtttggggtttaacccccccgggtttacccgttttccccgttaaccccggtccccgtaaaaccccccgg

SEQ ID NO: 27218 - DNA, 668 bp, Homo sapiens
  misc_feature: GYAE6OF01A9MGT.6.75.G09.1.454.CMB.1.raw
  modified_base (282)..(282): a, c, t, g, unknown or other
  misc_feature (282)..(282): n is a, c, g, or t
tcagatatcgcgagcacgaccggtgctcgatttagtatagacatcaggggctcagagaggagccttagcccctggactccaaggcccctccacagaggactcaccatggaattggggctgagctgggtttttccttgttgctattttagaaggtgtccaatgtgaggtgcaactggtggagtcgtggggggggcttagtccagccgtggggacctccctaagactctcctgtgcagcctctggattcattctttggcaagttcttggatgggctgggtcccnccagacttccgagggggccgcgtggaggtggggtcggaccaacacgtaccaacggacgatcggacgaaaggacgtacctacgttagtttcggacttcgtggtggacgggggtcccgttacacctatcctccgaacgagacaaccgccgaacaacctctactcgtcctgtcgcttagagtcgagctacgtcgtaggaacgaccggacccgaacgaaccgaccgggtcttaacgttcttaacgtttaccgtagtaccgtaacgtaacctccgttaccttactttaccgttactacgttccgtaagtaacggttaccggtccggggacccgtaacccgggttaacccggttcggttcccgttccgttacccgttcccgtacgtaccccg

SEQ ID NO: 27219 - DNA, 970 bp, Homo sapiens
  misc_feature: GYAE6OF01DJBOV.6.75.G09.1.454.CMB.1.raw
tcagatatcgcgagcacgaccggtgctcgatttagtatagacatcagggggctcagagaggagccttagccctggactccaaggccttccacagaggactcaccatggaattggggctgagctgggtttcttgttgctatttagaggtgtccaatgtgaggtgctaactggtggagtcggtggggggggcttagtccgaggccgtcggggactcccgtaaagctctccgtggtgtacgtcctcgtggtacttacattcgtttgggacctaaggttcgttgggtacgttcgggtaaccggttcggggtacccgacccgtaagggtacgtttacccggggagggggggtcccggtacgtacgggggtaagggttcgggggttaacgggaacccgtaaacgtaacgttaccaaaaccggaacgtaacggtacggaaccgaaaaagggtaccgtaacccgtagttttacgttacgggtaccttcggtagggtacgggtaccgggggtaccggtttaccaacccgttcggtaccctaaccggaacggtaacgaaacccgtaaacccgggacccgaaacgtaaacccgttccctaaacgttcggtttaccctggtaccgttaccggtagtacgttacggaaacggttccggtaacgtttacggtacgggaaacgggtccggaaaccccggaacggtaaacccgtaccgggtacccttaacgtttacccgtttaaagtttaacccggtccgggtaaacccgtacccgttaaacgtttaccccgtttaccgaacccgttttaccgtaaccgttaagttacccggttaagggttaaaaccccgggttaccgggttaacgggggtaacccccccgggttaaacgggggtttaacccccggttacggggttttaaccccgggttaccccggtttaccccgtaccccgttaacccgggtacccccggtttaaaccccccggg

SEQ ID NO: 27220 - DNA, 601 bp, Homo sapiens
  misc_feature: GYAE6OF01BCQFP.6.75.G09.1.454.CMB.1.raw
  modified_base (441)..(441): a, c, t, g, unknown or other
  misc_feature (441)..(441): n is a, c, g, or t
  modified_base (525)..(525): a, c, t, g, unknown or other
  misc_feature (525)..(525): n is a, c, g, or t
tcagatatcgcgagcacgaccggtgctcgatttagtatagacatcaggggctcagagaggagccttagccctggactccaaggccttccacagaggactcaccatggaattggggctgagctgggtttttcctgttgctattttagaaggtgtccaatgtgaggtgcaactggtggagtcgtgggggggggcttagtccagcctggggactccctaagactctcctgtgcagcctctggattcatctttggcaagtcttggatgggctgggtccgccagtattccgagggggccgcgtgggagtggggtggccaacatacaacgacgatgacgaaaaggacgactactagtttaggactcgtgtggacggggcccgttacacacgtctccgaagagaaccgaacgacccgacaaccgtcactcgtctacgtgctgatggancagtcgtagagtcggaccgacgacgtacggcttaatcgttaattacggtgtacgaccgtaaactcctacttacgttcccgttanacttcgttacgaagttaccggtcggggaacccagggtaccccgttcgggtaccgttcccgtctcccgttcgacccg

SEQ ID NO: 27221 - DNA, 652 bp, Homo sapiens
  misc_feature: GYAE6OF01BARL8.6.75.G09.1.454.CMB.1.raw
  modified_base (239)..(239): a, c, t, g, unknown or other
  misc_feature (239)..(239): n is a, c, g, or t
tcagatatcgcgagcacgaccggtgctcgatttagtatagacatcagggctcagagaggagccttagccctggactccaaggccttccacagaggactcaccatggaattggggctgagcgttgggtttttcctttgttgcttattttaggaaggtgtccaatgtgaggtgcaacgtggtggagtcggtggggggggcttagtccgagccgtgggacctccctaagactctcctgtgcncgcctctggtattctattcgtttggctaagtcgttggagtgggcgtcgggtccgccgagtacgttccggacgggggccggcgtgggaggtggggtcggaccaacgatacgaacgacgatcgaacgaaaggacgaacctacgttagtttcggacttcgtggtcgggacgggggtccgttccgacctactcctaccgaagacgaacgaaccggacccgacaacctctactcgtctcgcgtctagatgagcagtctagacgacgcccgaacgaccgacggtacttacgttaccttagttacgtcgtagaaccctaactccgtacttacgtttccctatacttacgtataacggtacggtacgggacccgtaaccgggtacccgttcggtaccgttccgttccctccgtacgacccg

SEQ ID NO: 27222 - DNA, 699 bp, Homo sapiens
  misc_feature: GYAE6OF01A6D99.6.75.G09.1.454.CMB.1.raw
  modified_base (233)..(233): a, c, t, g, unknown or other
  misc_feature (233)..(233): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagccgtggggacctccctaagactcctcctgtgcngcctctggattcattctttggctaagttctttgagttcgggcgttcggggtcccgccgtagaccttccggacggggggcccggtcgtgggacggttggggtcggaccaacgtactaccgaacggaccgagtacggacaaaagggacgtaacccttacttaagtttcggaccttcgttaggtgggtaccgggggtcccgttaccaccgacttcccgtccgaaggtaacgaccaaccggacccgactaaccctacacgttcgtactctgctgatcgacgtctagtcgtagtacgacgtacccggacgacgtaccggtatactaccttattaccggtcgtagtaacccaacttcctactaacgtttccgttcctagttcctaaggttacctcgggtacggggtacccccgtaaggggttcccccgtaggggtttcccgttcccggtaccctttcccgtccggtaccccg

SEQ ID NO: 27223 - DNA, 818 bp, Homo sapiens
  misc_feature: GYAE6OF01AVB9B.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggtttttccttgttgctattttagaaggtgtccaatgtgaggtgcaactggtggagtcgtgggggggcttagtccagcctgggactccctaagactctcctgtgcagcctctggtacttcattctttggactaagtttctttggagtggggtactcggggtcccgccagtacttccggaggggggcccgcggtgggtagggtggggtacggacctaacgtagtaccgaaaccggtaacgagttacggacgaaaaaggccgtaaaccctttacgttagtttacggtaccttccgttaggtcgggtaccgggggtacccgtttaccgaacccgtacgttacccgtaccgaacggtaaccgaaaccgaaccccggaacccggtaaccctaaacccggttacctaaccggtttcggttacccttaccgttacgtacccgttaggtaacgtagggtaaccgtaccgtaacggttaccgtaggaaccggtacccgggaccccggaaaccggaccgtaaccccgggttattaaaccgtttaacccttaacgtttaccgtacggttaccgtaaacccggtaaacttcccgttaccttacccgtttcccgtactacttaccgtaaggtaacttccgggtacgggtacccgtaacgggtacccgtttcggttaccggtccttcccgtacccgtccgtaaccccgg

SEQ ID NO: 27224 - DNA, 642 bp, Homo sapiens
  misc_feature: GYAE6OF01EYTUL.6.75.G09.1.454.CMB.1.raw
  modified_base (272)..(272): a, c, t, g, unknown or other
  misc_feature (272)..(272): n is a, c, g, or t
tcagatatcgcgagcacgaccggtgctcgatttagtatagacatcaggggctcagagaggagccttagcccctggactccaaggcccttccacagaggactcaccatggaattggggctgagctgggttttccttgttgctattttagaaggtgtccaatgtgaggtgtcaactggtggagtcgtgggggggcttagtccagcctgggacctcctaagactctcctgtgcagcctctggattcatcttggctaagtcttgatggctggtccncagtacttccgaggggccgcgtggagttgggtcgaccaacatccaacgacgatcgacgaaagacacctactagttcggactcgtgtcggaggggtcccgttacaccattccgaccgtagaacgaacaaccgcgaacaacctcacgttgtctctgccttagactggactcgacttgtacggacgaccggtaccgaccggtaaccgtcggaactttacgtaacgttaaccgtttcctggtacccgaactaaacctttccgtaacgtaaccgttttccgtaacctaaagttccgtaagtaaacgttcccgggtgggggacccccttaaaggggtcccctaggggttccctacgttccccgtactcgggacccc

SEQ ID NO: 27225 - DNA, 775 bp, Homo sapiens
  misc_feature: GYAE6OF01DJ14W.6.75.G09.1.454.CMB.1.raw
  modified_base (335)..(335): a, c, t, g, unknown or other
  misc_feature (335)..(335): n is a, c, g, or t
  modified_base (542)..(542): a, c, t, g, unknown or other
  misc_feature (542)..(542): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgcttatttagaaggtgtcaatgtgaggtgcaacgtggtggagtcggtgggggggggtctttaacggtccgagccgtggggactacctaagacctctcctgtgcagtcctctggtacttcattcgttacggactaagttcgttagagtcggggtcgttccgggtccgacctaggtacgttaccgggaggggggtcccggnggttagggtacggtcgggggtacgaccaaacgtacgtaccgaaacggaccggtaatggaaaccaaaaggggaactaacccgttacgtaagtttcgggacttcggtacggtagggacggggtacccgttcaacgtattccaccgaagtaacggacaaccggaaccgtaccaaacgttccaacgttgcccttacgcggtactaacggtnttaacggacgtaccgtaggtccgtaagggaaacggacccggacccgaaaccggtaacggtacccggtactttaaacgtcgtttaaacgttcggtacggttaaccgaaacccttaaagttcccttaataccgttttacccggttactaagttccgtaaaggttaacggtacgggtaccggggaccgtaacggtccccgttagggttcccctattccccggtactccgtaacccg

SEQ ID NO: 27226 - DNA, 702 bp, Homo sapiens
  misc_feature: GYAE6OF01BCUB0.6.75.G09.1.454.CMB.1.raw
  modified_base (614)..(614): a, c, t, g, unknown or other
  misc_feature (614)..(614): n is a, c, g, or t
tcagatatcgcgagcacgaccggtgctcgatttagtatagacatcaggggctcagagaggagccttagccctggactccaaggccttccacagaggactcaccatggaattggggctgagctgggtttccttgttgctattttagaaggtgtccaatgtgaggtgcaactggtggagtcgtggggggggcttagtccagccgtggggacctcccgtaagactctcctgtgcacgcctcgtggattcattctttggactaagttcgttggagtgggtcgtcgggtcccgcgagtacgttccgacgggggtccgcgtaggaggtcgggtcggaccaaacgagtaccaacggacagtcgaacgaaaggacgaacccttaattacgtttggaacctcgtaggtcggaacggggtcccggttacaaccgtagtcctaccgaaggtaacgaaccgtaacggacccgaaccaacctccgtacttacgttcctacgttcgcttagaacgtgaacgtacgacggttcgtacggaacgccgtacccggaacgtaacgaccggtacttaacgtactttacgttaacgtcggtacgaacgtaaccttctacttacgtttcccgtanaacgttcgtaacgtaagttaccggtacgggaccgtaccgggtaaccgttccgggttaccggttccttaccgttcccgccgtaccccgg

SEQ ID NO: 27227 - DNA, 743 bp, Homo sapiens
  misc_feature: GYAE6OF01DO50A.6.75.G09.1.454.CMB.1.raw
  modified_base (229)..(229): a, c, t, g, unknown or other
  misc_feature (229)..(229): n is a, c, g, or t
  modified_base (512)..(512): a, c, t, g, unknown or other
  misc_feature (512)..(512): n is a, c, g, or t
tcagatatcgcgagcacgaccggtgctcgatttagtatagacatcaggggctcagagaggagccttagccctggactccaaggccctccacagaggactcaccatggaattggggctgagctgggttttcttgttgcttatttagaggtgtcaatgtgaggtgcaacgtggtggagtcggtgggggggcttagtccagccgtggggacctccctaagacctctcctgtncagtcctctggtacttctattcgtttggactagttcgttggagttcggggtcgtcggggtcccgaccgtaggtaccgttccggggaacggggggcccggtcggtggggtacggggttcgggggtaccggacccaaacgtacgtaaccggaaaccggaaccggtagtacggaaccggaaaagggtaccgtaaccttaacgttacgtttcggaccttcgtggtacgggacggggtcccgttacaccgtatccgtacaagacgacaaccggaccgaactaacctcncttacgtcctcgtcgtactgagtagacgctacgtcgaggacgaccggccgaacgacacggtcttaacttacttaacgtttcgtagtacgaaccttaacctctaaccttacgttacccgttctaacttcgttaaaggacccgttacgggtaccggggtacccggttaaaccggggttaaccccttggggttaccccggtttcgttaacccccgtccgttacccggtaccccg

SEQ ID NO: 27228 - DNA, 663 bp, Homo sapiens
  misc_feature: GYAE6OF01CLYDQ.6.75.G09.1.454.CMB.1.raw
  modified_base (162)..(162): a, c, t, g, unknown or other
  misc_feature (162)..(162): n is a, c, g, or t
  modified_base (321)..(321): a, c, t, g, unknown or other
  misc_feature (321)..(321): n is a, c, g, or t
  modified_base (323)..(323): a, c, t, g, unknown or other
  misc_feature (323)..(323): n is a, c, g, or t
  modified_base (351)..(351): a, c, t, g, unknown or other
  misc_feature (351)..(351): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (455)..(455): a, c, t, g, unknown or other
  misc_feature (455)..(455): n is a, c, g, or t
  modified_base (494)..(494): a, c, t, g, unknown or other
  misc_feature (494)..(494): n is a, c, g, or t
  modified_base (560)..(560): a, c, t, g, unknown or other
  misc_feature (560)..(560): n is a, c, g, or t
tcagatatcgcgagcacgaccggtgctcgatttagtatagacatcgaggggctcagagaggagccttagccctggactccaaggccttccacagagactcaccatggaattgggctgagctggttttcttgttgcttatttagaaggtgccaatgtgaggtnctaagtggtggagtcgggtggggggggtcttacggtccgagccgtggggactcccgtaaagctctccgtgtgcacgtcctgtggtactcattcgttggactaagttcttgagtcgggcgtcggggtcaccgagtacgtcggacgggggcctcggtaggngnggggtcgacaacgtaccaacggactagnaacggaaaggtcaccgtagttagttcgacttgtggacgacggggctacgctactcgacgagagtacacctacgacaacnctacgtgaccttgntctagatgacngtcgcgtggaacgcggaccgaacgtcacgggtaccttanaacgtttccgtaaggtcctaacggtaaaccaaccttcctacccggttaactttccccggtaaactnttaacgtacggttaacccgtggggttaacccggggtaccccgtaaaccggggtcccccttaaacggggtccgttcccgtacccggtacccttcgaacccccgg

SEQ ID NO: 27229 - DNA, 763 bp, Homo sapiens
  misc_feature: GYAE6OF01AHJES.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggacctccctaagactctcctgtgtagcctctggattcatctttggcaagtcttggatgggctgggtccgccagtacgttcccgagggggccggcgtgggaggtcggggtggccccaagactaccgaacggacgagtgaccgaaaagggtacgaaccctacgttaagtttcgggacttcgtggtacggtacggggggtcccggtttacgaccctattcccgtaccgaagacgtaaaccgaaccggcccgaacaaaccgttccaacctttcggtccttacggtcggtcctagggacttcggaacgtctaacggttcgtacggaacgtccggacccgggtaaccgaaccggtaccgggtaaccttacgtttaccttttaaacccgttacgtttacgggtaaccggtaacggttaaaaccccttccgttacctaaaccgttttccccggttactaaactttccgttacggtaaacgttcccggggttaccgggggaacccaaccgggggtaacccccttgggtacccgttcccgtttacctccccgtccaccgggtccccc

SEQ ID NO: 27230 - DNA, 769 bp, Homo sapiens
  misc_feature: GYAE6OF01BUSHN.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtggtggggggggtcttagtccacgccgtggggacctccgtaagacctctcctgtgcagcctcgtggtattcattcgtttcgggactaagttcgttagggagttcggggtccgtcggggttccccgcgtaaggtacgtttacccggggaggggggtccccggtcggtagggggtagggttgggggttccggacctaaacggacttaccgaaacgggtaaccgtaggtacgaacggtaaacgggaactaacccgtttaagttacgttttacgggaacctttcggtagggtaccgggggtaacgggggttccccggttaccaacccgtacttcccgtaccgaaagggtaccgaaaccgtaaacccggtcccgaaacctaacccgttaccacgttcctacctcggtacgtcgtacgtagacgtacggacgttatcggtaaggacgaccggacccgacgacgtaccggtacactttactacgttcgtacgtacgtactacttaccgcttacgtttcctcaagttcacgttagtaccgggtccgggaaccgaccggttaccgttccgttcgggttccctcttccgtccccgtacccg

SEQ ID NO: 27231 - DNA, 722 bp, Homo sapiens
  misc_feature: GYAE6OF01BWRF6.6.75.G09.1.454.CMB.1.raw
  modified_base (185)..(185): a, c, t, g, unknown or other
  misc_feature (185)..(185): n is a, c, g, or t
  modified_base (658)..(658): a, c, t, g, unknown or other
  misc_feature (658)..(658): n is a, c, g, or t
tcagatatcgcgagcacgaccggtgctcgatttagtatagacatcaggggctcagagaggagccttagccctggactccaaggccttccacagagactcaccatggaattggggctgagtcgttcgggtttttccttgttgcttattttagaaggtgtccaatgtgaggtgactacgtgggtggnggtcgggtgggggggtctttagccgagccggtgggaccctaccgtaagtacctctccgtgtacgcctacgccttgtgtacttcatttcgttgactagttcgttgagtggccgtggtccacgtagtacgtccgggacggggtccgtcggtgggtacggtcgggtacgaccgtaagtaccgaacgtaaccgaggtagacggaaacgaaacggtacctaaccgttaagttaccgtcggtacgtgtaggtacgggaccggggttcctacgacctacgtcctaacgaacgtaccgaaccgaaccgtacctaacccgaacgttacacgttccttacgttacgtccgattacgacgtaagggacctgtacgtacgagtaccggaacgacccgaaagccgtaacggttacttaacggttaccttaacgtgttacgaaccgtctaactcgttaccttccgtttcgacctaatacccgggtanacggttaccggaccggtacgtaccggtccgttacggtcctacggttccccgttacccaccccgg

SEQ ID NO: 27232 - DNA, 866 bp, Homo sapiens
  misc_feature: GYAE6OF01C7YOZ.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagcgttgggttttcctttgttgtcttatttagaggtgtccaatgtggaggtgactaacgtgggtgggtacggtcgggttgggggggggtctttaacggtcccgtaggtcccggtacgggggtaacctcccgtaaaacgcctccttccgtggtcgcctacgtccctcgtggtattctatttccgttaggactaacgttcgttggagttcggggcgttcggggtcccgaccgaggttaccgttccggggacggggggccggtacggtgggtaggggttcgggggtcggaaccctaaacgtactaaccgaaaccggtaacgtagttacggaacggaaaacgggtaacgtaaccccgttaaacgtttagtttacgggccttagttgggtaggggtaccgggggtaccccgttaacccgtactaccgttaccgtaccgaacgaaccggaccgaacccggaaccccttaaaccgaaccttacgtaccgttccggttccttacggtacgtcgttaacgtagtacggtaacggtacccgtacggttacgtacgggaaccggtacccggacccggtaaaccggaccgttaaccgggtacttaaccgttacgtaacgtttacgtgtaccgaaccttacgtctaccgttcgtttccccgtattaccgtagtaaccgtaaggttccgggtaccgggtacccgtaacccgggttacccggttccgggttccttcccgtacccgttcccgtcgtaacccccg

SEQ ID NO: 27233 - DNA, 909 bp, Homo sapiens
  misc_feature: GYAE6OF01BRJQK.6.75.G09.1.454.CMB.1.raw
  modified_base (158)..(158): a, c, t, g, unknown or other
  misc_feature (158)..(158): n is a, c, g, or t
tcagatatcgcgagcacgaccggtgctcgatttagtatagacatcgagggctcagagaggagccttagcccctggactccaaggcccttccacagaggactcaccatggaattggggctgagctggttttcctgttgctattttagaggtgtcaatgngagtgcagtggtgagtcggtggggggtcttaggtccagccgtgggacctccgtaagacctcctccgtgtgcgacgtcctgtggtattaccgtatttccgtttggacgtaacggttccgtttgggaggttggggccgttccggggtcccgaccgtaaggtaccgttacccgggacggggggtcccgtcggtggggtacgggttcggggtacggacccgaaaaccgtcgttacccggaaaaccggtacgaacgtacggaaaccggtaaaacgggaaccgttaaccccgtttaacgtttacggttttaggtaaccgtttccggttaaggtcggggtacccgggggtccgttaaccccgtaacccttacgtacccgttaacgacgaaaccgaaccgaaacccggtccaaaacctacgtaccctaacgtttccgtctttccggcttacgttacgacgtacggaacgtccggttagtaccgtagggaacgtaacccgggtacccgaaccgggtaaccggacccggtttaagttaccctttacggtttaaaccgttaccgggttaaccggtaccgttaaaaccgttacctacccccgttttaacgtttacccgtttccgtttaaacccttggtttaaaccccgtaaggttaaccccggtaaccggggttaccggggtaccccggtaaaccccggggttacccgtttccgggttaccccggtttacccgtttccccgttacccgtacccgtacccccgg

SEQ ID NO: 27234 - DNA, 748 bp, Homo sapiens
  misc_feature: GYAE6OF01B2Y5W.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaacgtggtggagtcggtggggggggtcttaggtccagccgtgggacctccctaagacctcctccgtgtgccacgcctcgtggtattcattcgttttggactaagttcgttggataggacgtcgggtcccgccgaagtagttccggagggggccgcgtgggaggtcggggtaggccaacgctaccgaaacggacgagtacgaacgaaaagggaccgtaacccttaacgtacgttttacggacttacggttggtacggggtaacgggggtcccgttacccgaactacgtccttacgaaggacgaaccgaaccggacccgaaacctaactaccgtaacctcgtaccgttccgtacgtccgtgtacgtagacgtcgtagtacgtacggtacgacgaccggaccgaacgaccgtacgtacttacgttacgttacgtgttacggtacgtaaccttacctaccttagtttccccccccccgttatacctacgtacgttaacggttaaccggtaccgggtacccggaacccgggttacccggttaccgggttcccggttacccgttcccgttcccgtcccgtaccccgg

SEQ ID NO: 27235 - DNA, 966 bp, Homo sapiens
  misc_feature: GYAE6OF01BFF75.6.75.G09.1.454.CMB.1.raw
  modified_base (167)..(167): a, c, t, g, unknown or other
  misc_feature (167)..(167): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgcttattttagaaggtgtccaatgtgaggtncaactggtggagtcggtgggggggtcttagtccagccgtcgggacctccctaagacctctcctgtcgcacgtccttcgtggtacttcctatttcgtttggacgtaacgtttccggttagggacggttggggtcccgttcgggggtcccgacccgtaaggttaccgtttacccggggacggggggggtaccccggtcggttaggggggtaacggttcggggggtacccgacccgtaaacgtaccgtaaaccggaaacccggacggtagtaaccggaaacggtaaaaccgggtaaccgttaaccgtttaaacgtttacggtttacggaccgtttaccggttacgggtacggggtacccggggttacccgttaaccctaaccgtaccgttacccgtaaccgaacggtaaccgtaaaccccgaaacccggtaccccgtaaacccgtaacccgttaccgttacccgtttacgttacccgttccgttacggtaccgttaaggccggtagtaaccggttacgtacgttaacggtcggaaaccggacccggaaccccggtaaccggtaacccggtacggtttaacccttaacccgtttaaccgtttaaccggtttacggtaacccgggttaacgttaaacccggtttaacccctactttaacccgtttaccggtttcccttaactaccgggttaactaacgggtaacccggtttacggggtaccccgggtaaccgggttaccccggtacccgggttacggtttccccggttacccttcccgttaacccgtcccggttaaacccccgg

SEQ ID NO: 27236 - DNA, 593 bp, Homo sapiens
  misc_feature: GYAE6OF02IP9MM.6.75.G09.1.454.CMB.1.raw
  modified_base (124)..(124): a, c, t, g, unknown or other
  misc_feature (124)..(124): n is a, c, g, or t
  modified_base (137)..(137): a, c, t, g, unknown or other
  misc_feature (137)..(137): n is a, c, g, or t
  modified_base (142)..(142): a, c, t, g, unknown or other
  misc_feature (142)..(142): n is a, c, g, or t
  modified_base (145)..(145): a, c, t, g, unknown or other
  misc_feature (145)..(145): n is a, c, g, or t
  modified_base (148)..(148): a, c, t, g, unknown or other
  misc_feature (148)..(148): n is a, c, g, or t
  modified_base (150)..(151): a, c, t, g, unknown or other
  misc_feature (150)..(151): n is a, c, g, or t
  modified_base (153)..(153): a, c, t, g, unknown or other
  misc_feature (153)..(153): n is a, c, g, or t
  modified_base (156)..(156): a, c, t, g, unknown or other
  misc_feature (156)..(156): n is a, c, g, or t
  modified_base (158)..(158): a, c, t, g, unknown or other
  misc_feature (158)..(158): n is a, c, g, or t
  modified_base (160)..(162): a, c, t, g, unknown or other
  misc_feature (160)..(162): n is a, c, g, or t
  modified_base (167)..(167): a, c, t, g, unknown or other
  misc_feature (167)..(167): n is a, c, g, or t
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
tcagatatcgcgagcacgaccggtgctcgatttagtatagacatcaggggctcagagaggagccttagccctggactccaaggccttccacagaggactcaccatggaattggggctgagcggngttcgtctaggcncttanagncangnngncangngnnnggggntagcngctggcncctagcnctcngncagctntgatcatcttgnagtctggatggctggtccgcagattccgaggggccggngtggnggtgggtcggacgaacgagtacgaacgacgagtagacgaaaggaacgacctaacgttagttacggtacgtacgtggtggtacggggtccggttaccgtaccgtactacgtaccgacgaacgaacgaaccgacccgaaccgaacctacctacctacgtcgtccgtcgtcgtagtagtagtacgacgagtacgtagacgacgaccgaccgacgaccgtacgtactacttacttactcgtacgtacgtaaccgtactactacgttccgttactactacgtacgtaacgtacgtacggtaccggtaccggtaccgttacggtccgttccgtccgtccgtcgtcg

SEQ ID NO: 27237 - DNA, 546 bp, Homo sapiens
  misc_feature: GYAE6OF02HU2UR.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctgggggggggcttagtccagcctggggactccctaagactctcctgtgcagcctctggattcatctttggcaagtcttggatgggctggtccgccagattccgagggggccggctggagtgggtggccaacatcaacgacgatgcaaaggagacctactatttggactctgtggaggggccgttcaccatctccagagacaacgccgacaactcactgtctctgctgatgaaagcagtctgagagccgacgacacggctatctattactgtgacgaaactctacacttccgttcattcgtagaacttacgtcggggaccctacggggaacccgttcgggtccgttcggttccttccctccgtaccg

SEQ ID NO: 27238 - DNA, 589 bp, Homo sapiens
  misc_feature: GYAE6OF02GIOPX.6.75.G09.1.454.CMB.1.raw
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
tcagatatcgcgagcacgaccggtgctcgatttagtatagacatcagggctcagagaggagccttagccctggactccaaggccttccacagaggactcaccatggaattgggctgagcgtgggttttcgttgttgctatttagaaggtgtccaatgtgaggtgcaactggtggagtcgtggggggggcttaggtccagcctggggactcctaagactctcctgtgcagcctctggattcatctttggcaagtcttggatgggctgggtccgcagattccgagggggcccgcgtgggaggtcggggtggcccaaacgatccgaaaacggaccgaattggacaaaagggagtaacccttaacgtattttgggactcgtaggtggacggggggtccgttcaaccagtcctcaaggagaaccaaacggccgaaccaaacgtcaacgttgtcncgtgctgatgancagtcngagngccgagacacggctaanctatactgtgacgaaacctntcatttcccgtnactacgttggaacttcggtcggggacctaacggggacccttgggtccgtcgttcccgtccgtacctacg

SEQ ID NO: 27239 - DNA, 521 bp, Homo sapiens
  misc_feature: GYAE6OF02HT72E.6.75.G09.1.454.CMB.1.raw
  modified_base (517)..(517): a, c, t, g, unknown or other
  misc_feature (517)..(517): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctgggggggggcttagtccagcctggggactccctaagactctcctgtgcagcctctggattcatctttggcaagtcttggatgggctgggtccgcagattccagggggccgctggagtgggtggccaacatcaacggacgatgcaaaggagacctactattggactctgtgaggggccgttcaccatctccagagacaacgccgaacaactcactgtctctgctgatgagcagtctgagacgccgacgacacggctatctattactgtcgcgtaaactctactattccgttcatctgaactacgtgggacccagggaaccctggtcgtcgtctcctnaccg

SEQ ID NO: 27240 - DNA, 553 bp, Homo sapiens
  misc_feature: GYAE6OF02IR1VT.6.75.G09.1.454.CMB.1.raw
  modified_base (547)..(547): a, c, t, g, unknown or other
  misc_feature (547)..(547): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagactctcctgtgcagcctctggattcatctttggcaagtcttgatgggctgggtccgccagattccaggggggccgctgggagtggggtggccaacatcaacggacgatgacaaaaggacgacctactatttggactctgtggaggggccggttcaccatctccagagacaacgccacaactcactgtctctgctgatgagcagtctgagacgccgacgacacggctatctattactgtgacgaaactctacatttcccgttcacttcgtggtaaacttacggtcggggacccaaggggtaacccccttgggttcccgtccgtccttccctntaccgg

SEQ ID NO: 27241 - DNA, 558 bp, Homo sapiens
  misc_feature: GYAE6OF02HA757.6.75.G09.1.454.CMB.1.raw
  modified_base (417)..(417): a, c, t, g, unknown or other
  misc_feature (417)..(417): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagctctcctgtgcagcctctggattcatctttggcaagtcttggatgggctgggtccgccagattccgagggggccgctggagtgggtggccaacatcgaacgacgatgacaaaggagacctactatttggactcgtgtggacggggccgttcaccatctccgagacgacaacgccgacaactcactgtctctgctgatcgancagtctggagacgccgaacgacacggctatctacttactgtacgacgtaaactctactacgtttccgtacagttcctaagaacttaccggtggggacccaacggggtacccttgggtccgtcgtaccttccgagtacccgg

SEQ ID NO: 27242 - DNA, 572 bp, Homo sapiens
  misc_feature: GYAE6OF02JFGN0.6.75.G09.1.454.CMB.1.raw
  modified_base (494)..(494): a, c, t, g, unknown or other
  misc_feature (494)..(494): n is a, c, g, or t
tcagatatcgcgagcacgaccggtgctcgatttagtatagacatcaggggctcagagaggagccttagccctggactccaaggccctccacagaggactcaccatggaattggggctgagctgggttttccttgttgctattttagaaggtgtccaatgtgaggtgcaactggtggagtcgtggggggggctagtccagcctggggactccctaagactctcctgtgcagcctctggattcatctttggcaagtcttggatgggctgggtccgccagattccgagggggccgctggagtgggtggccaacatcaacgacgatgcaaaggagacctactatttggactcgtgtggacggggtccgttcacctatcctaccagacgacaacgccgaacaactcactgtcctcgtgctgatgagcagtctgagacgccgacgaccgacggctaatccttattacgtgtacgacgaaacttctactacgtttcccgtnacttcgtagtaactacggtcggggaccctaacgggtaaccccgttgggtcccgttcggtcccttcccgtacgtacccg

SEQ ID NO: 27243 - DNA, 563 bp, Homo sapiens
  misc_feature: GYAE6OF02F5HUA.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagactctcctgtgcagcctctggattcatctttggcaagtcttggatgggctgggtccgcagattccgagggggccgctggagtgggtggccaacatcaacgacgatgcaaaggagacctactatttggactctgtgaggggccgttcaccatctccagagacaacgccgacaactcactgtctctgctgatgagcagtctgagacgccgacgacacggtctatctaatttactggtcgacgtaaactctactatttcccgttcattccgtgaaacttaccggtcgggggacccaacgggggtaaccccttggggttacccgttccggttccttcccgtacgtacccgg

SEQ ID NO: 27244 - DNA, 534 bp, Homo sapiens
  misc_feature: GYAE6OF02HJ1YY.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagactctcctgtgcagcctctggattcatctttggcaagtcttggatgggctgggtccgccagattccgagggggccgctgggagtggggtggccaacatcaacgacgatgcaaaggagacctactatttggactctgtgaggggccgttcaccatctccagagacaacgccgacaactcactgtctctgctgatgagcagtctgagacgccgagacacggctatctattactgtcgacgtaaactctactactttccgttcattctagaacttacgtcggggccaagggtaccctgggtccgtccgtcctccgtcaccg

SEQ ID NO: 27245 - DNA, 578 bp, Homo sapiens
  misc_feature: GYAE6OF02I5GBC.6.75.G09.1.454.CMB.1.raw
  modified_base (332)..(332): a, c, t, g, unknown or other
  misc_feature (332)..(332): n is a, c, g, or t
tcagatatcgcgagcacgaccggtgctcgatttagtatagacatcaggggctcagagaggagccttagccctggactccaaggccctccacagaggactcaccatggaattggggctgagctgggttttccttgttgctattttagaaggtgtccaatgtgaggtgcaactggtggagtctgggggggggcttagtccagcctggggactccctaagactctcctgtgcagcctctggattcatctttggcaagtcttggatgggctgggtccgccagattccgagggggccgctggagtgggtggccaacatcaacgacgatgcaaagganacctatatttggactctgtgaggggccgttcaccatctccagagacaacgccgaacaactcactgtctctgctgatgacgcagtctgagagcccgacgacacggtctatcttaattacctggtacgaccgtaaactcttacactttcccgttacaacttccgttaggtaaacttaccggtcggggggaccctaacgggggtaccccttggggttacccgttaccggtccttccccgtcgtaacccg

SEQ ID NO: 27246 - DNA, 613 bp, Homo sapiens
  misc_feature: GYAE6OF02GCG35.6.75.G09.1.454.CMB.1.raw
  modified_base (317)..(317): a, c, t, g, unknown or other
  misc_feature (317)..(317): n is a, c, g, or t
  modified_base (485)..(485): a, c, t, g, unknown or other
  misc_feature (485)..(485): n is a, c, g, or t
  modified_base (498)..(498): a, c, t, g, unknown or other
  misc_feature (498)..(498): n is a, c, g, or t
  modified_base (603)..(603): a, c, t, g, unknown or other
  misc_feature (603)..(603): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactcctaagactctcctgtgcagcctctggattcattctttggcagtcttggatgggctgggtccgccagacttccgagggggccgcgtggaggttggggtcggccaacnctaccgaaaccggacggatcggacaaaagggcgaaccttacgtaagttttgggacttcgtggttgggacgggggtcccgtttcaacccgtagtcctaccgagtaacgacaaccggccgaacaactcactgtctctgctgatgagcagtctgacgcgccgacgacacgntatacttattacngtcacgtaactctactacttcccgttatacgtactaggtaaccgtacggtacggggaccgtacgggttaaccccgtgggttacccgtaccgttccgttaccccgngtaaccccgg

SEQ ID NO: 27247 - DNA, 588 bp, Homo sapiens
  misc_feature: GYAE6OF02F9332.6.75.G09.1.454.CMB.1.raw
  modified_base (313)..(313): a, c, t, g, unknown or other
  misc_feature (313)..(313): n is a, c, g, or t
  modified_base (371)..(371): a, c, t, g, unknown or other
  misc_feature (371)..(371): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctgggggggggcttagtccagcctggggactccctaagactctcctgtgcagcctctggattcatctttggcaagtcttggatgggctgggtccgccagattccgagggggccgctgggagtggggtggccaantcaacgacgatgcaaaggagacctactatttggactctggtgaggggtccgttcaccntctcagagacaacgcgacaactcactgtctctgctgatgacgcagtctagacgacggccgacgaccacgggctaatcttagtttactggtacgaccgtaaaccttctacctacgtttcccgttacacttaccgtagtaaacttacccgggtcgggggaccctaaccggggtaaccccgttgggttacccgttccggttcccttccgtcctaacccgg

SEQ ID NO: 27248 - DNA, 577 bp, Homo sapiens
  misc_feature: GYAE6OF02G7XDP.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagactctcctgtgcagcctctggattcatctttggcaagtcttggatgggctggggtccgccagattccgaggggggccggctgggagtggggtggccaacatcaacgacgatgacaaaggagacctactatttggactctgtgaggggccgttcaccatctcagagacaacgccgacaactcactgtctctgctgatgagcagtctagagacgccgacgacgacggtctacgtacttattactggtacgaccgtaaaccttctactactttcccgttacattccgtagaacgttaccggtcgggggaccctaacggggtaaccccgttgggtcccgttccggttccctccgtcgtaacccgg

SEQ ID NO: 27249 - DNA, 546 bp, Homo sapiens
  misc_feature: GYAE6OF02IP2J0.6.75.G09.1.454.CMB.1.raw
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
  modified_base (466)..(466): a, c, t, g, unknown or other
  misc_feature (466)..(466): n is a, c, g, or t
  modified_base (492)..(492): a, c, t, g, unknown or other
  misc_feature (492)..(492): n is a, c, g, or t
  modified_base (544)..(544): a, c, t, g, unknown or other
  misc_feature (544)..(544): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtgggggggggcttagtccagcctggggactccctaagactctcctgtgcagcctctggattcatctttggcaagtcttggatgggctgggtccgccagattccgagggggccgcgtggaggtggggtggccaacatacgaacgacgatggacaaaagggacgaacctactagtttcggacttcgtggtggacggggtccgttcacctatctcagagacaacgccgacactcactgtctgngctgatgancagtcngagcgccgacgacacggctatctattacgngtcgactaactctctacttccgttanattcgaagtactacggtcgggacacgggtaccctgggtctccgtctcctacncg

SEQ ID NO: 27250 - DNA, 558 bp, Homo sapiens
  misc_feature: GYAE6OF02G6H88.6.75.G09.1.454.CMB.1.raw
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (481)..(481): a, c, t, g, unknown or other
  misc_feature (481)..(481): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagactctcctgtgcagcctctggattcatctttggcaagtcttggatgggctgggtccgccagattccgagggggccgctggagtgggtggccaanatcaacgacgatgcaaaggngacctatatttggactctgtgaggggccggttcaccatctcagagacaacgccgaacaactcactgtctctgctgatgagcagtctgagacgccgacgacacgggactatctattacgtgtacgcgaaaacttctactaatttcccgttanacttcgtagaaacttacggtacggggaccctaaggggtaccccttgggtcccgttccgttccgtacctccgtacccg

SEQ ID NO: 27251 - DNA, 578 bp, Homo sapiens
  misc_feature: GYAE6OF02JDY5Q.6.75.G09.1.454.CMB.1.raw
  modified_base (272)..(272): a, c, t, g, unknown or other
  misc_feature (272)..(272): n is a, c, g, or t
  modified_base (333)..(333): a, c, t, g, unknown or other
  misc_feature (333)..(333): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagactctcctgtgcagcctctggattcatcttggcaagtcttggatgggctgggtccnccagattccgagggggccgctgggagtggggtggccaacatcaacggacgatgcaaagganacctactatttggactctgtgaggggccgttcacatctcagagacacgccgacaactcactgtctctgctgatgancagttcngagacgccgacgacacggtctatccttattactgtagaccgtaaactccgtactaacgtttcccgttataacttcgtacggtaaacttaccgggtacgggggaccctaagggggtaacccccttggggttacccgttccgttccttcccgtacgtaacccgg

SEQ ID NO: 27252 - DNA, 556 bp, Homo sapiens
  misc_feature: GYAE6OF02GA386.6.75.G09.1.454.CMB.1.raw
  modified_base (276)..(276): a, c, t, g, unknown or other
  misc_feature (276)..(276): n is a, c, g, or t
  modified_base (411)..(411): a, c, t, g, unknown or other
  misc_feature (411)..(411): n is a, c, g, or t
  modified_base (483)..(483): a, c, t, g, unknown or other
  misc_feature (483)..(483): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtgggggggggcttagtccagcctggggactccctaagactctcctgtgcagcctctggattcattctttggcaagtcttggatgggctgggtccnccagattccgagggggccggctgggagtgggtggccaacatcaacgacgatgacaaaggagacctatatttggactctgtgaggggccgttcacatctcagagacaacgccacactcactgtctctgctgatgancagtcagacgcgccgacgaccacggcttagcttatactgtacgaccgtaaactcgtactacgtttcccgtanactcgtaagtaacttacggtacggggaccaacgggtacccttgggttaccgtaccgtccttccgtactacccg

SEQ ID NO: 27253 - DNA, 643 bp, Homo sapiens
  misc_feature: GYAE6OF02JFIGD.6.75.G09.1.454.CMB.1.raw
  modified_base (267)..(267): a, c, t, g, unknown or other
  misc_feature (267)..(267): n is a, c, g, or t
  modified_base (309)..(309): a, c, t, g, unknown or other
  misc_feature (309)..(309): n is a, c, g, or t
  modified_base (528)..(528): a, c, t, g, unknown or other
  misc_feature (528)..(528): n is a, c, g, or t
tcagatatcgcgagcacgaccggtgctcgatttagtatagacatcaggggctcagagaggagccttagccctggactccaaggccttccacagaggactcaccatggaattggggctgagctgggtttccttgttgctatttagaaggtgtccaatgtgaggtgcaactggtggagtcgtgggggggcttagtccagcctggggactccctaagactctcctgtgcagcctctggattcatcttggcagtctggatgggctggtccnccagacgttccgagggggccgctgggaggtgggtcggccaanagtcaaacggcgatggacaaaagggcaacctcgtaagtttcggactcgtggtggaacgggggtcccgttacaaccgattcctaccgaagtacgaacaaccggccgtaacaactcacgtgtactcgtgctagatcggagctagtcgtggaacgcgtacccggacaaccgcgggtactaacttcgttaaacgttacgtggtaacgtaacccgtaaaccttntccctaagttttccccgtataaggttcccgttaaaggtaacctttccggggaccgggttacccgaacgggttaaccccttgggttacccttcgttacccgtaccctcgtacccgg

SEQ ID NO: 27254 - DNA, 544 bp, Homo sapiens
  misc_feature: GYAE6OF02JN0T8.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagactctcctgtgcagcctctggattcatcttggcaagtcttgatgggctgggtccgcagattccgagggggccgctgggagtgggtggccaacatcaacgacgatcgacaaaggcgacctactatttggactcgtgtggacggggccgttcaccatctcagagacaacgccgacaactcactgtctctgctgatgagcagtctgagacgccgacgacacggctatcttaatactgtacgaccgtaaactctactacttccgttacattacgtgtaactcggtcggggaccctaacgggtacccttgggtccgttccgtctccctgaccg

SEQ ID NO: 27255 - DNA, 833 bp, Homo sapiens
  misc_feature: GYAE6OF02H660O.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcattctttggctaagttctttgagtgggctggggtccgccagacttccgagggggcccggtcgtgggagtggggtcggacccaaacgagtaccgaaacggaccgaagtcggaccgaaaagggacgaacccgttacgttaagttttagggaaccttcgttaggtacgggtacggggggtcccggttaccaacccgtaacgttcccgttacccgaaggaaccgtaacccgaaacccggtaccccggaaacctaaacccgttcccgaaacgtttccgggttaccccttaccggtttacggacccgttagggtaaagttacgggaaaccggtccgtaaagggttacccgttaaggaaacgggtaaccggaccccggaaacgtaaccggaaaccgggtcctttaaacgttacctttaacgtttaaccggtggttaaccggtaaaccgtaaaacccttccgtacgtttaccgtttccccgttactagtttacccgtaggaaaccgtttacgggtacccggggggtaaccctaaacggggggtacccccgttggggttaccccgtttacccggtttccttacccccgtagtaaccccgg

SEQ ID NO: 27256 - DNA, 540 bp, Homo sapiens
  misc_feature: GYAE6OF02I7HIE.6.75.G09.1.454.CMB.1.raw
  modified_base (335)..(335): a, c, t, g, unknown or other
  misc_feature (335)..(335): n is a, c, g, or t
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctgggggggggcttagtccagcctggggactccctaagactctcctgtgcagcctctggattcatctttggcaagtcttggatgggctgggtccgccagattccgaggggggccggctgggagtggggtggccaacatcaacgacgatgcaaaggngacctactattggactctgtgaggggccgttcaccatctccagacgacacgccgacaactcactgtctctgctgatgagcagtctgagagccgaacgacacggctatctatactgtnacgaaactctacattcccgttnattctagtaacttacgtcggggacctagggaccccttgggtacccgttcgtacctccctcgtaccg

SEQ ID NO: 27257 - DNA, 567 bp, Homo sapiens
  misc_feature: GYAE6OF02G49VY.6.75.G09.1.454.CMB.1.raw
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (378)..(378): a, c, t, g, unknown or other
  misc_feature (378)..(378): n is a, c, g, or t
tcagatatcgcgagcacgaccggtgctcgatttagtatagacatcgaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagactctcctgtgcagcctctggattcatctttggcaagtcttggatgggctgggtccgcagattccgagggggccgntggagtgggtggccaacntcgaacgcgatgacaaaggagacctatagttggactcgtgtggaggggcgttacacgtatctcaganaacaacgccgacaactcactcgtctctcgctgatgacgcagtctggagacgccgacgacacggctatacttacttctgacgacgtaaactctaactccttaccgttctaattcgtaataaccgttacgtcggggtaccgaacggggtacccttggggttacccgttccggtaccttcgtactaccccgg

SEQ ID NO: 27258 - DNA, 783 bp, Homo sapiens
  misc_feature: GYAE6OF02GSR1O.6.75.G09.1.454.CMB.1.raw
  modified_base (289)..(289): a, c, t, g, unknown or other
  misc_feature (289)..(289): n is a, c, g, or t
  modified_base (344)..(344): a, c, t, g, unknown or other
  misc_feature (344)..(344): n is a, c, g, or t
tcagatatcgcgagcacgaccggtgctcgatttagtatagacatcagggctcagagaggagcctagcctggactccaaggccttccacagaggactcaccatggaattgggctgagctgggtttccttgtgtctatttagaggtgtccaatgtgaggtgcaacgtggtggagtcggtgggggggggtcttaggtccgaggtccgtggggacctccgtaacggactctcctgtcgtcagcctgtggtattcattcgtttggcaaggttctggtagtgggcgttggggccncgagtacgttcccggaggggggcccgtgtgggaggggtgggtcggacccaaacgntaccgaaacggaccgtaagtggacaaaagggcgtaacctaacgttagtttcgggacctttcctaggttacgggacgggggtacccgttacaacccgattcccgtaccgaaagtaacgtaacccaaacgggccccgtaaaacaacgtccctaaccggttacgcccgtttacgacggttcccggtagtaacgtggaacggttaccgcggttcgtaaggaaccggtaaccgggccccgtaaacgggtccaaacccgggttctaaacgttccgttaaaccttttccggtaggttacccgaaacgttaaaccctttgcccgtttaacgttacccgttactaacgtttgtaaaaccgtacgtaacccgggggttcggaacccggttaacccccgggaacggtttcggggtaccgttccttccccggttaccccgactaacccggg

SEQ ID NO: 27259 - DNA, 655 bp, Homo sapiens
  misc_feature: GYAE6OF02GZZ1K.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcattctttggctaagttctttgatgggcgtgggtccgccagactccggagggggcccggcgtgggaggtggggtcggaccaacacgtaccgaacggacgatcgacgaaaggacgaccttaacgttacgtttggacttcgtggtggacgggggtccggttacacctactcctaccgagacgaaccaaccgacccgaactaacctccaactcgtcctcgtgcgtgacgtggagtccgtagtcctggacgacggccgaacgaccgacggtctattccttagtttactggacgtaccgtaaacttcctacttacgtttcccgttacacttcgtaagtaacttaccgggacgggacccggttaacgggaaccccggttgggttacccggttccgttcccgttacccgtcgtaaccccgg

SEQ ID NO: 27260 - DNA, 723 bp, Homo sapiens
  misc_feature: GYAE6OF02JGOWK.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggtttccttgttgctattttagaaggtgtccaatgtgaggtgcaactggtggagtcgtggggggggcttagtccagccgtggggactccctaagactctcctgtgcagcctctggattcattctttggcaagtctttgatgggctgggtccgccagattccgaggggggcccggcgttaggggaggttggggtggacccaacgagttaccgaaacggacgagtcggacgaaagggacgacctagttagtttggacttcgtggtgggacgggggtcccggttacaccgtacttctaccgaggacgacaaccgccgaaccaacgtccaacgttcgtacccttacgtcggaccttggaacgttagacggtcctaacggtttccgtagggaacggaaccggaccccgaaccggtaaccgaccgggtactttaacgttccttaacgtttacgttacggtacgtaacccgttaaaccttcgttaacctttacgttttacccgttcgtaactttcgtaacgttaacgttaccggtaccggggacccgtaaacggggttaccccttgggggttacccgttccgttacccgtttcccgaccgtacccgg

SEQ ID NO: 27261 - DNA, 571 bp, Homo sapiens
  misc_feature: GYAE6OF02J0IFC.6.75.G09.1.454.CMB.1.raw
  modified_base (273)..(273): a, c, t, g, unknown or other
  misc_feature (273)..(273): n is a, c, g, or t
  modified_base (336)..(336): a, c, t, g, unknown or other
  misc_feature (336)..(336): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (498)..(498): a, c, t, g, unknown or other
  misc_feature (498)..(498): n is a, c, g, or t
  modified_base (561)..(561): a, c, t, g, unknown or other
  misc_feature (561)..(561): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttaggtccagcctggggactccctaagactctcctgtgcagcctctggattcatcttggcaagtcttggatgggctgggtccnccagattccgagggggccgctgggagtgggtggccaacgatcaaacggcgatcggacaaaggngacctatagttaggactctgtggacggggtccgttcaaccntctccagacgacaacgccgacaactcgactgtctntgctgactgagacagtctganacgccgagacnccggntaagtcctatttaccgagttagccgtaaaactcgtcacgttttccgatntacgtcgtaatccggtacggggccctaacggtaccccgttggtaccgttaccggtcccttacncgtaacccgg

SEQ ID NO: 27262 - DNA, 623 bp, Homo sapiens
  misc_feature: GYAE6OF02I166J.6.75.G09.1.454.CMB.1.raw
  modified_base (296)..(296): a, c, t, g, unknown or other
  misc_feature (296)..(296): n is a, c, g, or t
  modified_base (381)..(381): a, c, t, g, unknown or other
  misc_feature (381)..(381): n is a, c, g, or t
  modified_base (449)..(449): a, c, t, g, unknown or other
  misc_feature (449)..(449): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagccgtggggactccctaagactctcctgtgcagcctctggattcatcgtttggctaagtcttggatgggctgggtccgcagattccgagggggccgngtggagtggggtcggccaacagtccaacgacgagtgacaaaggacgaaccttagtattggactcgtgtcgggacggggccgttanaccatcgtccgagacgacgaaccgccgaacaacgtcattcgtctacgtgctgaagtgacgcaggttcnggaaggccgaccgaacgcgaacggtctaagttaccttacgttacgtgacgtaacctaacttccgattaaccgtttcccttataccttacgttaacggtaactttccggggtaccgggaacccgttaacgggtcccgttacgggttcctccggttacccgttccctacggacccg

SEQ ID NO: 27263 - DNA, 564 bp, Homo sapiens
  misc_feature: GYAE6OF02GBHRA.6.75.G09.1.454.CMB.1.raw
  modified_base (314)..(314): a, c, t, g, unknown or other
  misc_feature (314)..(314): n is a, c, g, or t
  modified_base (335)..(335): a, c, t, g, unknown or other
  misc_feature (335)..(335): n is a, c, g, or t
  modified_base (483)..(483): a, c, t, g, unknown or other
  misc_feature (483)..(483): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcatcttggcaagtctttgatgggctggggtccgccagattcccgaggggggccgctggagtggggtggccaanatcaacgacgatgcaaaaggngacctactatttggactctgtgaggggtccgttcaccgtatctcagagaccaacgccgacaactcactgtctctgctgatgagcagtctgagacgaccgacgacacggctatctattactgtacgacgtaaactctacattcccgttnacttcgtaagaacttaccggtacggggaccctaacggggtaaccccttgggtacccgttcggttccctccctcgtacccgg

SEQ ID NO: 27264 - DNA, 583 bp, Homo sapiens
  misc_feature: GYAE6OF02HOVMR.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagactctcctgtgcagcctctggattcatctttggcaagtctttgatgggctgggtccgcagattccgagggggccgctggagtgggtggccaacatcaacgcgatgacaaaggacgacctacgttatttaggacttctgtggacggggtccgttcacatctcagagaacacgccgaacactacacgtgtctctgctgatgacgctagtcgttaggacgtacgacccgaacgactaccgggcttaagtccttacttagtcgtacgaccgtaaactctctaacgttccgtacgtatttccgaagttactaccggttcgggaccgtaaccgggtaccttgggttaccgtccgttccgtaccgctaacccgg

SEQ ID NO: 27265 - DNA, 529 bp, Homo sapiens
  misc_feature: GYAE6OF02GOZX6.6.75.G09.1.454.CMB.1.raw
  modified_base (377)..(377): a, c, t, g, unknown or other
  misc_feature (377)..(377): n is a, c, g, or t
  modified_base (479)..(479): a, c, t, g, unknown or other
  misc_feature (479)..(479): n is a, c, g, or t
  modified_base (526)..(526): a, c, t, g, unknown or other
  misc_feature (526)..(526): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtctggggggggcttagtccagcctggggactccctaagactctcctgtgcagcctctggattcatctttggcaagtcttggatgggctgggtccgccagattccgagggggccgctggagtgggtggccaacatcaacgacgatgacaaaggagacctactatttggactctgtgaggggccgttcaccatctccaganacaacgccgaacaactcactgtctctgctgatgagcagtctgagagccgacgacacggctatcttaattacgtgtcgacgtaaactctacatttcccgttanattactgaatcgtcgggccaagggacccttggtccgtcgtctccctnacg

SEQ ID NO: 27266 - DNA, 704 bp, Homo sapiens
  misc_feature: GYAE6OF02H48E4.6.75.G09.1.454.CMB.1.raw
  modified_base (225)..(225): a, c, t, g, unknown or other
  misc_feature (225)..(225): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtgagtcgtgggggggcttagtccagccgtgggactccctaagactctcctgngcgagtcctctggattcattcttggactagtcttggattggcgttggtccgctagtacgttccgagggggtccgcgtgggaggtgggtcggacctaacacgtcaaccggtacgagtcgacgaaacgggagtaacccttatacgttaggacttcgtggtaggacggggtccgttaccaccgtactacctaccgaaggacgtaacccgacggacccgtaacctaaccttccgtaccgttacggtccttacggcgtacgtagaagttcgtaacgaccttaggtaccgttgacggaaccggccctaacggggtccaacgggttcttacgttaacttacgtttaacgtggtaccctaaccggttaacttccgttctaacgtttccgtagtaccttacggaacttaacggtaccggttcggggaaccttaaacccggggtaccctttggggccctttaacccgtcgttaccccgtaaccgtcggg

SEQ ID NO: 27267 - DNA, 845 bp, Homo sapiens
  misc_feature: GYAE6OF02FGMZC.6.75.G09.1.454.CMB.1.raw
  modified_base (742)..(742): a, c, t, g, unknown or other
  misc_feature (742)..(742): n is a, c, g, or t
tcagatatcgcgagcacgaccggtgctcgatttagtatagacatcgaggggctcagagaggagccttagccctggactccaaggccttccacagaggactcaccatggaattgggctgagctgggttttccttgttgctatttagaagtgtccaatgtgaggtgcaactggtggagtcgtggggggggtcttagtccagccgtggggacctccctaagacctctcctgtgcagcctctggattcattcttttcggctaagtcttaggactgggctggggtcccgccgagtacgttccggacggggggtcccggctggggtacttggggtcgaccaaacattaccgaaacggaccgaattcggacgaaaacgggacgtaacccgttacgttaacgttttacggacttacgtcggtacgggtacggggggtacccggtttaccgaacccgtacgttacccgttaccgaacgggtaaccgtaaacccgaaacccggaccccggtaaaaccctaaaccttcccgtaaaccggtttccggtacctttaccccgtaggtacccgttaaggtaaccgttcgggtaacgtacccgtaagggttaccgttaacgggaacggaaccgggtaacccccgaacggtaacccggtaaccgggttacctttaacctacggttttaacgttttaaccggttaggttaaccggaaaccgttaaaacccttccgttaacgttaccgtttacccggttanaacgtccgttaaaggaacgtttacccgggacgggggtaccctaaccgggggttaacccttggggttaaccccttcccggtaccgttacccttccgaaacccgg

SEQ ID NO: 27268 - DNA, 808 bp, Homo sapiens
  misc_feature: GYAE6OF02GYMR2.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctggttttccttgttgctattttagaaggtgtccaatgtgaggtgcaactggtggagtcgtggggggggcttaggtccagccgtggggactccctaagactctcctgtgcagcctctggattcattcttggcaagtcttggatgggctcgggtccgccagtacgttccgagggggccggcgtcgggaggtggggtcgggtcccaaacagttaccgaaaccggtacgacgttagacaaaaaggacgtaccttaacgttagtttacgggacttcgttaggtacgggacgggggtcccggttaccgaccgtaacgttccgttaccgaacggaaccgaaccgaaaccgggtaccccgaaaccgtaaaccttaccgaaacccgtttacgttcccgttacgtcggtccgtttcgaacgttacgggaacgtccgtaacggttccggttaagggaaccgggtaccgggacccggtaaccggaaaccggtacccgggttaacgttaactttacccgtttaaatttacccgttggtaacggtacccgttaaaaccgttccgtactttacccggttttaccctttacgtaacgttaccgttacggtaaaacgtttcccgggacgggggtaccccttaaaccgggggtacccgtttacggggttccgtacccggtttcccttacccgaccggtaacccgg

SEQ ID NO: 27269 - DNA, 570 bp, Homo sapiens
  misc_feature: GYAE6OF02FRCKJ.6.75.G09.1.454.CMB.1.raw
  modified_base (415)..(415): a, c, t, g, unknown or other
  misc_feature (415)..(415): n is a, c, g, or t
  modified_base (459)..(459): a, c, t, g, unknown or other
  misc_feature (459)..(459): n is a, c, g, or t
tcagatatcgcgagcacgaccggtgctcgatttagtatagacatcagggggctcagagaggagccttagccctggactccaaggccttccacagaggactcaccatggaattggggctgagctgggttttccttgttgctattttagaaggtgtccaatgtgaggtgcaactggtggagtcgtgggggggggcttagtccagcctggggactccctaagactctcctgtgcagcctctggattcatctttggcaagtcttggatgggctggggtccgccagattccgagggggccggctgggagtggggtcggccaacatcgaacgcgaatgacaaagggagacctactagtttgactcgtgtggacggggtccgttcacctatctcagagacacgccgacaactcgactgtctntcgctgatagactcacggttctgagacggaccgacgacgacgtntatcgttattacgtggtcgaacgtaactctactacgttccttacatcgtacgaattacgggtcgggaccttaacgggacccgttgggtacccgtcgttcctccgtcgaccg

SEQ ID NO: 27270 - DNA, 700 bp, Homo sapiens
  misc_feature: GYAE6OF02FX3QY.6.75.G09.1.454.CMB.1.raw
  modified_base (350)..(350): a, c, t, g, unknown or other
  misc_feature (350)..(350): n is a, c, g, or t
  modified_base (540)..(540): a, c, t, g, unknown or other
  misc_feature (540)..(540): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagccgtggggactcctaagactctcctgtgcagcctctggattcattcgtttggcaagttcttggatggggctggggtcccgccagtattccgaggggggcccgcgtcggtagtggggtggccaacatccaacggacgatgacaaaaggganacccgtattagtttcggaacttcgtagtcggagggggtcccgtttcgaacctattcctaccgaaggaacgaaccgaacccggcccgtaaacctaaccttcctaacttcggttcctcgttcggacttcgagttcgacggtactacggtcgtaggacggacgcccggaaacggtacccacgggtacctttanaccgtttatttaaccgtggttacgaaccgtaaacctcttacttaccgtttcccgtttatacgttacgtttagaacgttaccgggtacccggggaccgtaaccggggttacccctttggggttccccgttacggtttcccccttacccgtcggtacccccg

SEQ ID NO: 27271 - DNA, 644 bp, Homo sapiens
  misc_feature: GYAE6OF02INJLU.6.75.G09.1.454.CMB.1.raw
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
  modified_base (455)..(455): a, c, t, g, unknown or other
  misc_feature (455)..(455): n is a, c, g, or t
tcagatatcgcgagcacgaccggtgctcgatttagtatagacatcaggggctcagagaggagccttagccctggactccaaggccttccacagaggactcaccatggaattggggctgagctggttttccttgttgctattttagaaggtgtccaatgtgaggtgcaactggtggagtcgtggggggggcttagtccagccgtgggacctcccgtaagactctcctgtgcagcctgtggattcattcttggctagtcttggatggctgggtcccncagacgttccggagggggccgcgtaggnggtcgggtcggacccgaacgaacgtccgaaccggacgtagtcggaacgaaaggacgtaacccgttaacgttagttcggacctcgtggtagggtacggggtccgtacaccgatcctaccgagaacgaccaacgaccagaacttcagtcgtctntgctggatcgagtactacgtcgtagacggtaccgaccgaaccgaccggtagacgtttactacgttaagtcgtgtaaccgaaccttaactcccgtagttaccttcccgtacctagttacgcgtaaacgtcggtaccgggaccgtaaacgggtccccgttaggttccgttcccgtcctaccgtgtaccccg

SEQ ID NO: 27272 - DNA, 648 bp, Homo sapiens
  misc_feature: GYAE6OF02IYRH8.6.75.G09.1.454.CMB.1.raw
  modified_base (274)..(274): a, c, t, g, unknown or other
  misc_feature (274)..(274): n is a, c, g, or t
  modified_base (466)..(466): a, c, t, g, unknown or other
  misc_feature (466)..(466): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcatctttggcaagtcttggatgggctgggtccncagattccgagggggccggctggaggtggggtggaccaacagtccaaacggacgatggacgaaaagggagtaaccttacgtaagtttggaccttcgtaggtgggacgggggtcccgttccaaccgtatccgtaccgaaggacgaaccgaaccggcccgaacaccgtcaacttgtctcgtgcttgaatggacncagttcaggagacgacccgagaccacggtcttaactcttaagttaccgtggtacgaccgtaaaccttctacgttaacttttcccgtactattaccgttacgaaccgtttacgggccgggggtaaccctacggggtaaccccgtttgggttacccggttccgttccccttccgtactacccgg

SEQ ID NO: 27273 - DNA, 625 bp, Homo sapiens
  misc_feature: GYAE6OF02IRQNS.6.75.G09.1.454.CMB.1.raw
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (298)..(298): a, c, t, g, unknown or other
  misc_feature (298)..(298): n is a, c, g, or t
  modified_base (332)..(332): a, c, t, g, unknown or other
  misc_feature (332)..(332): n is a, c, g, or t
  modified_base (534)..(534): a, c, t, g, unknown or other
  misc_feature (534)..(534): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagccgtgggactccctaagctctcctgtncagcctntggattcattctttggctaagtcttggatcggcttcgggtccgctagacttccgagggggccgngtggagtgggtcggaccaacatacgaacgtacgntgacgaaaggacgtaaccttactagttggacttcgtggtggacgggtccgttacacctagtctacgagacgacaaccggccgtaactactcacttcgtacttctggctagagtcgacgctagttcgtaggactacgccggaacacgacgtctagtccttaagttcgtgtaccgacgtaaacctttgaccgttatcccggttntaacgtttcgacgtaaacgttccgggtacggggtaccctaaccggggtaccctttgggtacccttaccggtcccttaccgcgtaaccccgg

SEQ ID NO: 27274 - DNA, 706 bp, Homo sapiens
  misc_feature: GYAE6OF02FOY3J.6.75.G09.1.454.CMB.1.raw
  modified_base (632)..(632): a, c, t, g, unknown or other
  misc_feature (632)..(632): n is a, c, g, or t
  modified_base (698)..(698): a, c, t, g, unknown or other
  misc_feature (698)..(698): n is a, c, g, or t
tcagatatcgcgagcacgaccggtgctcgatttagtatagacatcaggggctcagagaggagccttagccctggactccaaggccttccacagaggactcaccatggaattggggctgagctgggttttcttgtgctatttagaggtgtcaatgtgaggtgcaactggtggagtcgtgggggggggcttagtccgagccgtggggacgtcccgtaagacctctcctgtcgcacgcctctggtattctatcgtttggactaagttctttgattggggtccgttggggtcccgccaggtacttccgggacggggggtcccggcgttcgggaggttcggggtacggacccgaacgaacgtaccgtaaccggaacggaacgtcggacgaaaacggtaacgaaccgttacttaagttcggtaacgtacttcggtacggtacgggggtccggttacgtaccctactaccgtaccgagtacggaacgaacccgaccgaaccaacgtaccgtacctcgtccgtacttacggctacggacgttaacgacggacgttagtccgttacggaacgacggaccgaccgacggtaccgtctaacgtacttagtactgtcggactaacgtctactacttacccgttnacgtactagacgtacgggtacggacccgtaccgggtaccggttcgttagggttccctccggtcccnggtacccg

SEQ ID NO: 27275 - DNA, 624 bp, Homo sapiens
  misc_feature: GYAE6OF02GSDOY.6.75.G09.1.454.CMB.1.raw
  modified_base (461)..(461): a, c, t, g, unknown or other
  misc_feature (461)..(461): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctgggacctcccgtaagactcctcctgtgtagcctctggattcattctttggctaagtcgttggatgggcgtgggtccgccagacttccggagggggccgcgtgggagtggggtcggaccaacgagtacgaaccggacgatggacaaaagggacgacccttaattagttaggactcgtggtaggacggggtaccgtttcaccatcctaccgaggacaccaacgccgaacactcactgtctcgtgcgtgatagcgctacgngtagacgtacgaccggacacgaccggtctattcttacgttactagtagaccgtaactccgttcgtactttccgtctagttctaagtaacttaccggtacgggacccggttaacggtaacccgttcggttaccgtccgttcctacccgtacgaccgtacccccg

SEQ ID NO: 27276 - DNA, 703 bp, Homo sapiens
  misc_feature: GYAE6OF02IM5L0.6.75.G09.1.454.CMB.1.raw
  modified_base (621)..(621): a, c, t, g, unknown or other
  misc_feature (621)..(621): n is a, c, g, or t
tcagatatcgcgagcacgaccggtgctcgatttagtatagacatcaggggctcagagaggagccttagccctggactccaaggccttccacagaggactcaccatggaattgggctgagctgggtttcgttgttgctattttaggaacgtgtccaatgtgaggtgcaactggtcgagtcgtgggggggcttagtccagcctggggactccctaagacctctcctgtgcagcctctggattcagttctttggctaagtccttggattcgggcttggggaccgccaaggtcttccggaaggggggtccccgcgttgggaggttcggggtgcccgtaaagtagtaccgaaacggacgtagttggacccaaaagggacgtaaccccttaagttagttttacgggaaccctttggttccggtacgggtaacgggggtccccggtttacaccgtaacgtccgtaccgaggtaaccaccgtaaaccggcccgaataacctccgaagtcgtactcgacgtcgtagaatggaacgtctaaggtcttagacgacgaccgacgaacacggtacgtatacccgttataacgtttcggaagttccgtaaactctaccgtagtttaccccggttntaacttcgtaaacgtaacgtacggtccgggtaccgaaccggggtaccctgggtaccgttcgtaccctttcggactacccggg

SEQ ID NO: 27277 - DNA, 693 bp, Homo sapiens
  misc_feature: GYAE6OF02JMUIV.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtgggggggcttagtccagccgtggggactccctaagactctcctgtgcacgcctcgtggattcatcttggcaagtcttggatgggcgtcggggtcccgccgagtacgttccggaggggggcccggtcgtgggaggttgggggtcggacccaacgtactaccgaaacggacgagtcggacgaaaagggacgtaaccttacgttagtttacgggacttcgttggtacgggacgggggttaccgttaccacctacttccgtccgaggaacgaaccaaccggacccgaacctaaccgtcgaaccgttcgtccttcgtcgtcgtgtagtcggaacgtaccgtagttccgtagggtaaccgacggacccgtaacgaacggtccggtacttacgttacctttaacgttacgttcggacgtaaccgtaacctccgtaacttcgtttcccgtatacctgtaacgacttaccgggccgggacctacgggtacccgttggtcctccgtaccttccgactcccg

SEQ ID NO: 27278 - DNA, 758 bp, Homo sapiens
  misc_feature: GYAE6OF02IP79R.6.75.G09.1.454.CMB.1.raw
  modified_base (282)..(282): a, c, t, g, unknown or other
  misc_feature (282)..(282): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctatttagaagtgtccaatgtgaggtgcaactggtggagtcgtgggggggcttagtccagcctggggactcccgtaagactctcgtgtcgcagcctcgtggattcgattctttggcaagttcgttggattcgggctggggtaccnccgagtacgttccgaggggggccgcgtgggaggttcggggtcggacccgtaaacacgtaccaaaacggcggaacgttgacgaaaacgggtacgaaccttacgttaaagtttcggaaccgttgttacggttgggaacggggggttccccgtttcgaacccgtagttacctcccggtaagacggtaccaaaacccgggcccgtaaacctacgtcgtaacgttccgtactaccgtgaacccgtttgggaactcgggtaacgtaccgttaggtaccgtacggttaacgacggaccccgaaaggaaccgtcccgggtaatacttacggttaaacgttaccgtcgggttactaaccggaaaccttcgacgtttaccttttcgtaccgtattccgggtaacttaccggttaccggtcgggtaacctaaggtaaaccccggtccgtttacgggtaccggtttcccttaccgtccccgttaacgg

SEQ ID NO: 27279 - DNA, 850 bp, Homo sapiens
  misc_feature: GYAE6OF02HPASK.6.75.G09.1.454.CMB.1.raw
tcagatatcgcgagcacgaccggtgctcgatttagtatagacatcaggggctcagagaggagccttagccctggactccaaggccatccacagaggactcaccatggaagttgggctgagcttgggttttccttgttgcttattttagaaggtgtccaatgtgaggtgcaactggtggagtcggtgggggggtcttagtccagccgtggggacctaccctaagactctcctgtcgctacgtcctcgtggtactttcattcgtttggactaacgttcgtttggagtggggtcgttcggggtccccgacaggtaccgttccgggacgggggccgtcgtgggtacgggttcgggcggtaccaaacgtacgtaccgaaccgacgagtcgaacgaaaaggtacgtaacccttaagttagttttacggacttcgtagggtacgggaccgggggttaccggttaccctacccgtacttcccgtaccgtaaacggaaccgtaaaccggaaacccgacccgtaaccctaaaccgttaccgtaccgtttacgttaccttcgttcggtcgttaggttacggtcgtaacggtacgtacggttacgtaggaacggtaacccgggaacccgtaacccggtaccgggtaaccggttaacgttaaccgttttacttaaacgttttcggtacgggttaacggtaaacccgttaaacttcccgtttaaccttaccgttttcccgttactttaaccggttaaccgttaacgttaaaccgttaccggggtacccggtaaccccgggtaaccggggtttaccccgtggggtttacccccgtttacccgtttcccgttacccgttaacccgg

SEQ ID NO: 27280 - DNA, 756 bp, Homo sapiens
  misc_feature: GYAE6OF02HWDXE.6.75.G09.1.454.CMB.1.raw
  modified_base (604)..(604): a, c, t, g, unknown or other
  misc_feature (604)..(604): n is a, c, g, or t
  modified_base (633)..(633): a, c, t, g, unknown or other
  misc_feature (633)..(633): n is a, c, g, or t
  modified_base (651)..(651): a, c, t, g, unknown or other
  misc_feature (651)..(651): n is a, c, g, or t
  modified_base (667)..(667): a, c, t, g, unknown or other
  misc_feature (667)..(667): n is a, c, g, or t
tcagatatcgcgagcacgaccggtgctcgatttagtatagacatcaggggctcagagaggagccttagccctggactccaaggccttccacagaggactcaccatggaattggggctgagcgtgggttttccttgttgcttattttagaaggtgtccaatgtgaggtgcaactggtggagtcggtggggggggcttagccagccgtgggacctcccgtaaagctctcctgtgcacgtcctgtgtattaccattcgtttggactaagttcgttaggagtcgggtcgttcggggtcccgaccgtagtacgttccgggacggggggcccgtcggtaggggtagggttcggggacggaccaaacgtacgtaccggaaaccggtaggtacgtggaaaccggtaaaggaaccggttaaccttaacgttacggtttacggaaccgtttcgtacggtacggggtaccgggggtacccggttaccaaccgtacggttacccacccggtaaggaacccgtaaaccggaaacccggtacccgaaacgtaaccctaaccgtaaccgttccggttccttacggtctacgttaggactacggaacgtcgtaacggttnacgggaagaccgtaccgaacgagaccgtnttaacctacgtattacgnggtaacacgtaacctntaaccgttccgttactcgatttcggataaccgtcggacggtacccgtaaccggttaccgcgttccgttaccctcgttcccacgtacccg

SEQ ID NO: 27281 - DNA, 663 bp, Homo sapiens
  misc_feature: GYAE6OF02HZJTF.6.75.G09.1.454.CMB.1.raw
  modified_base (501)..(501): a, c, t, g, unknown or other
  misc_feature (501)..(501): n is a, c, g, or t
  modified_base (552)..(552): a, c, t, g, unknown or other
  misc_feature (552)..(552): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtgggggggggcttaggtccgagccgtggggacctcccgtaaagacctctcctgtgcagcctcgtggattacattcttttcggctaagttctttgagtcgggtcgttcggggtcccgcgtaacgtacgttccggacgggggcccggtcgttgggtaagggttggggtacggcccgaaacgtacgtacgaaacggtacgagtacggaacgaaaggacgtaacccttaacgttacgtttcggactcgtgttagggacggggtccgtcaccattccgacagaacgacaacgccaacactctactcgtctcgtgcctagatacgngcgtagcgtggacgacgtccgaacgacgcgtacttactacgtacgttacgngtacgtaccgtaaacttccagttacctttcgtctaacgttcgtaagacgttccggacgggtaccccgtacgggtaccgttcggtccttccggtctacccgttgaaccccgg

SEQ ID NO: 27282 - DNA, 943 bp, Homo sapiens
  misc_feature: GYAE6OF02HAILY.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagcttggttttccttgttgctatttagaggtgtccaatgtgaggtgactaactggtggagtcggtggggggggcttagtcacggtccgtcgggtacgtaccctaacgactctcctcgtgcacgcctctggtatctattcgtttcggactaacgtcgttggtaggtgggtccggtcgggtccgtaccgagtacgttccggtacggggggcccggtacggtgggtggggttacggggtcggacccgtaaaacgtacgttaaccgaaaaccggaacggttaacgaccggtaacggaaaaagggtaacccgtaacgttaaccgttaacggtttacggtaaccgttcggttacggtaggggtaaccgggggggttacccggttcccgaaaccgttaccgtaacccgttcccggaaacgggtaaacgaacccggaaacccggttaacccggaaaccttaaacccggtacctacgttacgttcccgttaccggttcctagttacggtaaggttaccgaacggtaccgtagttaccgggtacggtaacggaaacccgggtacccgtaaacgggaacggttaccccgaacggttttaacctaacgtttaacccggttttggttaccggtaaaccgtaacccgttaaaaccgttaccccgttacgttaaccctttacccggtttacccgtaacctttaacggtttaacgtaacccggggttaaacccggttacccggggggaacccccggggttaacccggggttaaccccggtaccggggggttttccccgttacccgtttttacccacccccggttacccgtaaacccccggg

SEQ ID NO: 27283 - DNA, 806 bp, Homo sapiens
  misc_feature: GYAE6OF02HP6VM.6.75.G09.1.454.CMB.1.raw
tcagatatcgcgagcacgaccggtgctcgatttagtatagacatcaggggctcagagaggagccttagccctggactccaaggccttccacagaggactcaccatggaattgggctgagctggttttcctgttgctatttagagtgtcaatgtgaggtgcaactggtggagtcgtgggggggcttagtccagccgtggggactcccgtaagacctctcctcgtgcagcctcgtggattcattcgtttggactaagttcgttggtagtgggtccgtcggggttcccaccgaagtacgttccgacgggggtacccgtcgtacgggtaggtggggtacggtaccgaacgacgttaccgaaaacggtaccgtaagtacggaacgaaaacggtacgtaacccgttaacgttaacgtttacggtaacttagttacggtagggacggggtccggtttaccaaccgtaacgttcgtaaccgacgtaacgtaaccgaaccggaccgaacctaacgttccacgttcgtacgttctgcgtagtaacgttcgaggaacccgagttacggtaggtacgaacccggcccgtaacgaacccggtaaccgttagttaaccctttaaggttaaccctttaaggttacgtacgttaaacccgtaaaacgttcgtacctttaccgtttaccgttacgttaaccctttagttaacgggaaccggttttaacgggtcccgggggtaacccttaaacccgggggttacccgttaaccgggtttacccgtttcccggttaaccccggtttacccacgggttaaaccccc

SEQ ID NO: 27284 - DNA, 784 bp, Homo sapiens
  misc_feature: GYAE6OF02IUA8I.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaggtgtccaatgtgaggtgcaactggtgagtcgtggggggggcttagtccagccgtggggactccccgtaagactctcctgtgcacgcctctggattcattctttaggctaagtcttggactgggcgtgggtccgaccagacgttaccgacggggggaccgtcgtagggaggttcggggtggaccaaacgagtacgaaaccggacggaatcggacgaaagggaccgaacttaacgttagtttaggactcgttgtacgggacggggtcggttacccaacctacgtacctacggtacgaacgaaccgaaaccggcccgtaacgaaaccctccgtaacgtttcgtaccttacggttacgtccggttaagacgtagaaccggttacctaacggttacgagggtaaccggtaaccgcccgggtaaaccgaccccgtaaccgggtcttaaacgtccgtttttaaacgtacggtttaacggacggtaaacgttaaacccttcgtaaccgttttaccgttaccccggttattaaaccttttccggtaaagggttaaaccgaccggggttcccgggggtaaaccgtaacggggttccccgttagggggtttccccaacggtttttccgaaccccttcggaacccccg

SEQ ID NO: 27285 - DNA, 747 bp, Homo sapiens
  misc_feature: GYAE6OF02FVZAU.6.75.G09.1.454.CMB.1.raw
  modified_base (313)..(313): a, c, t, g, unknown or other
  misc_feature (313)..(313): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagccgtggggactccctaagactctcctgtgtagcctcgtggattcattcgtttggactaagttcgttggagtgggcgtcgggtccgccagtacgttccggacggggggtcccgngtagggaggtcggggtcggacccgaaacgtagtaccgaaacggacggatacggaacgaaaacgggacgtaacccgttaacgtttagtttacggacttcgtaggtacgggtaacgggggtcccggttaccaacctacgtcccgtaccgaggtaacgaaccgaaccggtaacccgaactaaaccgtacgacttcgttcctcgtacgcgtagtagtagacgtacgtgtacgtaggaacggacgaccgaacggaacgaccggtactattacttacgttacgtcgtacgaccgttaaacgtcttacgttaccgtttaccgttactacgttacgtacgtaaacggttaccgggacccggggtaacccgtaaccgggttaccccggttacggttcccggttaacccgtccccgtttacccgtaccgtaccctaacccccgg

SEQ ID NO: 27286 - DNA, 994 bp, Homo sapiens
  misc_feature: GYAE6OF02HER7W.6.75.G09.1.454.CMB.1.raw
tcagatatcgcgagcacgaccggtgctcgatttagtatagacatcaggggctcagagaggagccttagccctggactccaaggccctccacagaggactcaccatggaattgggctgagcttggttttccttgttgcttattttagaaggtgtccaatgtgagtgacactggtggagtcggtgggggggtcttaggccgaggccgtggggacctacccgtaagtctcttccgtgtcgcacgcctcgtggtattccattcgttttggactaacgttcgttaggagttcggggtacgttcggggtcccgccgtaacggtacgtttccccggaacgggggggtccccggtcgttacggggtagggttcgggggttacggaccccgaaaaccgtacggtttaacccggaaaacccggacggtaacgttaccggaacgaaaaaaggggtacccggtaacccgtttacgttttaacggtttacgggacccgttttaccgttaggggttacggggtaacggggggttaccccggtttaaccgaaccgttaacttcccggttaaccgaagggttaaccggaaacccgtaaacccgggaacccccgtaaaaccgttaaccgtacccgttaaaccggtttccgtttaaccgtttcccgggtttcggaacccgtttagggtaaaccgtttaacgggaaccgtacccggttaacggtttaccggttaacgggggacgtaaaccccgggtacccggtaaacccggttacccggaaccgggtttaaccctttaacgggttaaccgtttttaaacgttccgggttaacgggtttaccgaaaccgggttaaaacccttccgttaaccgttaacccgttttcccgtacgtttaagtaacccgttaacggtttaacggtaccgggttaaccggggtacccgggttaacggtaccccggttttaaccgggtccgtttacccggtttccgtacccgtacccgtttaacccccgg

SEQ ID NO: 27287 - DNA, 728 bp, Homo sapiens
  misc_feature: GYAE6OF02HMPYJ.6.75.G09.1.454.CMB.1.raw
  modified_base (408)..(408): a, c, t, g, unknown or other
  misc_feature (408)..(408): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcggtggggggggcttaggtccagccgtggggacctccgtaagactctccgtgtgcgacgccttcgtggacttctagttctttggactaagttcgtttaggagttgggcgttacggggttcccgccgaggtacttccgaggggggtcccgcgttgggtacggtgggtcggaccaacgagtcaaacgcgagtgacgaaaagggacgaaccttaacgtagtttcggaacttntacggttaggaccgggggtccgttaccgaccgtacttccgtcccgtaaggaacgtaaacccgaaccgacccgaaacctaaacgtcctaacgtcggtttacctcgttacgtccgttggaacgtggtaacgcggtcgtaccggtaggtaacgcggaacccggagaccgtaaccggccttacgttaaccgttagtaacttcggtacgtacgtaaaactccttaaccgttcgttacccgtactacgttcgtaacgaacgttcggtacgggtaccgaacccgggttaccgtacgggtaccttccggtaccctaccgtcctaccgg

SEQ ID NO: 27288 - DNA, 794 bp, Homo sapiens
  misc_feature: GYAE6OF02GOOKZ.6.75.G09.1.454.CMB.1.raw
  modified_base (228)..(228): a, c, t, g, unknown or other
  misc_feature (228)..(228): n is a, c, g, or t
tcagatatcgcgagcacgaccggtgctcgatttagtatagacatcaggggctcagagaggagccttagccctggactccgaaggccttccacagaggactcaccatggaattgggctgagctgggttttcttgttgctatttagaggtgtccaatgtgaggtgcaactggtgagtcgtgggggggtcttagtcgagcctgggactcctaagctctcctgtgcagcctntggtattctattcgtttggactaagttcgttggagttgggcgttcggtcccgcagtacgttccggagggggtccgcgtggaggtcggggtcgaccgaacgtagtaccgaaacggtacgatacggaacgtaaaaggaccgtaccttacttagttagggtcctacgtgtagggtaccgggggtccgtttaccaccctcgtacctacgaacgtaacgacccgaaccggaccgtaaccaaccgtacccgtagttcccgttaccctcggttcgacgtacggtaagtacgtacgtccggtaacgttacggacgggacgtaccggaacccggaaccggttaaaccgtacccgggtaacttacggtaacgttttaccgtttaacccgttagggttaaccgttaacccttaaccgtttaccgttaaacgtttaccccgtttaccgtttccgtaagttccggttaaacggttaaccggttaaaccggggttccggggtaaaacccccgttacgggttaaccccttttccgggggttaccctttcccgtacccgttaccccggtacttaacccccgg

SEQ ID NO: 27289 - DNA, 770 bp, Homo sapiens
  misc_feature: GYAE6OF02HASQ4.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaggtgtccaatgtgaggtgcaacgtgggtggtaggtcggtgggggggggtctttagtccgacgccgtgggacctaccctaagacctcctccgttagtcgtcacgtcccttcgtaggtacttcgtattcgtttcggactaacgttcttagggtagttcgggtcgttccgggtcccgccgtaagtacgttccggacgggggtccggtcgggtgggagggtcgggtcggaccaaacgacgtaaccgaaccggacgtaagtacgaacgtaaacggtacaaacctttacttacggttacggactcggttaggtcggggtaccggggtcgttaaccacgtaacgttccaccgtaagaacgaaccaaccgacccgtaacacctcgtacgttcgtccgtcttagtcgtcggtagtacgacgtacgtagtacgtaggtaacggccggaaccgtaaccgaaccggtaccggtaactttacgttaaccttaacgttaccgttacggttaccgtaaacgttacctacggttccttaccgtttaccgttacttcgttaccgtggtaacgttaacgggccgggtaacccgtacgggttacccgtcggttaccgttccggtaccctaccgtcgtacccg

SEQ ID NO: 27290 - DNA, 607 bp, Homo sapiens
  misc_feature: GYAE6OF02GX866.6.75.G09.1.454.CMB.1.raw
  modified_base (229)..(229): a, c, t, g, unknown or other
  misc_feature (229)..(229): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
  modified_base (555)..(555): a, c, t, g, unknown or other
  misc_feature (555)..(555): n is a, c, g, or t
tcagatatcgcgagcacgaccggtgctcgatttagtatagacatcaggggctcagagaggagccttagccctggactccaaggccttccacagaggactcaccatggaattggggctgagctggttttctgttgctattttagaggtgtccaatgtgaggtgcaactggtggagtcgtggggggggcttagtccagcctggggactcctaagactctctgtgcagcctntggattccattcgtttggactaagtcgttaggatgggctcgggtccgtcagacgttccgaggggtccggcgtggaggtggggtacgaccaacgtgtaccgaacggacgtaactcgaacgaaagggactaactacttaagttcggactctggtacggacggggtccgttacaacgtactctacgagagacacgccaacgtactcacgtgtcngtcncgtagacgngagtcaggttcaagggtacgacgtcccgaagacctacggtactattacgttaactacgtaggtcgaacctaaacgttctacctagttccgtatactcgtaanaacgttcggtacggacttacggaccttggtaaccgtctactacctacgaccg

SEQ ID NO: 27291 - DNA, 766 bp, Homo sapiens
  misc_feature: GYAE6OF02I7NCN.6.75.G09.1.454.CMB.1.raw
  modified_base (182)..(182): a, c, t, g, unknown or other
  misc_feature (182)..(182): n is a, c, g, or t
  modified_base (684)..(684): a, c, t, g, unknown or other
  misc_feature (684)..(684): n is a, c, g, or t
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgngggggggggtcttagtccagcctggggactcctaagactctcctgtgcagcctctggattcattctttggcaagtcttggagtggcgtgggtccgccagacgttccggagggggcccggcgtgggaggttaggggtcgggaccaaacgtacgtaccgaaaaccggacggtaagtcggaccaaaacgggacgtaacccgttaacgttagttttacgggaacttcgttggtacgggacggggggtccccggtttaccaacccgtatccgtacccgaacggacggtaaacccgaaacccgggacccggtaaaccctaacccgttacaaccgttgttaccccgttcttcgggacccgtttaggaaccttgggaacgtccctaacgggttccggttaggaaaccggaccgggacccggtaaccgacccgtaaccgggtacttaacgtacgtttaacttccggttagtacgggtaaacctaaacttgtaccttaacgtttcccgttanacttcgtaagtaaccggttcggtccggggtaccctaacggggtacccttggggttaccctccgtccttcccggcctaaccgg

SEQ ID NO: 27292 - DNA, 941 bp, Homo sapiens
  misc_feature: GYAE6OF02I0U3F.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcattctttggctaagtcttggatgggcgtcgggtccgccgagtattccggaggggggcccggtcgtgggaggttggggtacggaccgaaactacgtaccaaacggaacggtactacggaacaaaaggggacgtaaccttaccgttagtttacggaccttaccgtaggtacgggaacggggggtcccgtttacgaacccgtactccgttaccgaaggaaccgaaccgaaacccggtacccggaacctaaaccgttccgaaaccgtttcgggttaacccttccgttacgggtccttacgggtaacgttagggaaaccggtcccgttaacgggttacccttacgggaaaccgggtaaccggtaacccccggggtaaacccgaaaccccgggaaaccgggttaacccttttaaacggtttaacccccgtttttaaagtttttaaacccgttacgggggttttaacccgggtaaaaccccggttaaaaccgtttaccccgtttaaccgtttaaaccctttttaccccgggtttttaacctaacggtttttacccggttaaacggttaaaacccggttttcccggggttaaaccgggggggaaccccccgttaaaaccggggggttaacccccggtttacgggggtttacccggtttccccggttttacccccgtttaccccggtttacccggttaaacccccggg

SEQ ID NO: 27293 - DNA, 667 bp, Homo sapiens
  misc_feature: GYAE6OF02HQW49.6.75.G09.1.454.CMB.1.raw
  modified_base (161)..(161): a, c, t, g, unknown or other
  misc_feature (161)..(161): n is a, c, g, or t
  modified_base (217)..(217): a, c, t, g, unknown or other
  misc_feature (217)..(217): n is a, c, g, or t
  modified_base (484)..(484): a, c, t, g, unknown or other
  misc_feature (484)..(484): n is a, c, g, or t
  modified_base (510)..(510): a, c, t, g, unknown or other
  misc_feature (510)..(510): n is a, c, g, or t
  modified_base (543)..(543): a, c, t, g, unknown or other
  misc_feature (543)..(543): n is a, c, g, or t
tcagatatcgcgagcacgaccggtgctcgatttagtatagacatcaggggctcagagaggagccttagccctggactccaaggccttccacagaggactcaccatggaattggggctgagcgtggtttctgttgctatttagaaggtgtcaatgtgaggtncaactggtgagtcgtgggggggactgtccagcctgggactcctaagctctctgtgnacgcctctaggattcgacttcttggactaaggttcttttggagtgggtctgggttccgcctaagtacgttcccggagggggtcccggtgtagggtaggtcggggtaggacctaaacgtcgtacgaaccggacgtagttacggacgaaaacggtacgtaaccgttaacgtttaacgttttggaacccttcggtggtaggggtaccggggtccggttacaccgtatacgttaccaggaacaccgaacggccgtaaacacttacgacgtntcctacgttgactgaactggatacgngtacgaggactaggacccaacggacaccgggtntaactgttaacgtacctaggtaccgtactaacgttctaacgttacctttcggtcaggttcaacgtacggtaacgtggggtaccacggggtacctacgggttctaccggtacctccctagtcccg

SEQ ID NO: 27294 - DNA, 759 bp, Homo sapiens
  misc_feature: GYAE6OF02HM933.6.75.G09.1.454.CMB.1.raw
  modified_base (375)..(375): a, c, t, g, unknown or other
  misc_feature (375)..(375): n is a, c, g, or t
tcagatatcgcgagcacgaccggtgctcgatttagtatagacatcgaggggctcagagaggagccttagccctggactccaaggccttccacagaggactcaccatggaattggggctgagctgggttttccttgttgcttattttagaaggtgtccaagtgtgaggtgcaacgtggtggagtcggtggggggggtcttacgtccagtccgtggggacctccgtaagtactctcctgtacgcacgtcctgtggtacttctacttcgtttggacgtattcgttggtagtcgggtcgtcgggtccgcgacgtacgtccggagggggccgcggtgggtaggtcggggtacggaccctaacgtacgtacgtaaaccggngtacgtacgaacgaaacgggacctaactacgttaagttcgtacgtacgtgggtcggtacggggtccgttaccaaccgtacgtcccgtacgaacggtacgtaaacccgaaccggtacccggtaactaacccgtctaacgttccgtccgttacgtccgtacggtacgtagacggtacgtacgtcggtacgtaagtacgaccggtaccggaacgacggtaccgttacgtagttaaccttacggttactacggtacgtacccttaagttacctaacctttccgttacctacttcggttacgtaacggtaacgttcgggtaacccgggtacccgttaccgggacccgttaggtcccgtttaaccggtccccttacggcccgtaacccgg

SEQ ID NO: 27295 - DNA, 818 bp, Homo sapiens
  misc_feature: GYAE6OF02FJU89.6.75.G09.1.454.CMB.1.raw
  modified_base (694)..(694): a, c, t, g, unknown or other
  misc_feature (694)..(694): n is a, c, g, or t
tcagatatcgcgagcacgaccggtgctcgattttagtatagacatcaggggctcagagaggagccttagccctggactccaaggccttccacagaggactcaccatggaattgggctgagcgtgggttttccttgttgctattttagaaggtgtcaatgtgagtgcaactggtggaggtcggtggggggggtcttacgtcgacggccgtgggacctcccgtaaagcctcctcctgcgcacgcctctggacttctactcttggactaagttcttgggatgggtcgttcgggtccgctagagttccgggaggggtccggacgttgggcggtggggtacgaccgaacacgtacggaacgacgtgtacggaacgaaacggctaaccctatttaggttacgtacgttcggtggtacgggccggggtaccgttaccaccgtacgtacctcgaacggtacgaaccgaacccgacccgaacctaacccgtacgttacctccggttaaccttcggttaccgtacggttacgtacgttacggccggtaacgtacgggttccgaagggttaccgtaaacccgggacccggtaaaccgtaccgggtacccgtttacgtaccgtttaacgtttagtttaacccggtttcggttaaacgggaaccccttaaacgtttcccgttaaaccgttccgttttaaccccggtnttaacccggtttacgttaacccggttaaccgttacccggggggtacgtaaccccgggttaaccgggttaccgtttccggggttcccgtttcccggttaacccgttaccccgtacctaccccggg

SEQ ID NO: 27296 - DNA, 782 bp, Homo sapiens
  misc_feature: GYAE6OF02ILCE6.6.75.G09.1.454.CMB.1.raw
  modified_base (136)..(136): a, c, t, g, unknown or other
  misc_feature (136)..(136): n is a, c, g, or t
  modified_base (163)..(163): a, c, t, g, unknown or other
  misc_feature (163)..(163): n is a, c, g, or t
  modified_base (174)..(174): a, c, t, g, unknown or other
  misc_feature (174)..(174): n is a, c, g, or t
  modified_base (302)..(302): a, c, t, g, unknown or other
  misc_feature (302)..(302): n is a, c, g, or t
  modified_base (587)..(587): a, c, t, g, unknown or other
  misc_feature (587)..(587): n is a, c, g, or t
  modified_base (699)..(699): a, c, t, g, unknown or other
  misc_feature (699)..(699): n is a, c, g, or t
tcagatatcgcgagcacgaccggtgctcgatttagtatagacatcgagggctcagagaggagccttagcccgtggactccaaggcccttccacagaggactcaccatgaattgggctgagctggttttccttgttncttattttagaagtgtccaatgtgagngcaatggtagngtggtgggggggtcttagtcacgtcgtcgggaccttcccgtaaagtccttccgttccttcgtgccgtcgtacccgttcgttaggactttccgtactttccgtttacggtacgtacgttttctttacgnggttcgggcgtttccggtaccccgcgaacgtacggttccggggacggggccggtaggtgggaacgggttcgggtaccgaccgtaaacgtaccgttaacggaacggtaccgaagtaccggaaaaccgaaaacgggtacccttaaacgtttacgttaacgtttacggaacgttcgtggttaacgggtccggggttacccgtacgcccgtaaacttcgtaaccgaaagtacccaaaccgtaccgaccgtaaccacgtactaacgttcgtacgcgttcgacgtaacgtnacggtactcgttacgtgtacgagacgttaaccggacgtacccggcgttaacttacgttactttaggaactcggtacgtaaccgttaacgttcgtaaccttcgtttaccggtntaccgtgaacgttaaccgtaccgggtccgggacccgtaccggttaccggttccgttccgtacccgttccgtcgacccttcccg

SEQ ID NO: 27297 - DNA, 769 bp, Homo sapiens
  misc_feature: GYAE6OF02HPQWG.6.75.G09.1.454.CMB.1.raw
  modified_base (118)..(118): a, c, t, g, unknown or other
  misc_feature (118)..(118): n is a, c, g, or t
  modified_base (465)..(465): a, c, t, g, unknown or other
  misc_feature (465)..(465): n is a, c, g, or t
tcagatatcgcgagcacgaccggtgctcgatttagtatagacatcaggggctcagagaggagccttagccctggactccaaggccttccacagaggactcaccatggattgggctgantgggttttccttgtgctagtttagagtgtcctaatgtgaggtgacgaatggtaggtagtcggtgggggggcttaggtccaggccgtgggacctccgtaagactctaccgtgtgcacgcctcgtggtatcattcttcggactagttacgttggagtcgggtcgttacggccgacgtagacggttccggacgggggtccggacggtaggacggtcgggtcggaaccaagtagtaacgaacgtagacgagaacggaaaggctaaccgtagttacgttgacttcgtaggtggaccgggtccttaccgaccgtatccgaccgtacgtaaacgaccgaaacccggtacccaanaacccgttccgtaacgtccgttccgttccgttaacggcttaaccggtagtaggtaccgttaggtaccggtaccgttaaggaacggaacccgggacccgaaccgtaccgggtaaccttaacgttaccttacctagtttaccgtgggtaaccctaccgttaaccgttctaaaccgtttacccgtttacgtaacgttcgttaacgtaaaggttacccgttagggggaacccggttaacccgtaaccggggttaccccgttacgggttaccggtttcccccgtttacgcccccggtaagtacccccgg

SEQ ID NO: 27298 - DNA, 806 bp, Homo sapiens
  misc_feature: GYAE6OF02F7PSF.6.75.G09.1.454.CMB.1.raw
tcagatatcgcgagcacgaccggtgctcgatttagtatagacatcagggggctcagagaggagccttagccctggactccaaggccttccacagaggactcaccatggaattgggctgagctgggttttccttgttgctattttagagtgtccaatgtgaggtgcaactggtggagtcgtggggggggcttagtccagccgtggggactcccgtaagacgtctcctgtcgtcgacgcctcgtggacttcattcgtttggctaagttcttggagtcggggtcgttcgggtcccgcctaacggtacgttcccgggacggggggcccggtcggttggggtagggttcgggtacgggaaccgaactaacgtaccgaaaccgacggaagtacggaacgaaaagggacgtaaccgttacgttaacgttttaggaacctttcgtacggttaggggtaccggggttccgggttaacctaaccgtaacgttccgttaacccgaaggaacggaaccgaaaccggtccccgaaacctaaccgtactaacgttcgttacctcgttcgtacgtacggtacgtggaacctacggtaacgtcgttaggaacgaccggtacccggaacggtacccgagggttaccttacttaaccgttagttaccgtagtccggtaacctaacgtacctacgtttacgttcccgtttacacgtttaccgcggttaaaaccttacgggtaaccggggaaccgtttaaccggggttaaccccgttggggttacccggttccggtttaaccccttcgggttaccctaaccccggg

SEQ ID NO: 27299 - DNA, 721 bp, Homo sapiens
  misc_feature: GYAE6OF02H4UZG.6.75.G09.1.454.CMB.1.raw
tcagatatcgcgagcacgaccggtgctcgatttagtatagacatcaggggctcagagaggagccttagccctggactcccaaggccttccacagaggactcaccagtggaaagttggggctgagcgtgggttttccttgttgctattttagaaggtgtccaatgtgaggtgcaacgtggtggagtcggtgggggggtcttagtccagccgtgggacctccgtaagacctcctccgtgtgcacgtcctagtggacttcattgttttcggactaagttcgttagggagttcgggtcgttaccgggtccgaccgtagtacgtccgggacgggggcccgcggttgggtaggtcgggtccggaaccaacgtacgtaactaacggacgtacgacggtaaacgaaagggttaaccgtacccttaagttacgtttacggacttcggtggttaacgggcggggttaccgttaccaacgtactcctaccgaagtaacgaacccgtacgacccgtaacacctctacgtcgtcctagtactctagtagtcgactcgtacgtatacggagacgacccggacgaccgacgtacgttattacctaacgttcgtacggaacgtaccggaatccttaccgtacgtttacctctactcgtaacgtaccggtaccggtccgggaacccgttacgggtacccgtttcgggacccgttccgtaccgtaccgtcgtaaccccg

SEQ ID NO: 27300 - DNA, 772 bp, Homo sapiens
  misc_feature: GYAE6OF02GTJ7X.6.75.G09.1.454.CMB.1.raw
tcagatatcgcgagcacgaccggtgctcgatttagtatagacatcaggggctcagagaggagccttagccctggactccaaggccttccacagaggactcaccatggaattggggctgagctgggttttcctgttgctatttagaaggtgtccaatgtgaggtgcaacgtggtggagtcggtggggggggtcttagtccaggcctggggactccctaaagacctcctccgtgtcgacacgcctcgtggtacttcacttcgtttggactaagttctttgagttgggacgttcggggtccgcgtacgtacgttccggagggggccgtcgtagggtacgtggggtaccgtaccaacgtacgtaccgaaaccggtacgtagtcggaacgaaaagggacgtaacccttaagttaggtttaccggacttacggttaggtacgggggtacgggggtacccgttacccgaaccgtacgttcccgtaaccgaagggaacgaacccgtaaccgggacccgtaaaccgtacctcgtaaccgtcgtaccttccgtagtctaggaactaggtaccgtacgtacgtccgtaacggacggtaccgaccggacgtacccggacggttactacgttacgtaacttcgagggtaccaaaccgttcctacgtaccgttaccgtttccgtaactcgtaacgtaacggtaaccggttaccgggaacccggtaccggaaccgggttaacccggttcggtacccggttccgttacccttccgtcccgtaacccgg

SEQ ID NO: 27301 - DNA, 1028 bp, Homo sapiens
  misc_feature: GYAE6OF02G1Q9L.6.75.G09.1.454.CMB.1.raw
tcagatatcgcgagcacgaccggtgctcgatttagtatagacatcaggggctcagagaggagccttagccctggacctccaaggccttccacagaggactcaccatggaattggggctgagctgggttttccttgttgcttattttagaaggtgtccaatggtgaggtgactaacgtgggtggtaggttcgggtggggggggggtactttaacggtcccgagtcccggtcgggggtaccttaccccgttaaacggtaccgtacccttcccgtggttcggcgtaaccggcccttcgtaggtacttactactttccgttttgggaccgtaacgtttccgtttaggacggttgggggtccgttacggggtcccgtaccgaacgtaccgtttacccgggacgggggggtcccggtacgggtggggtacggggttacggggtaccgggacccgtaaaaccgtacggtaaacccgtaaacccgggaaccggtaagttaccggaaaccggaaaacggggaaccgttaaacccgtttaaacgtttacggtttaaccggggtaacttcggttagggtacggggtaccgggggtcccggttaccgaaccgtttacgttcccggtaaccgaaacggtaccggtaaacccgtaaccggacccgaaacctaaacgtaccctacggttccttacccgtcgttacgtcgttacgggtactaacgggaccgtaacggttacggtccgttaacgggaaccggaaccggaccccggtaaacggtaacccggaaccgggtttaccttaaaccgtttaaccgtttaacgtttaacccggtaacggttaccgtaaaaccccggtttaacttacccgtttaccccgtttaaccgtttttcccggtacgtttaacgtttaccgggttaaaccggttaaacccggttaccggggttacccgggggaaccccgtttaaaaccccggggtaccgtttcccgggggtttaccctttaccccggttaccctaccggggttaacccctaaccccggg

SEQ ID NO: 27302 - DNA, 288 bp, Homo sapiens
  misc_feature: GYAE6OF01DN9EY.25.72.G06.1.454.CMB.1.raw
  modified_base (223)..(223): a, c, t, g, unknown or other
  misc_feature (223)..(223): n is a, c, g, or t
  modified_base (227)..(288): a, c, t, g, unknown or other
  misc_feature (227)..(288): n is a, c, g, or t
tcagactgtacagtcacgaccggtgctcgatttagctacgactgcaagggggaaaggggccagggaaccctggtaaccgtctcctcaccttccaccaagggcccatcggtcttccccctggcgccctgctccaggagcacctctggggcacagcggccctgggctgcctggtcaaggactacttccgactgtacagtctgagcgggctggcaaggcgcatagngcgnnnnnnnnnnnnnnnnnnnnnnnnnnnnnnnnnnnnnnnnnnnnnnnnnnnnnnnnnnnnnn

SEQ ID NO: 27303 - DNA, 231 bp, Homo sapiens
  misc_feature: GYAE6OF01CHV7M.25.72.G06.1.454.CMB.1.raw
  modified_base (218)..(231): a, c, t, g, unknown or other
  misc_feature (218)..(231): n is a, c, g, or t
tcagactgtacagtcacgaccggtgctcgatttagctacgactgcaagggaaagggccagggaaccctggtaaccgtctcctcaccttccaccaagggcccatcggtcttcccctggcgccctgctccaggagcacctctgggggcacagcggccctgggctgcctggtcaaggactacttccactgtacagtctgagcggctggcaaggcgcatagnnnnnnnnnnnnnn

SEQ ID NO: 27304 - DNA, 235 bp, Homo sapiens
  misc_feature: GYAE6OF01BGROI.25.72.G06.1.454.CMB.1.raw
  modified_base (221)..(235): a, c, t, g, unknown or other
  misc_feature (221)..(235): n is a, c, g, or t
tcagactgtacagtcacgaccggtgctcgatttagctacgactgcaagggaaagggggccagggaaccctggtaaccgtctcctcaccttccaccaagggcccatcggtcttccccctggcgccctgctccaggagcacctctgggggcacagcggccctgggctgcctggtcaaggactacttccactgtacagtctgagcgggctggcaggcgcatagnnnnnnnnnnnnnnn

SEQ ID NO: 27305 - DNA, 229 bp, Homo sapiens
  misc_feature: GYAE6OF02GBGUH.25.72.G06.1.454.CMB.1.raw
  modified_base (118)..(118): a, c, t, g, unknown or other
  misc_feature (118)..(118): n is a, c, g, or t
  modified_base (228)..(229): a, c, t, g, unknown or other
  misc_feature (228)..(229): n is a, c, g, or t
tcagactgtacagtcacgaccggtgctcgatttagctacgactgcaagggaaagggccgaggaaccctggtaaccgtctcctcaccttccaccaaggcccatcggtcttcccctcggnggccctcgctccacggagcacctcctggggcgacagcgggccctcgggcgtgcctcggttcaaggactacttccactgtacagtctgagcgggctggcaaggcgcatagnn

SEQ ID NO: 27306 - DNA, 482 bp, Homo sapiens
  misc_feature: GYAE6OF02FVS8H.25.72.G06.1.454.CMB.1.raw
  modified_base (406)..(406): a, c, t, g, unknown or other
  misc_feature (406)..(406): n is a, c, g, or t
  modified_base (440)..(440): a, c, t, g, unknown or other
  misc_feature (440)..(440): n is a, c, g, or t
  modified_base (462)..(462): a, c, t, g, unknown or other
  misc_feature (462)..(462): n is a, c, g, or t
  modified_base (467)..(482): a, c, t, g, unknown or other
  misc_feature (467)..(482): n is a, c, g, or t
tcagactgtacagtcacgaccggtgctcgatttagctacgactgcaagggaaagggcccagtctgtgttgacgcagccgccctcagtgtctgcggccccaggacagaaggtcaccatctcctgttctggaagtagctccaacattggggataattatgtatcctggtaccagcaactcccaggaacagcccccaaactcctcattaatgacaatgataagcgaccctcagggattcctgaccgattctctggctccaagtctggcacgtcagccaccctgggcatcaccggactccagactggggacgaggccgattattactgcggaacatgggatagcggcctgaatgttttgtcttcggaactggaccaaggtcgcgtctgggtcagcccaaggccaaccccntcgtcactctcgttcccaccctcctcactgtacngtctgagcgggctggcaaggcnatagnnnnnnnnnnnnnnnn

SEQ ID NO: 27307 - DNA, 776 bp, Homo sapiens
  misc_feature: GYAE6OF02IMSVL.25.72.G06.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
  modified_base (285)..(285): a, c, t, g, unknown or other
  misc_feature (285)..(285): n is a, c, g, or t
tcagactgtacagtcacgaccggtgctcgatttagctacgactgcaagggaaagggcccagtctgtgttgacgcagccgccctcagtgtctgcggccccaggacagaaggtcaccatctcctgttctggaagtagctccaacagttgggataattatgtatcctggtaccagcaactccaggaacacgcccccaaatcctanattaatgacaatgaataagccgaccctgaggnttccngacattctctggcctaccgaagttcnggcacgtcagccaccgtggnactcaccggactccagacgtgggacgagcctagttacgttaccaggtaccggaaactaggtcgggtaattacggccgggtacctacggtaaagttttcggtttttaccgaccgtttacgggttaaaccgttacgggggaaaccctaaacggggttcccgtacccggtttcccgggttacggggtaccgtaaccggtaacccccggtaaacgggacccccgtaaaaccccccttggttacccggggtttaacaaccccggtttccgtttacccggtttacccccgcccggtttaaacccctacgtaaccgggtttaccctaaagtaccgtccgtttaacgggccgggtaacccggggtttcgtacccgggtaaccggtaaacgggtccccgacgttaaaggttacccgggtcgaccgtacgaccgtagtacgtacgtacgtacgtacgtacgtacgtacgtacgtacgtacgtacgtacgtacgtacgtacg

SEQ ID NO: 27308 - DNA, 291 bp, Homo sapiens
  misc_feature: GYAE6OF01BZJNH.1.37.D04.1.454.CMB.1.raw
  modified_base (138)..(138): a, c, t, g, unknown or other
  misc_feature (138)..(138): n is a, c, g, or t
  modified_base (259)..(291): a, c, t, g, unknown or other
  misc_feature (259)..(291): n is a, c, g, or t
tcagacgagtgcgtcacgaccggtgctcgatttagtagcatactgttggggtttgggaacagatttcatgctaaaatcaggaggatggatgctgaggatggttggggtttattgctgcccgagccaaagtacccccgntcactttcggcggagggaccaaggtgagatcaaacggactggtggctgccaccatcctgtcttcagtccttcccggccatcctgaacgcactcgtctgagcggctggacaaggcgcatagnnnnnnnnnnnnnnnnnnnnnnnnnnnnnnnnn

SEQ ID NO: 27309 - DNA, 854 bp, Homo sapiens
  misc_feature: GYAE6OF01DDFRO.1.37.D04.1.454.CMB.1.raw
tcagacgagtgcgtcacgaccggtgctcgatttagtagcatactgtcgcggggagagctgctcagttaggacccagagggaaccatcggaaaccccagcgcagcttctcttcctcctgctactctggcctccagactaccaccggaactaattgtgttagacgcagtcctccgagcctaccctgttctttcgtcctccgaaggggaagaccgccctacccttctaccgtgcgacgggccagtacgagacgtactaaccttaccggaggtaacgttccgtaacgttaccggtacccgttacggtaacccgaaggacctaaaccgtaaacccggtcggaacccgaccgggtccccgacccgtacggtcccttcccgtacttagttacgtttcgcttcgacacgtcgaacgacggtaccggtaccaacgtcgccacctaccggaacgtaccggttacggttacaaggggtcgggtacggttacggtcgggggttacgtacggggtaacctaacgggttcccttaacgacccgttaccttaaccgaccgtaccgtaaccgacgtaaccggtaaggtaccggtaacgggtacccggtaacccgtttaaaggtttacgtttttacggtaggttttaccgttaagtttagttacgttaacgtaacggtttaacttagggtaccgttgtaaccctacccgtaaccgtaccgttacccgtaccgttaacccgggaaccggtaaccggtaacgtaccgggtaaaccgttaaagggtaacctttaaacggtaaaccggttaccggttacggttacggacccgtacgtaccccgtaacttagtttcctcccgttacgtttaccccg

SEQ ID NO: 27310 - DNA, 902 bp, Homo sapiens
  misc_feature: GYAE6OF01E06M0.1.37.D04.1.454.CMB.1.raw
  modified_base (895)..(895): a, c, t, g, unknown or other
  misc_feature (895)..(895): n is a, c, g, or t
tcagacgagtgcgtcacgaccggtgctcgatttagtagcatactgttgggttggggggggtctcaggaggcagcgctctcgggacgtctccaccatggcctgggctctgctattcctccaccctcctcactcagggcacgagggtcctgggcccagtctgccctgactcagcctgcctcgtgtcgtggtctctggacagtcgatcatcgccatctctgcactaggaccagcagtggtacgtttggtagttaactaactatgtctccgtggtactacaacacgaccacccgaggaccaaaccgacccccaaatactaacttaaatttactagattcgacgtaggaacgggacggaacggtcgttaagttaacttaacgttacgtacggaccacggtaccttactaaacttaaacgttaaaccgaacggaaccgaacgaccggtaacggtaccggttaaccgggtttaccggggggtttaacccgttaaccgggggtaaacccggttacgggggaaaccccgttaaacgggttaccccgttaaccccgggtacccggttacccccggtaaccggtttacccccggaaaccccggtaaacccccggaaaccccggtaaccccccgtaaaccccccgtttaacccgttacccgggttaaccccttaaccccgttttccccgggttttaacccccccggttccccccccgggttaacccccctttcccccggttaacccccgttaacggttacccggttacccggtacccgtttacccgggtacccggggttaaaccggggtccccggggttaacccggggttaccggggaacccgggttaaaccgggggtcccggttaaacggtaaacccggttaaggggccgttaacgaccgttaacncgtgacg

SEQ ID NO: 27311 - DNA, 153 bp, Homo sapiens
  misc_feature: GYAE6OF01DBG29.1.36.D03.1.454.CMB.1.raw
  modified_base (153)..(153): a, c, t, g, unknown or other
  misc_feature (153)..(153): n is a, c, g, or t
tcagacgagtgcgtcacgaccggtgctcgatttagctgcgtcacgtcggcgggggaccaagctggagatcaaacgaactgtggctgcaccatctgtcttcatcttcccgccatctgaacgcactcgtctgagcgggctggcaaggcgcatagn

SEQ ID NO: 27312 - DNA, 153 bp, Homo sapiens
  misc_feature: GYAE6OF01EXJUW.1.36.D03.1.454.CMB.1.raw
  modified_base (153)..(153): a, c, t, g, unknown or other
  misc_feature (153)..(153): n is a, c, g, or t
tcagacgagtgcgtcacgaccggtgctcgatttagctgcgtcacgtcggcgggggaccaagctggagatcaaacgaactgtggctgcaccatctgtcttcatcttcccgccatctgaagacgacgctctgagcgggctggcaaggcgcatagn

SEQ ID NO: 27313 - DNA, 151 bp, Homo sapiens
  misc_feature: GYAE6OF01DI5IP.1.36.D03.1.454.CMB.1.raw
  modified_base (151)..(151): a, c, t, g, unknown or other
  misc_feature (151)..(151): n is a, c, g, or t
tcagacgagtgcgtcacgaccggtgctcgatttagctgcgtcacgtcggcggggaccaagctggagatcaaacgaactgtggctgcaccatctgtcttcatcttccgccatctgaacgcactcgtctgagcgggctggcaaggcgcatagn

SEQ ID NO: 27314 - DNA, 365 bp, Homo sapiens
  misc_feature: GYAE6OF01BAW3T.1.36.D03.1.454.CMB.1.raw
  modified_base (359)..(365): a, c, t, g, unknown or other
  misc_feature (359)..(365): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtcttcccctggcgccctgctccaggagcacctccgagagcacagcggccctgggctgcctggtcaaggctacttccacgcactcgtctgagcgggctggcaaggcgcatagnnnnnnn

SEQ ID NO: 27315 - DNA, 432 bp, Homo sapiens
  misc_feature: GYAE6OF01EVDI0.1.36.D03.1.454.CMB.1.raw
  modified_base (389)..(432): a, c, t, g, unknown or other
  misc_feature (389)..(432): n is a, c, g, or t
tcagacgagtgcgtcacgaccggtgctcgatttagctgcgtcacgaatctctgcacagaactttcagggctgggtcaccaatgaccagggacacgtccatcaaaacagcctctctggagcctgacccagactcgagatctgacgacacggccgtggtattacgtgtgcgagtagagggtactacataccggtctgggacgtctggggccaacggggaccacggtcaccggtctcctcagccctccaccaagggcccatcccgtcttcccccctggccgccctggctccaggagcacctccgagagcacagccggccctggggcctagccctggtcaaggactacttccacgcactcgtctcgagcgggctggcaaaggcgtcagtacgnnnnnnnnnnnnnnnnnnnnnnnnnnnnnnnnnnnnnnnnnnnn

SEQ ID NO: 27316 - DNA, 368 bp, Homo sapiens
  misc_feature: GYAE6OF01EWMR7.1.36.D03.1.454.CMB.1.raw
  modified_base (364)..(368): a, c, t, g, unknown or other
  misc_feature (364)..(368): n is a, c, g, or t
tcagacgagtgcgtcacgaccggtgctcgatttagctgcgtcacgaagtctctgcacagaactttcacggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtcttccccctggcgcccctgctccaggagcacctccgagagcacagcggccctggggctgcctggtcaaggctacttccacgcactcgtctgagcgggctggcaaggcgcatagnnnnn

SEQ ID NO: 27317 - DNA, 388 bp, Homo sapiens
  misc_feature: GYAE6OF01EWP51.1.36.D03.1.454.CMB.1.raw
  modified_base (361)..(361): a, c, t, g, unknown or other
  misc_feature (361)..(361): n is a, c, g, or t
  modified_base (367)..(388): a, c, t, g, unknown or other
  misc_feature (367)..(388): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtcgtggggccaagggaccacggtcaccgtctcctcagcctccaccaaggcccatccgtcttccccctggcgccctgctccaggagcacctccgagagcacagcggcccgttctggccctagggtccaaggactacgttccacgcactcgtactgagcgggctggcaaggcncatagnnnnnnnnnnnnnnnnnnnnnn

SEQ ID NO: 27318 - DNA, 156 bp, Homo sapiens
  misc_feature: GYAE6OF01DL3CF.1.36.D03.1.454.CMB.1.raw
  modified_base (153)..(156): a, c, t, g, unknown or other
  misc_feature (153)..(156): n is a, c, g, or t
tcagacgagtgcgtcacgaccggtgctcgatttagctgcgtcacgtcggcgggggaccaagctggagatcaaacgaactgtggctgcaccatctgtcttcatcttcccgccatctgaacgcactcgtctgagcgggctggcaaggcgcatagnnnn

SEQ ID NO: 27319 - DNA, 364 bp, Homo sapiens
  misc_feature: GYAE6OF01BI39G.1.36.D03.1.454.CMB.1.raw
  modified_base (360)..(364): a, c, t, g, unknown or other
  misc_feature (360)..(364): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctactcagcctccaccaagggcccatccgtcttcccctggcgccctgctccaggagcacctccgagagcacagcggccctgggctgcctggtcaaggactacttccacgcactcgtctgagcgggctggcaaggcgcatagnnnnn

SEQ ID NO: 27320 - DNA, 366 bp, Homo sapiens
  misc_feature: GYAE6OF01E4KII.1.36.D03.1.454.CMB.1.raw
  modified_base (362)..(366): a, c, t, g, unknown or other
  misc_feature (362)..(366): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtcttccccctggcgccctgctccaggagcacctccgagagcacagcggccctgggctgccctggtcaaggactacttccacgcactcgtctgagcgggctggcaaggcgcatagnnnnn

SEQ ID NO: 27321 - DNA, 153 bp, Homo sapiens
  misc_feature: GYAE6OF01DM1J0.1.36.D03.1.454.CMB.1.raw
  modified_base (153)..(153): a, c, t, g, unknown or other
  misc_feature (153)..(153): n is a, c, g, or t
tcagacgagtgcgtcacgaccggtgctcgatttagctgcgtcacgtcggcgggggaccaagctggagatcaaacgaactgtggctgcaccatctgtcttcatcttcccgccctcctcacgcactcgtctgagcgggctggcaaggcgcatagn

SEQ ID NO: 27322 - DNA, 665 bp, Homo sapiens
  misc_feature: GYAE6OF01B173Z.1.36.D03.1.454.CMB.1.raw
tcagacgagtgcgtcacgaccggtgctcgatttagctgcgtcacgaatctctgcacagaactttcaggctggtacaccactggaccaggacacgtccatcaaaacagcctcgtctggacgcgtgtaccagtactgagatctgacgacacggccgtgtattactcgtgccgagagagggtactacatacggtctggacgtcgtaggggccaagggccacggtcgaccgtcgtcctcagcctccgacctaagggcccagtccgtcctttccccctggccgaccccttgccgtaccgacggacgcctaccgtccggacgacgccgaccgtacggccggacccgtgggacctggtcccgtaggggtaccaaacggtacccttaaccgttccccgtacgtccgtaccgttcggtaccgttacggaacggtccgggcgttacgggaccgtaaacggtccgttaccgaagttacggagtacgtacgcgtacgttcgacgacgtaacgcgacgacgacgacgtacgtacgtacgtacgtacgtacgacgacgtacgacgtacgtacgtacgacgacgacgacgtacgtacttacgtacgtacgtacgacgtacgacgtagtacgtcgtacgacgtcgacgacacgtacgtacgtacgtacgtacgtacgtacg

SEQ ID NO: 27323 - DNA, 395 bp, Homo sapiens
  misc_feature: GYAE6OF01BE6C7.1.36.D03.1.454.CMB.1.raw
  modified_base (373)..(373): a, c, t, g, unknown or other
  misc_feature (373)..(373): n is a, c, g, or t
  modified_base (375)..(395): a, c, t, g, unknown or other
  misc_feature (375)..(395): n is a, c, g, or t
tcagacgagtgcgtcacgaccggtgctcgatttagctgcgtcacgaatctctgccacaggaactttcagggctgggtcaccatgaccagggacacgtccatcaaaacagcctctctggacgctgacccagactgagatctgacgacacggccgtgtattactgtgcgagagagggtactacatacggtctggacgtctggggcccaagggccacggtcaccgtctcctcagcctccaccaacggggcccagtccgtcttcccccctaggcgccctgcctccaggagcacctccgagagcacagcggcctgggcctgcctggtcaaggactacttcccacgcactcgtctgagcgggctggcaaggcgcatagncnnnnnnnnnnnnnnnnnnnnn

SEQ ID NO: 27324 - DNA, 433 bp, Homo sapiens
  misc_feature: GYAE6OF01C2OWN.1.36.D03.1.454.CMB.1.raw
  modified_base (394)..(433): a, c, t, g, unknown or other
  misc_feature (394)..(433): n is a, c, g, or t
tcagacgagtgcgtcacgaccggtgctcgatttagctgcgtcacgaaaggtctctgcacagaactttcagggctgggtcaccatgaccagggacgacgtccatcaaaacagccctctctggagctgaccagactgagatctggacgtacacggccgtgtattactgtgcgagagagggtactacgatacggtctggacgtctggggccaagggaccacggtcaccgtctcctcagcctccaccaagggcccagtccgttcttcccctggccgccctgcctaccacgggagaccaccctaccgaagagctaacaggccggccctggggcctggcccgttggtacaaggacttacttccacggcactcgtctgagcgggctcggcaaggcgcatgnnnnnnnnnnnnnnnnnnnnnnnnnnnnnnnnnnnnnnnn

SEQ ID NO: 27325 - DNA, 381 bp, Homo sapiens
  misc_feature: GYAE6OF01DDXST.1.36.D03.1.454.CMB.1.raw
  modified_base (279)..(279): a, c, t, g, unknown or other
  misc_feature (279)..(279): n is a, c, g, or t
  modified_base (364)..(381): a, c, t, g, unknown or other
  misc_feature (364)..(381): n is a, c, g, or t
tcagacgagtgcgtcacgaccggtgctcgatttagctgcgtcacgatctctgcacagaactttcagggctgggtcaccatgaccagggacacggtcccatcaaaacagcctctctggagctgaccagactgagatctgacgacacggccgtgtattactgtgcgagagagggtactacactacggtctggacgtctggggccaagggaccacggtcaccgtctcctcacgcctccaccaagggcccatcccgtctcccctggcgccctgctccaggacncacctccgagagcacagccggccctgggctgcctggtcaaggactactccacgcactcgtctgagcgggctggcaaggcgcatgnnnnnnnnnnnnnnnnnn

SEQ ID NO: 27326 - DNA, 429 bp, Homo sapiens
  misc_feature: GYAE6OF01BM4BI.1.36.D03.1.454.CMB.1.raw
  modified_base (107)..(107): a, c, t, g, unknown or other
  misc_feature (107)..(107): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (398)..(429): a, c, t, g, unknown or other
  misc_feature (398)..(429): n is a, c, g, or t
tcagacgagtgcgtcacgaccggtgctcgatttagctgcgtcacgaatctctgcacaggaactttcagggctgggtcaccatgaccagggacacgtccataaaaacngcctctctggagctgaccagactgagatctgacgacacggccgtgtattactgtgcgagagagggtactacagtacggtctggacgtctggggccaagggaccacggtcaccgtctcctcacgccctccaaccgaacgggccccatcccgtccttcccccgtggccgcccctgcctccgaggtcgcacctccgagagcacaggccggcccgtgggcctgccgtgggtccaagggcctacgttccacggcaccgtcgtctggacgcgggctgggacaagggcnctaanacgnnnnnnnnnnnnnnnnnnnnnnnnnnnnnnnn

SEQ ID NO: 27327 - DNA, 364 bp, Homo sapiens
  misc_feature: GYAE6OF01B2M21.1.36.D03.1.454.CMB.1.raw
  modified_base (352)..(352): a, c, t, g, unknown or other
  misc_feature (352)..(352): n is a, c, g, or t
  modified_base (357)..(364): a, c, t, g, unknown or other
  misc_feature (357)..(364): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaaggggaccacggtcaccgtctcctcagcctccaccaagggcccatccgtcttcccctggcgccctgctccaggagcacctcgagagcacagcgccctggctgcctggtcaaggctacttccacgcactcgtctgagcgggctggcaaggcgnatagnnnnnnnn

SEQ ID NO: 27328 - DNA, 424 bp, Homo sapiens
  misc_feature: GYAE6OF01BYBMX.1.36.D03.1.454.CMB.1.raw
  modified_base (182)..(182): a, c, t, g, unknown or other
  misc_feature (182)..(182): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (381)..(381): a, c, t, g, unknown or other
  misc_feature (381)..(381): n is a, c, g, or t
  modified_base (388)..(424): a, c, t, g, unknown or other
  misc_feature (388)..(424): n is a, c, g, or t
tcagacgagtgcgtcacgaccggtgctcgatttagctgcgtcacgaatcgtctgcacagaactttcagggctgggtcaccatgacccagggacacgtccatcaaaacagcctctctggagctgaccagactgaggatctgacgacacggccgtgtattacctgtcgcgagagagggtactanatacggtctgggacgtcgtggggccaaagggaccacggtcgaccgtctcctcagcctccacgaaggcccatccgtctccccngccncctgcctcaggncaccgtcgagngcacgacggccggccctggggcctggccgtggacaagggtacttaccgtccgacgcaaccgtcgtcgtggacgcgggctaggacaaggcncagtagnnnnnnnnnnnnnnnnnnnnnnnnnnnnnnnnnnnnn

SEQ ID NO: 27329 - DNA, 382 bp, Homo sapiens
  misc_feature: GYAE6OF01DR59F.1.36.D03.1.454.CMB.1.raw
  modified_base (295)..(295): a, c, t, g, unknown or other
  misc_feature (295)..(295): n is a, c, g, or t
  modified_base (368)..(382): a, c, t, g, unknown or other
  misc_feature (368)..(382): n is a, c, g, or t
tcagacgagtgcgtcacgaccggtgctcgatttagctgcgtcacgaatctctgcacagaactttcagggctgggtcaccatgaccaggggaccacgtccatcaaaacagccgtctctggagctgaccagactgagatctgacgacacggccgtgtattactgtgcgagagagggtactacatacggtctggacgtctggggccaaagggaccacggtcaccgtctcctcagcctccaccaagggcccatccgtcttccccctgcgccctgctccaggagcactccgagagcaacngcggccctgggctgcctggtcaaggactacttccacgcactcgtacctgagcgggctggcaaaggcgcatagnnnnnnnnnnnnnnn

SEQ ID NO: 27330 - DNA, 373 bp, Homo sapiens
  misc_feature: GYAE6OF01AJQ5C.1.36.D03.1.454.CMB.1.raw
  modified_base (277)..(277): a, c, t, g, unknown or other
  misc_feature (277)..(277): n is a, c, g, or t
  modified_base (367)..(373): a, c, t, g, unknown or other
  misc_feature (367)..(373): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtcttccccctggccgccctgctccaggacncacctccgagacgcacaggccggccctgggctggcctggtcaaggactacttccacgcactcgtctgacgcgggctggcacggcgcatgnnnnnnn

SEQ ID NO: 27331 - DNA, 423 bp, Homo sapiens
  misc_feature: GYAE6OF01DT89V.1.36.D03.1.454.CMB.1.raw
  modified_base (280)..(280): a, c, t, g, unknown or other
  misc_feature (280)..(280): n is a, c, g, or t
  modified_base (369)..(371): a, c, t, g, unknown or other
  misc_feature (369)..(371): n is a, c, g, or t
  modified_base (373)..(373): a, c, t, g, unknown or other
  misc_feature (373)..(373): n is a, c, g, or t
  modified_base (376)..(423): a, c, t, g, unknown or other
  misc_feature (376)..(423): n is a, c, g, or t
tcagacgagtgcgtcacgaccggtgctcgatttagctgcgtcacgaatcgtcttgcacagaactttcagggctgggtcaccatgaccagggaacacgtccatcaaaacagcctctctggagctgaccagacctgagatctgaccgacacggccgtgtattactgtgcgagaggacgggtactacatacggtctggacgtctggggccaagggaccacggtcaccgtctcctcagcctccaccaagggcccatccgtctcccctgcgccctgctccgaggncacctccgagacgcgacaggccggcctgggctgcctggtcaaggactactccacgcactcgtctgagcgggctggcaaggcgcagtagnnngnacnnnnnnnnnnnnnnnnnnnnnnnnnnnnnnnnnnnnnnnnnnnnnnnn

SEQ ID NO: 27332 - DNA, 491 bp, Homo sapiens
  misc_feature: GYAE6OF01EGTI1.1.36.D03.1.454.CMB.1.raw
  modified_base (113)..(113): a, c, t, g, unknown or other
  misc_feature (113)..(113): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
  modified_base (409)..(409): a, c, t, g, unknown or other
  misc_feature (409)..(409): n is a, c, g, or t
  modified_base (438)..(454): a, c, t, g, unknown or other
  misc_feature (438)..(454): n is a, c, g, or t
  modified_base (456)..(456): a, c, t, g, unknown or other
  misc_feature (456)..(456): n is a, c, g, or t
  modified_base (458)..(491): a, c, t, g, unknown or other
  misc_feature (458)..(491): n is a, c, g, or t
tcagacgagtgcgtcacgaccggtgctcgattttagctgcgtcacgaaagtctctgcacagaactttccagggcgtgggtcaccaatcgaccagggacacgtccatcaaaacngcctctctggagctcgaccagactgagatctgacgacacggccgtgtattactgtgcgagtagagggtactaacgaatacgggtctcggacgttcgtggggaccaaggggacccacgggtccaccggtcttcctcacgccctccaaccgaagggcccctatcccgtcttcccccnggaccncctgcctccgaggacnccaccctccgagacgccacgaggcccggcccgtggggccttggcccgtgggtccaacggtacctaccttcccacgcctactcggtctggaggccgggtntcggggacaaaggggccgactagtacgcnnnnnnnnnnnnnnnnntntnnnnnnnnnnnnnnnnnnnnnnnnnnnnnnnnnn

SEQ ID NO: 27333 - DNA, 370 bp, Homo sapiens
  misc_feature: GYAE6OF01BT0OC.1.36.D03.1.454.CMB.1.raw
  modified_base (360)..(360): a, c, t, g, unknown or other
  misc_feature (360)..(360): n is a, c, g, or t
  modified_base (366)..(370): a, c, t, g, unknown or other
  misc_feature (366)..(370): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtcttccccctggccgccctgcctccaggagccacctccgagagccacagccggccctgggctggcctggtcaaggactacttccacgcactcgtctgagcggctggcaaggcncatagnnnnn

SEQ ID NO: 27334 - DNA, 374 bp, Homo sapiens
  misc_feature: GYAE6OF01AR6NM.1.36.D03.1.454.CMB.1.raw
  modified_base (276)..(276): a, c, t, g, unknown or other
  misc_feature (276)..(276): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (362)..(374): a, c, t, g, unknown or other
  misc_feature (362)..(374): n is a, c, g, or t
tcagacgagtgcgtcacgaccggtgctcgatttagctgcgtcacgaatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtcttccccctggccgccctgctccaggngcacctcgagacgcacagccggccctgggctgccgtggtcaaggctacttccacgcactcgtctgagcggntgcaaggcncatagnnnnnnnnnnnnn

SEQ ID NO: 27335 - DNA, 380 bp, Homo sapiens
  misc_feature: GYAE6OF01EVWUG.1.36.D03.1.454.CMB.1.raw
  modified_base (106)..(106): a, c, t, g, unknown or other
  misc_feature (106)..(106): n is a, c, g, or t
  modified_base (362)..(362): a, c, t, g, unknown or other
  misc_feature (362)..(362): n is a, c, g, or t
  modified_base (364)..(380): a, c, t, g, unknown or other
  misc_feature (364)..(380): n is a, c, g, or t
tcagacgagtgcgtcacgaccggtgctcgatttagctgcgtcacgaatctctgcacagaactttcagggctgggtcaccatgaccagggacacgtccatcaaaacngcctctctggagctgaccagactgagatctgacgacacggccgtgtattactgtgcgagagagggtactacatacggtctggacgtctggggccaagggccacggtcaccgtctcctcagcctccaccaagggcccatcccgtcttccccctggccgccctgcctccaggacgcacctcgagagcacagcggccctgggctgcctggcaaggctacttccacgcactcgtctgagcgggctggcaaggcgcatagncnnnnnnnnnnnnnnnnn

SEQ ID NO: 27336 - DNA, 397 bp, Homo sapiens
  misc_feature: GYAE6OF01BUM3A.1.36.D03.1.454.CMB.1.raw
  modified_base (372)..(397): a, c, t, g, unknown or other
  misc_feature (372)..(397): n is a, c, g, or t
tcagacgagtgcgtcacgaccggtgctcgatttagctgcgtcacgaagtctctgcacagaactttcagggctgggtcaccatcgaccagggacacgtccatcaaaacagcctctctggagctgaccagactgagatctgacgacacggccgtgtattacctgtgcgagagagggtactacatacggtctggacgtctggggccaagggaccacggtcaccgtctcctcagcctccaccaagggcccatccgtcttccccctggccgcccctgcctccaggacgccacctccgagagcacagccggccctgggctgcctggtcaaggctactccacgcactcgtctggacgcgggctggcaaggcgcatacgnnnnnnnnnnnnnnnnnnnnnnnnnn

SEQ ID NO: 27337 - DNA, 456 bp, Homo sapiens
  misc_feature: GYAE6OF01CPG2A.1.36.D03.1.454.CMB.1.raw
  modified_base (106)..(106): a, c, t, g, unknown or other
  misc_feature (106)..(106): n is a, c, g, or t
  modified_base (406)..(406): a, c, t, g, unknown or other
  misc_feature (406)..(406): n is a, c, g, or t
  modified_base (409)..(421): a, c, t, g, unknown or other
  misc_feature (409)..(421): n is a, c, g, or t
  modified_base (423)..(423): a, c, t, g, unknown or other
  misc_feature (423)..(423): n is a, c, g, or t
  modified_base (425)..(456): a, c, t, g, unknown or other
  misc_feature (425)..(456): n is a, c, g, or t
tcagacgagtgcgtcacgaccggtgctcgatttagctgcgtcacgaatctctgcacagaactttcagggctgggtcaccatgaccagggacacgtccatcaaaacngcctctctggagctgaccagactgagatctgacgacacggccgtgtattactgtgcgagagagggtactacgatacggtctgggacgtcgtggggccaagggccacggtcaccgtctcctcagccctccaccgaacgggcccatccgtccttcccctggccgccctgcctccgaggacgccacctcgagacgcaccgaggcccggaccctgggcctcgcccgttggtaccaaggtactaccttccacgtcaacctcgtacctggacggtccgggctcgggacgaagggccgagaatcgancgnnnnnnnnnnnnngngnnnnnnnnnnnnnnnnnnnnnnnnnnnnnnnn

SEQ ID NO: 27338 - DNA, 463 bp, Homo sapiens
  misc_feature: GYAE6OF01D9KC0.1.36.D03.1.454.CMB.1.raw
  modified_base (291)..(291): a, c, t, g, unknown or other
  misc_feature (291)..(291): n is a, c, g, or t
  modified_base (437)..(438): a, c, t, g, unknown or other
  misc_feature (437)..(438): n is a, c, g, or t
  modified_base (440)..(463): a, c, t, g, unknown or other
  misc_feature (440)..(463): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagaggagggtactacagtacggtctgggacgtcgtggggaccaagggaccacggtcaccgtctcctcagccctccaccgaacgggcccatcccgtccttcccccgtggcccgccctgcctccgaggacnccaccctcgagacgccaccgacgccggccccgtgggcctcggcccgtgggtaccaaacgggtaccttaccgttcccaacggtccaaccgttcgttccgaggacgggtccggggacgtcgggacgaacgggcccgagtaagtaggcnngnnnnnnnnnnnnnnnnnnnnnnnn

SEQ ID NO: 27339 - DNA, 387 bp, Homo sapiens
  misc_feature: GYAE6OF01ET240.1.36.D03.1.454.CMB.1.raw
  modified_base (349)..(349): a, c, t, g, unknown or other
  misc_feature (349)..(349): n is a, c, g, or t
  modified_base (374)..(387): a, c, t, g, unknown or other
  misc_feature (374)..(387): n is a, c, g, or t
tcagacgagtgcgtcacgaccggtgctcgatttagctgcgtcacgatcgtcgtgcacagaactttcagggctgggtcaccatgaccagggacacgtccatcaaaacagcctctctggagctgaccagactgagagtctgacgacacggccgtgtattactgtgcgagagagggtactacatacggtctggacgtctggggccaagggaccacggtcaccgtctcctcagcctccaccaagggcccatccgtcttccccctggccgccctgcctccaggacgccacctccgagacgcactagccggccctggggcctgccctggtcaaggactacttccacgcactcgtntgagcgggctggcaaggcgcatagnnnnnnnnnnnnnn

SEQ ID NO: 27340 - DNA, 152 bp, Homo sapiens
  misc_feature: GYAE6OF01DUR18.1.36.D03.1.454.CMB.1.raw
tcagacgagtgcgtcacgaccggtgctcgatttagctgcgtcacgtcggcgggggaccaagctggagatcaaacgaactgtggctgcaccatctgtcttcatcttcccgccatctgaagacgacgctctgagcgggctggcaaggcgcatag

SEQ ID NO: 27341 - DNA, 406 bp, Homo sapiens
  misc_feature: GYAE6OF01BQALF.1.36.D03.1.454.CMB.1.raw
  modified_base (389)..(406): a, c, t, g, unknown or other
  misc_feature (389)..(406): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtcgtggggccaaggggaccacggtcacccgtctcccgtcacgccctaccaccgaaaggggccccatcccgtccttccccccgtggccgccctgctcccagggacgccacctccgagacgcacagccggccctgggctgcctggtcaaggactacttccacgcactcgtctggagcgggctggacaagggccacatacgnnnnnnnnnnnnnnnnnn

SEQ ID NO: 27342 - DNA, 156 bp, Homo sapiens; identical to SEQ ID NO: 27318
  misc_feature: GYAE6OF01E12CZ.1.36.D03.1.454.CMB.1.raw
  modified_base (153)..(156): a, c, t, g, unknown or other
  misc_feature (153)..(156): n is a, c, g, or t

SEQ ID NO: 27343 - DNA, 495 bp, Homo sapiens
  misc_feature: GYAE6OF01BH9UA.1.36.D03.1.454.CMB.1.raw
  modified_base (459)..(495): a, c, t, g, unknown or other
  misc_feature (459)..(495): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctgggacgtcgtgggggccaaaggggacccacgggtcacccggtctccctcagccctccaaccgaacgggcccatcccgtccttccccctggccgcccctgcctccgagggcgccaacccgtccggagacggcctaaccgacggccggccccgttggggccttcggcccgttgggtaccgaaagggtacccttaccttcccgaaccggcctaaccgttccggttccgtaggacggggccgggtcgtcgggacaacggggccacgtagtacggctgnnnnnnnnnnnnnnnnnnnnnnnnnnnnnnnnnnnnn

SEQ ID NO: 27344 - DNA, 368 bp, Homo sapiens
  misc_feature: GYAE6OF01BBHMP.1.36.D03.1.454.CMB.1.raw
  modified_base (364)..(368): a, c, t, g, unknown or other
  misc_feature (364)..(368): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtcgtggggccaagggaccacggtcaccgtctcctcagcctccaccaagggcccatccgtccttcccctggcgccctgctccaggagcacctccgagagccacagccggccctgggctgcctggtcaaggactacttccacgcactcgtctgagcgggctggcaaggcgcatagnnnnn

SEQ ID NO: 27345 - DNA, 375 bp, Homo sapiens
  misc_feature: GYAE6OF01EGNA2.1.36.D03.1.454.CMB.1.raw
  modified_base (363)..(375): a, c, t, g, unknown or other
  misc_feature (363)..(375): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtcttcccctggcgccctgctccaggagcacctccgagagccacagcggccctggggcctgcctggtcaaggactacttccacgcactcgtctgagcgggctggcaaggcgcatagnnnnnnnnnnnnn

SEQ ID NO: 27346 - DNA, 431 bp, Homo sapiens
  misc_feature: GYAE6OF01BNNBM.1.36.D03.1.454.CMB.1.raw
  modified_base (106)..(106): a, c, t, g, unknown or other
  misc_feature (106)..(106): n is a, c, g, or t
  modified_base (111)..(111): a, c, t, g, unknown or other
  misc_feature (111)..(111): n is a, c, g, or t
  modified_base (404)..(404): a, c, t, g, unknown or other
  misc_feature (404)..(404): n is a, c, g, or t
  modified_base (410)..(431): a, c, t, g, unknown or other
  misc_feature (410)..(431): n is a, c, g, or t
tcagacgagtgcgtcacgaccggtgctcgatttagctgcgtcacgagtctctgcacagaactttcagggctgggtcaccatgaccagggacacgtccatcaaaacngcctntctggagctgaccagactgagatctgacgacacggcctgtattactgtgcgagaggagggtactacatacggtctggacgtcgtggggaccaaggggaccctacgggtccaacccggttctcccttcaacgtccctcccaaccaaacggggccccaattccccggtccttcccccgtggcccgtccctggtcctcccgaaggacgcctaccgtcgagacgcaccgaggccggcctgggctgcctggtcaaggtactacttccgacgcactcgctgagcggctggactaaggcnagtagnnnnnnnnnnnnnnnnnnnnnn

SEQ ID NO: 27347 - DNA, 455 bp, Homo sapiens
  misc_feature: GYAE6OF01DODUZ.1.36.D03.1.454.CMB.1.raw
  modified_base (179)..(179): a, c, t, g, unknown or other
  misc_feature (179)..(179): n is a, c, g, or t
  modified_base (229)..(229): a, c, t, g, unknown or other
  misc_feature (229)..(229): n is a, c, g, or t
  modified_base (318)..(318): a, c, t, g, unknown or other
  misc_feature (318)..(318): n is a, c, g, or t
  modified_base (428)..(455): a, c, t, g, unknown or other
  misc_feature (428)..(455): n is a, c, g, or t
tcagacgagtgcgtcacgaccggtgctcgatttagctgcgtcacgaatctctgcacagaactttcgagggctgggtcaccatgaccagggacacgtccatacaaaacagcctctctggagctgaccagactgagatcgtgacgacacggccgtgtattactgtgcgagagaggtactanataggtctggacgtcgtggggaccgaagggaccacggtccaccgtctccncacgcctccaccgaacgggcccactccgtccttccccgtggcccgccccgttgcctccgaggacgccaaccgtcccgagacgccgaacnggtcccggcccgtggggcctcggaccgttggtaccgaacggtaccttacctaccgaccgctaccgtccgtgtcggacggccggggtcacgggacaagggcgactaagtgnnnnnnnnnnnnnnnnnnnnnnnnnnnn

SEQ ID NO: 27348 - DNA, 570 bp, Homo sapiens
  misc_feature: GYAE6OF01ERB2Y.1.36.D03.1.454.CMB.1.raw
  modified_base (289)..(289): a, c, t, g, unknown or other
  misc_feature (289)..(289): n is a, c, g, or t
  modified_base (429)..(429): a, c, t, g, unknown or other
  misc_feature (429)..(429): n is a, c, g, or t
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
  modified_base (517)..(522): a, c, t, g, unknown or other
  misc_feature (517)..(522): n is a, c, g, or t
  modified_base (524)..(526): a, c, t, g, unknown or other
  misc_feature (524)..(526): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (536)..(537): a, c, t, g, unknown or other
  misc_feature (536)..(537): n is a, c, g, or t
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (568)..(569): a, c, t, g, unknown or other
  misc_feature (568)..(569): n is a, c, g, or t
tcagacgagtgcgtcacgaccggtgctcgatttagctgcgtcacgaatcgtctgcacacgtaacttttcgagggctgggtccaccgatgaccagggacacgtccagtcaaaacagcctcgtctggacgctgaccagactggagatctgacgacacggccgtgtattacgtgtgacgagagagggtactacagtacggtcgtggacgtcgtggggccaagggaccacggtccaccgtctcctacacgcctccgaccgaaaggggccctagtccccgtacctttcccccgngggtaccgcccttacgtcgtaccaacggacgccaacccgtccggaagtacggccaacggacggcccgggtcccgtgggggtcctaggcccgttacgggtccgaaacgggtacttaccttccgacggtcctaccgtccgtnttacggacggccgggtactcgggaccaacgggccnctagtacgcacnacngcttgcncgnactcgcacgnacgcgcgcncgacngcgnnnnnncnnncgcncncgcnncncgngngcnacncncacncncncncncncnnc

SEQ ID NO: 27349 - DNA, 179 bp, Homo sapiens
  misc_feature: GYAE6OF01E5QWQ.1.36.D03.1.454.CMB.1.raw
  modified_base (150)..(150): a, c, t, g, unknown or other
  misc_feature (150)..(150): n is a, c, g, or t
  modified_base (156)..(179): a, c, t, g, unknown or other
  misc_feature (156)..(179): n is a, c, g, or t
tcagacgagtgcgtcacgaccggtgctcgatttagctgcgtcacgtcggcggggggaccaagctggagatcaaacgaactgtggctgcaccatctgtcttcatcttcccgcatctagaacgcactcgtctggagcgggctggcaagggcncatagnnnnnnnnnnnnnnnnnnnnnnnn

SEQ ID NO: 27350 - DNA, 365 bp, Homo sapiens
  misc_feature: GYAE6OF02FXTEX.1.36.D03.1.454.CMB.1.raw
  modified_base (360)..(365): a, c, t, g, unknown or other
  misc_feature (360)..(365): n is a, c, g, or t
tcagacgagtgcgtcacgaccggtgctcgatttagctgcgtcacgaatctctgcacagaactttcagggctgggtcaccatgaccagggacacgtccatcaaacagcctctctggagctgaccagactgagatctgacgacacggccgtgtattactgtgcgagagagggtactacatacggtctggacgtctggggccaaggggaccacggtcaccgtctcctcagcctccaccaagggcccatccgtcttcccctggcgccctgctccaggagcacctccgagagcacagcggccctgggctgcctggtcaaggctacttccacgcactcgtctgagcgggctggcaaggcgcatagnnnnnn

SEQ ID NO: 27351 - DNA, 152 bp, Homo sapiens
  misc_feature: GYAE6OF02H5GUE.1.36.D03.1.454.CMB.1.raw
  modified_base (152)..(152): a, c, t, g, unknown or other
  misc_feature (152)..(152): n is a, c, g, or t
tcagacgagtgcgtcacgaccggtgctcgatttagctgcgtcacgtcggcggggaccaagctggagatcaaacgaactgtggctgcaccatctgtcttcatcttcccgccatctgaagacgacgctctgagcgggctggcaaggcgcatagn

SEQ ID NO: 27352 - DNA, 400 bp, Homo sapiens
  misc_feature: GYAE6OF02I9R1B.1.36.D03.1.454.CMB.1.raw
  modified_base (362)..(366): a, c, t, g, unknown or other
  misc_feature (362)..(366): n is a, c, g, or t
  modified_base (369)..(400): a, c, t, g, unknown or other
  misc_feature (369)..(400): n is a, c, g, or t
tcagacgagtgcgtcacgaccggtgctcgatttagctgcgtcacgaatctctgcacagaactttcagggctgggtcaccgatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtctcccctggcgccctgctccaggagcacctccgagagcacagcggccctgggctgcctggtcaagggactacttccacgcactcgtctgagcgggctggcaaggcgcatagnnnnngannnnnnnnnnnnnnnnnnnnnnnnnnnnnnnn

SEQ ID NO: 27353 - DNA, 486 bp, Homo sapiens
  misc_feature: GYAE6OF02G74G5.1.36.D03.1.454.CMB.1.raw
  modified_base (472)..(486): a, c, t, g, unknown or other
  misc_feature (472)..(486): n is a, c, g, or t
tcagacgagtgcgtcacgaccggtgctcgatttagctgcgtcacgaattctctggctacgagaactttcagggctcgggtcgaccattgtaccaacgggaccacgtaaccagtccaaaaccagccctacggtcctgggacgactaggaacctagacctgaggatttctgtaccgacacggcccgtgtattactgtcggccgagtagttagggtactacagtacggtactggacgttcgtgggccaagggccgaccggtcgaccgtctccctgacgcccttccaccacgggccccattcccgtccttaccccgtcggcgccccgtgtcccctccgacggaccgtcaccctcccgaggagccacctagccggggccctgggctcggccctgggtccaaggacctacgttccaacggcctaccttccgtctcgacgccgggtctgggacgaacggggccgtcgactaaggcacgnnnnnnnnnnnnnnn

SEQ ID NO: 27354 - DNA, 416 bp, Homo sapiens
  misc_feature: GYAE6OF02HDCU2.1.36.D03.1.454.CMB.1.raw
  modified_base (378)..(416): a, c, t, g, unknown or other
  misc_feature (378)..(416): n is a, c, g, or t
tcagacgagtgcgtcacgaccggtgctcgatttagctgcgtcacgaatctctgcacagaactttcagggctgggtcaccgatgaccaggggaccacgcccatcaaaacaggcctctctggagctgaccagactgagatctgacgacacggccgtgtattactgtgccgagagacgggtacctacatacggtctggacgtctggggccaagggaccacggtcaccgtctcctcagcccgtccaaccaagggccccaatccgtcttcccctggccgtaccctgctccaggagccacccgtccgacgagcacagcggccctgggctgcctggtcaaggctacttccacgcactcgtctgagcggctggcaaggcgcatagnnnnnnnnnnnnnnnnnnnnnnnnnnnnnnnnnnnnnnn

SEQ ID NO: 27355 - DNA, 171 bp, Homo sapiens
  misc_feature: GYAE6OF02G2534.1.36.D03.1.454.CMB.1.raw
  modified_base (155)..(171): a, c, t, g, unknown or other
  misc_feature (155)..(171): n is a, c, g, or t
tcagacgagtgcgtcacgaccggtgctcgatttagctgcgtcacgtcggcgggggaaccaagcctggagatcaaacgaactgtggctgcaccatctgtcttcatcttcccgccatctgaagacgacgctctgagcgggctggcaaggcgcatagnnnnnnnnnnnnnnnnn

SEQ ID NO: 27356 - DNA, 375 bp, Homo sapiens
  misc_feature: GYAE6OF02JCK08.1.36.D03.1.454.CMB.1.raw
  modified_base (362)..(375): a, c, t, g, unknown or other
  misc_feature (362)..(375): n is a, c, g, or t
tcagacgagtgcgtcacgaccggtgctcgatttagctgcgtcacgaagtctctgcacagaactttcagggctgggtcaccatgaccagggacacgtccatcaaaacagcctctctggagctgaccagactgagatctgacgacacggtccgtgtattactgtgcgagagagggtactacatacggtctggacgtctggggccaagggaccacggtcaccgtctacctcagcctccaccaagggcccatccgtctcccctggcgccctgctccaggagcacctccgagagcacagcggccctgggctgcctggtcaaggctacttccacgcactcgtctgagcgggctggcaaggcgcatagnnnnnnnnnnnnnn

SEQ ID NO: 27357 - DNA, 377 bp, Homo sapiens
  misc_feature: GYAE6OF02G6YY0.1.36.D03.1.454.CMB.1.raw
  modified_base (363)..(377): a, c, t, g, unknown or other
  misc_feature (363)..(377): n is a, c, g, or t
tcagacgagtgcgtcacgaccggtgctcgatttagctgcgtcacgaatctctgcacagaactttcagggctgggtcaccatggacccagggacacgtccatcgaaaacagcctctctggagctgaccagactgagatctgacgacacggccgtgtacttactgtgcgagagagggtactacatacggtctggacgtctggggccaagggaccacggtcaccgtctcctcagcctccaccaagggcccatccgtcttcccctggcgccctgctccagagcacctccgagagcacagcggccctgggctgcctggtcaaggctacttccacgcactcgtctgagcgggctggcaaggcgcatagnnnnnnnnnnnnnnn

SEQ ID NO: 27358 - DNA, 367 bp, Homo sapiens
  misc_feature: GYAE6OF02HFKIH.1.36.D03.1.454.CMB.1.raw
  modified_base (363)..(367): a, c, t, g, unknown or other
  misc_feature (363)..(367): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaacgggcccactccgtccttcccctcggcgccctgctccaggagcacctccgagagcacagcggccctgggctgcctggtcaaggactacttccaccactcgtctgagcgggctggcaaggcgcatagnnnnn

SEQ ID NO: 27359 - DNA, 416 bp, Homo sapiens
  misc_feature: GYAE6OF02F9EPG.1.36.D03.1.454.CMB.1.raw
  modified_base (281)..(281): a, c, t, g, unknown or other
  misc_feature (281)..(281): n is a, c, g, or t
  modified_base (368)..(373): a, c, t, g, unknown or other
  misc_feature (368)..(373): n is a, c, g, or t
  modified_base (376)..(384): a, c, t, g, unknown or other
  misc_feature (376)..(384): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (390)..(416): a, c, t, g, unknown or other
  misc_feature (390)..(416): n is a, c, g, or t
tcagacgagtgcgtcacgaccggtgctcgatttagctgcgtcacgaatctctgcacagaactttcagggctgggtcaccatgaccagggacacgtccatcaaaacagccctctctggagctgaccagactgagatctgacgacacgggccgtgtattactgtgcgagaggagggtactacatacggtctggacgtctgggggccaagggaccacgggtcaccgtctcctcagcctccaccgaagggcccatccgtcttcccctggcgccctgctccaggancacctccgagagcacacgcggccctgggctgcctggtcaaggctacttccaccactcgtctgagcggggctggcgaaggcgcatagnnnnnncgnnnnnnnnngngngnnnnnnnnnnnnnnnnnnnnnnnnnnn

SEQ ID NO: 27360 - DNA, 156 bp, Homo sapiens; identical to SEQ ID NO: 27318
  misc_feature: GYAE6OF02HPUOD.1.36.D03.1.454.CMB.1.raw
  modified_base (153)..(156): a, c, t, g, unknown or other
  misc_feature (153)..(156): n is a, c, g, or t

SEQ ID NO: 27361 - DNA, 700 bp, Homo sapiens
  misc_feature: GYAE6OF02G4WVG.1.36.D03.1.454.CMB.1.raw
  modified_base (542)..(542): a, c, t, g, unknown or other
  misc_feature (542)..(542): n is a, c, g, or t
tcagacgagtgcgtcacgaccggtgctcgatttagctgcgtcacgtaagtctctgcacgtacgaacttttcagggcttagggtcaccatgaccagggacacgtccatcaaaacgagcctctcggtggagcgtcgaccacgacgtgacgatctgacgacacggccgtgtattactggttcgccgagaagaagggtactacgaatacggtctggacggtcgtcggggaccgaacgggacccacgggtcaaccgggttcctccgtacgacggccgtaccaaccgaaacgggccccaatccggttcctttccccgtggccggacccctgaccttaccaacggtacgccaaccgtccgaacggaacggccgtaaccaacggccggccccgttcggggaccgttacggacccgttcgggtaaccgaaaacgggtaaccttaaccgtttcccgaacgttccgaaccgttaaccggttaccgttacggaacgggtcccgggggacgttacggggaaccgaaaggggccggaccgtaaacggttaacggtntagtacgtagcgtagacgagacgacgtagacgtgacgtgtactcgtcgtacgtagtagtagtgtacgtacgtcggacgacgacgtcgtcgcgtctctcacgcgccgacgacgacgtcgtcgtccgtccgtccgccgccgcgcgtacgcgcgcgcgacg

SEQ ID NO: 27362 - DNA, 373 bp, Homo sapiens
  misc_feature: GYAE6OF02HX4AU.1.36.D03.1.454.CMB.1.raw
  modified_base (366)..(373): a, c, t, g, unknown or other
  misc_feature (366)..(373): n is a, c, g, or t
tcagacgagtgcgtcacgaccggtgctcgatttagctgcgtcacgaagtctctgcacagaactttccacgggctgggtcaccatgaccagggacacggtccatcaaaacgagcctctctggagctgaccagactgagatctgacgacacggccgtgtattactgtgcgagagagggtactacatacggtctggacgtctggggccaagggaccacggtcaccgtctcctcagcctccaccaagggcccatccgtcttcccctggccgccctgctccaggagcacctccgagagcacagcggccctgggctgcctggtcaaggactactccacgcactcgtctgagcgggctggcaaggcgcatagnnnnnnnn

SEQ ID NO: 27363 - DNA, 374 bp, Homo sapiens
  misc_feature: GYAE6OF02IM9KS.1.36.D03.1.454.CMB.1.raw
  modified_base (361)..(374): a, c, t, g, unknown or other
  misc_feature (361)..(374): n is a, c, g, or t
tcagacgagtgcgtcacgaccggtgctcgatttagctgcgtcacgaatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaaggggaccacggtcaccgtctcctcagcctccaccaagggcccatccgtcttcccctggcgccctgctccaggagcacctccgagagcacagcggccctgggctgcctggtcaaggctacttccacgcactcgtctgagcgggctggcaaggcgcatagnnnnnnnnnnnnnn

SEQ ID NO: 27364 - DNA, 472 bp, Homo sapiens
  misc_feature: GYAE6OF02G7B9Q.1.36.D03.1.454.CMB.1.raw
  modified_base (426)..(428): a, c, t, g, unknown or other
  misc_feature (426)..(428): n is a, c, g, or t
  modified_base (430)..(443): a, c, t, g, unknown or other
  misc_feature (430)..(443): n is a, c, g, or t
  modified_base (445)..(472): a, c, t, g, unknown or other
  misc_feature (445)..(472): n is a, c, g, or t
tcagacgagtgcgtcacgaccggtgctcgatttagctgcgtcacgaagtacgtctgcacagaacgttttcacgggctggggtccaccagtgaccccagggaccacgtccattcaaaacctgccctctctggagctgacccagactcgacgatactgacgacacggccgtgtattaccgtgtcgcgagtaggagggtacctacgatacgggtctcggaccgttctggggccaagggacccacggtcaccgtctcctcgagccctccaccaagggccccagtccccgtaccttccccccgtaggccgccccctggccttccccgaagggacgccaccctccgagagcacaggccgccctgggacctggccctggtcaaggaccttacctccacgcgtactcgtctgaggcgggctggcaagcgcatgnnncnnnnnnnnnnnnnntnnnnnnnnnnnnnnnnnnnnnnnnnnnn

SEQ ID NO: 27365 - DNA, 466 bp, Homo sapiens
  misc_feature: GYAE6OF02G96OI.1.36.D03.1.454.CMB.1.raw
  modified_base (120)..(120): a, c, t, g, unknown or other
  misc_feature (120)..(120): n is a, c, g, or t
  modified_base (415)..(415): a, c, t, g, unknown or other
  misc_feature (415)..(415): n is a, c, g, or t
  modified_base (418)..(466): a, c, t, g, unknown or other
  misc_feature (418)..(466): n is a, c, g, or t
tcagacgagtgcgtcacgaccggtgctcgatttagctgcgtcacgaatctctgcacagaacctttcagggctgggtcaccactgaccagggacacgtccatcaaaacagcctctctggancctgaccagactgagatctgacgacacggccgtgtattactgtcgcgagtaggagggtacctaacgaatacggtctcggacgtctggggccaaggggcccaggtcaccgtctcctcagccctccaccaacgggcccatcccgtccttaccccctgggccgccctgcctccgaggacgccacctcccgagagcacagccggcccctagggcctcgcccgtggtccaaacggacctaccttcccaacggtccaactcggtcctggacggcggggctgggaccaaagggccgcatagnacnnnnnnnnnnnnnnnnnnnnnnnnnnnnnnnnnnnnnnnnnnnnnnnnn

SEQ ID NO: 27366 - DNA, 521 bp, Homo sapiens
  misc_feature: GYAE6OF02FP86R.1.36.D03.1.454.CMB.1.raw
  modified_base (399)..(399): a, c, t, g, unknown or other
  misc_feature (399)..(399): n is a, c, g, or t
  modified_base (401)..(402): a, c, t, g, unknown or other
  misc_feature (401)..(402): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (460)..(460): a, c, t, g, unknown or other
  misc_feature (460)..(460): n is a, c, g, or t
tcagacgagtgcgtcacgaccggtgctcgatttagctgcgtcacgaagtcgggtctgcacagaactttccagggctggggtcaccatcgaccaggggaccacggtccatcaaaacagtcctctcctggagctcgaccgagactggagagtcctgacgacaccggccgtgtattactcgtgccgacgagagggtacgtacactacgggtcgtaggacgtctcggggccaagggccacggtcaccgtctccgtacagcctccaccgaagggcccatccgtcttcccctggcgccctgcctccgacgagccacctccgacacgcactagcggccctgggcctgcctggtcaacggacttacttccacgcactcgtctgagcggctggcaaggcgcagtacgncnncncgncacnctagngcgcgnanatatntntatntnanananananagtagtgtgtcgngcgcgcgtcgcgacgtacgtcgcgcgacgacgcgtcgtcgcgtcgtcgtctcgtccgtctc

SEQ ID NO: 27367 - DNA, 440 bp, Homo sapiens
  misc_feature: GYAE6OF02HN4LI.1.36.D03.1.454.CMB.1.raw
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (426)..(440): a, c, t, g, unknown or other
  misc_feature (426)..(440): n is a, c, g, or t
tcagacgagtgcgtcacgaccggtgctcgatttagctgcgtcacgaatctctgcacagaactttcagggctgggtcaccatgaccagggacacgtccatcaaaacagcctctctcggagctgaccagactgagatctgacgacacggccgtgtattactgtgcgagagagggtactacatacggtctcggacgtcgtggggccaagggaccacggtcaccgtctcctcagcctccacaagggcccatccgtctcccctgccgcctgacctcagggacncgtaccncccgtagagccaaccacggtccggccccgtggggcttcgcccgtttggaccgtaaagggaccttaccgttccaaccggcccgtaactccggttctggaccggtcgggcctcgggcaaacggggcnctaagacgnancntannnnnnnnnnnnnnn

SEQ ID NO: 27368 - DNA, 453 bp, Homo sapiens
  misc_feature: GYAE6OF02GKT2O.1.36.D03.1.454.CMB.1.raw
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (407)..(453): a, c, t, g, unknown or other
  misc_feature (407)..(453): n is a, c, g, or t
tcagacgagtgcgtcacgaccggtgctcgatttagctgcgtcacgaatacctctcgcacgagaactttccagggctgggtcaccatgaccagggacacgtccatcaaaacagcctctcttggagctgaccagactgagatctgacgacacggccgtgtattacgtgtgcgagagagggtctacatacggtctgggacgtcgtggggccaaggggacctacgggtcaccggtctcctcagcctccacctaagggcccatccgtcttcccctggcgccctgctccgaggacgcctaccctccggagacgcaacgagccgggcccgtggggacctggccctgggtccaagggtacttaacttccacggcactcgtctgacgcgggctggcgaaggcgacatagcngtncnnnnnnnnnnnnnnnnnnnnnnnnnnnnnnnnnnnnnnnnnnnnnnn

SEQ ID NO: 27369 - DNA, 370 bp, Homo sapiens
  misc_feature: GYAE6OF02GD32R.1.36.D03.1.454.CMB.1.raw
  modified_base (364)..(370): a, c, t, g, unknown or other
  misc_feature (364)..(370): n is a, c, g, or t
tcagacgagtgcgtcacgaccggtgctcgatttagctgcgtcacgaatctctgcaccagaactttcagggctgggtcaccatgaccaggggaccacgtccatcaaaacagccgtctctggagctgaccagactgagatctgacgacacggccgtgtattactgtgcgagagagggtactacatacggtctggacgtctggggccaagggaccacggtcaccgtctcctcagcctccaccaagggcccatccgtcttcccctgcgccctgctccaggagcacctccgagagcacagcggccctgggctgcctggtcaaggctacttccacgtcactcgtctgagcgggctggcaaggcgcatagnnnnnnn

SEQ ID NO: 27370 - DNA, 437 bp, Homo sapiens
  misc_feature: GYAE6OF02GONQF.1.36.D03.1.454.CMB.1.raw
  modified_base (297)..(297): a, c, t, g, unknown or other
  misc_feature (297)..(297): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (392)..(395): a, c, t, g, unknown or other
  misc_feature (392)..(395): n is a, c, g, or t
  modified_base (397)..(437): a, c, t, g, unknown or other
  misc_feature (397)..(437): n is a, c, g, or t
tcagacgagtgcgtcacgaccggtgctcgatttagctgcgtcacgaatctctgcacagaactttcagggctgggtcgaccatgaccagggacacggtccatcaaaaacagcctctctggagctgaccagactgagatctgacgacacggccgtgtattactgtgcgagagaggggtactacgatacggtctggacgtctggggccaagggaccacggtcaccgtctcctcagcctccaccaagggccccatccgtccttcccctggccgcccctgactccaggacgcacctccgagngcacagcggccctgggctgcctggtcaaggacctacttccacgcactcgtctgagcgggctggcaagggcgacaagtaggctgcgntncgancgnnnngnnnnnnnnnnnnnnnnnnnnnnnnnnnnnnnnnnnnnnnnn

SEQ ID NO: 27371 - DNA, 409 bp, Homo sapiens
  misc_feature: GYAE6OF02GEY03.1.36.D03.1.454.CMB.1.raw
  modified_base (291)..(291): a, c, t, g, unknown or other
  misc_feature (291)..(291): n is a, c, g, or t
  modified_base (370)..(409): a, c, t, g, unknown or other
  misc_feature (370)..(409): n is a, c, g, or t
tcagacgagtgcgtcacgaccggtgctcgatttagctgcgtcacgtaaggtctctgcacagaactttcgagggctgggtcaccagtgaccagggacgaccgtccatcaaaacagccgtctcctggagctgaccagactgagatctgacgacacggccgtgtattactgtcgcgagagagggtacctaccagtacggtctggacgtctggggccaagggaccaggtcaccgtctcctcacgcctccgaccaagggcccatccgtcttcccctggcgcccctgtctccaggancacctccgagagcacacgcggcctgggctgcctggtcaggctactcagcatcgctgagcgggctggcaaggcgcagtgnnnnnnnnnnnnnnnnnnnnnnnnnnnnnnnnnnnnnnnn

SEQ ID NO: 27372 - DNA, 370 bp, Homo sapiens
  misc_feature: GYAE6OF02FP3SQ.1.36.D03.1.454.CMB.1.raw
  modified_base (360)..(370): a, c, t, g, unknown or other
  misc_feature (360)..(370): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtcttcccctggcgccctgctccaggagcacctccgagagcacagcggccctgggctgcctggtcaaggactacttccacgcactcgtctgagcgggctggcaaggcgcatagnnnnnnnnnnn

SEQ ID NO: 27373 - DNA, 387 bp, Homo sapiens
  misc_feature: GYAE6OF02IB72N.1.36.D03.1.454.CMB.1.raw
  modified_base (376)..(387): a, c, t, g, unknown or other
  misc_feature (376)..(387): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtcttcccctggccgccctgcctccgaggacgccacctccgagagccacacgccggccctgggctgcctggtcaaggactacttccacgcactcgtctgacggcgggctgggcaagggcgactacgtagnnnnnnnnnnnn

SEQ ID NO: 27374 - DNA, 392 bp, Homo sapiens
  misc_feature: GYAE6OF02I5WF4.1.36.D03.1.454.CMB.1.raw
  modified_base (379)..(392): a, c, t, g, unknown or other
  misc_feature (379)..(392): n is a, c, g, or t
tcagacgagtgcgtcacgaccggtgctcgatttagctgcgtcacgaatctctgcacagaactttcagggctgggtcaccatgaccagggacacgtccatcaaaacagcctctctggagctgaccagactgagatctgacgacacggccgtgtattactgtgcgagagagggtactagatacggtctggacgtctggggccaagggaccacggtcaccgtctcctcagcctccaccaagggccccatcccgtccttcccctggccgcccctgcctccacggagccaccctccgagcgcacagcggccctgggcctggccctggtcaaggcctaccttccgacgcactcgtctgacggcgggctggcaaggcgacagtagnnnnnnnnnnnnnn

SEQ ID NO: 27375 - DNA, 439 bp, Homo sapiens
  misc_feature: GYAE6OF02ILWIR.1.36.D03.1.454.CMB.1.raw
  modified_base (419)..(419): a, c, t, g, unknown or other
  misc_feature (419)..(419): n is a, c, g, or t
  modified_base (422)..(439): a, c, t, g, unknown or other
  misc_feature (422)..(439): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtccttccccgtggccgccctgcctccagggacgccacctccgagacgccaacaggccggccccgtggggcctcggcccgtgggtaccaaagggaccttaaccgttcccgaaccggccaccgttccgtccgtggacggccgggggtctggggaccaaagggccgacgaatagngcnnnnnnnnnnnnnnnnnn

SEQ ID NO: 27376 - DNA, 364 bp, Homo sapiens
  misc_feature: GYAE6OF02IQWA5.1.36.D03.1.454.CMB.1.raw
  modified_base (360)..(364): a, c, t, g, unknown or other
  misc_feature (360)..(364): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtcttcccctggcgcccctgctccaggagcacctccgagagcacagcggccctgggctgcctggtcaggactacttccacgcactcgtctgagcgggctggcaaggcgcatagnnnnn

SEQ ID NO: 27377 - DNA, 154 bp, Homo sapiens
  misc_feature: GYAE6OF02GSFLH.1.36.D03.1.454.CMB.1.raw
  modified_base (153)..(154): a, c, t, g, unknown or other
  misc_feature (153)..(154): n is a, c, g, or t
tcagacgagtgcgtcacgaccggtgctcgatttagctgcgtcacgtcggcgggggaccaagctggagatcaaacgaactgtggctgcaccatctgtcttcatcttcccgccatctgaagacgacgctctgagcgggctggcaaggcgcatagnn

SEQ ID NO: 27378 - DNA, 423 bp, Homo sapiens
  misc_feature: GYAE6OF02I93RA.1.36.D03.1.454.CMB.1.raw
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
  modified_base (374)..(376): a, c, t, g, unknown or other
  misc_feature (374)..(376): n is a, c, g, or t
  modified_base (378)..(423): a, c, t, g, unknown or other
  misc_feature (378)..(423): n is a, c, g, or t
tcagacgagtgcgtcacgaccggtgctcgattttagctgcgtcacgaagtctctgcacagaactttcagggctgggtcaccatgtaccagggaccacgtccatcaaaaccaggcctctctggagctgaccagactgagatctgacgacacggccgtagtattactcgtgcgagagaggggtacctacatacggtctggacgtcgtggggccaagggaccacggtcaccgtctcctcacgcctccaccgaacgggcccatccgtcctcccctgcgccctgcctcagganccaccnccgagncacngccgcctgggctgcctgcaagctacttccgacggcnctcgtctgagccgggctggcaaggcgacagtagnnntnnnnnnnnnnnnnnnnnnnnnnnnnnnnnnnnnnnnnnnnnnnnnn

SEQ ID NO: 27379 - DNA, 365 bp, Homo sapiens
  misc_feature: GYAE6OF02HE04J.1.36.D03.1.454.CMB.1.raw
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (355)..(365): a, c, t, g, unknown or other
  misc_feature (355)..(365): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggccacggtcaccgtctcctcagcctccaccaagggcccatccgtctcccctggcgccctgctccaggancacctcgagngcacagcggccctgggctgcctggtcaggactacttccacgcactcgtctgagcgggctggcaggcgcatagnnnnnnnnnnn

SEQ ID NO: 27380 - DNA, 514 bp, Homo sapiens
  misc_feature: GYAE6OF02FWRCP.1.36.D03.1.454.CMB.1.raw
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (473)..(475): a, c, t, g, unknown or other
  misc_feature (473)..(475): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(514): a, c, t, g, unknown or other
  misc_feature (481)..(514): n is a, c, g, or t
tcagacgagtgcgtcacgaccggtgctcgatttagctgcgtcacgaagtctctgccacagaactttcagggctgggtcaccatgaccacgggacacgtccatccaaaacagcctctctggagcctgaccagacctgagatctgacgacacggcccgtagtagttactgtgccgaggagagggtactacagtacggtctggacggtcgtggggccgaaggggaccacgggtccaccggtcctcctcacgccctccaccgaacgggcccaagttcccgttccttcccccgtggccgcccctgcccttacccgaggacgccaccctccggagacggcgacgacggcccgggaccccgtcgggggcctcggcccggtgggttacgaaaggggtacctaacgttcccgaacggcctacctccgttactggacggcggggctggaccgaaggccgacgaagtagggntgngtcngntcnnngngngnnnnnnnnnnnnnnnnnnnnnnnnnnnnnnnnnn

SEQ ID NO: 27381 - DNA, 549 bp, Homo sapiens
  misc_feature: GYAE6OF02FK8VY.1.36.D03.1.454.CMB.1.raw
  modified_base (341)..(341): a, c, t, g, unknown or other
  misc_feature (341)..(341): n is a, c, g, or t
tcagacgagtgcgtcacgaccggtgctcgatttagctgcgtcacgatctctcttggggattctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaacttcaccgcctcctatatacactggtacgacaggcccctggacaaggacttgagtggagtgggatggatcgacccgtaaaagtggtggacacaatctctgcacanaactttcagggctggcacatcgaccgaggacacgtccatacaaacagtcctctcgtggacgtcagacccagacttgagtatactgacgacacggtccgtagttacttacgtgtcgcgaagacgaggttactacgtagttacggtcgtacgggtaccgttcggtcggggaccgtacgggaccgtacgggtacctaccggtacctacccg

SEQ ID NO: 27382 - DNA, 615 bp, Homo sapiens
  misc_feature: GYAE6OF02FYSCQ.1.36.D03.1.454.CMB.1.raw
  modified_base (108)..(108): a, c, t, g, unknown or other
  misc_feature (108)..(108): n is a, c, g, or t
  modified_base (162)..(162): a, c, t, g, unknown or other
  misc_feature (162)..(162): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (466)..(466): a, c, t, g, unknown or other
  misc_feature (466)..(466): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
tcagacgagtgcgtcacgaccggtgctcgattttagctgcgtcacgaatctcctagcacagaactttcagggctgggtcaccatgaccaggacacgtccatcaaaacngcctctctggagcctgaccagactgagatcgtgacgacgacggcgtgtattacngtgcgagagagggtactacgagtacggtctggaccgtcgtggggacccaaggggacccacgggtccaccggtctcccgtcacgccctaccgaacgaacgggccccaagttcccgtccttccccgtgggccgcccctggccttccgaggacgacctacccgtccggagacgcacgacggccggtccctggggcctcggccgtagggtaccaagggtacctaccgttccgaccgcctactcgtctcggaacggccgggcttcgggacgaacggcgacgtaagttagcacgngcangtgactgcagngcgntanatcgtagctatatcgcgacgctctcgttaccgtagtgtcgtcgtacgtcgtcgtcgtcgtacgtaccgtacgtacgtaccgtcgtactaccgtaccgtaccgtacgtacgtaccgtaccgtaccgtccgtaccgtccgtccg

SEQ ID NO: 27383 - DNA, 300 bp, Homo sapiens
  misc_feature: GYAE6OF02HMTSW.1.36.D03.1.454.CMB.1.raw
  modified_base (281)..(300): a, c, t, g, unknown or other
  misc_feature (281)..(300): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacgacggccgtagtattcggagagcacgaggccggcccgtggggctcggccgtgggtacaaacgggtaccttacttcccgaacgcctaccgttccgtctggacgggtccggggcgtgggaccgaacgggccgactaagtagnnnnnnnnnnnnnnnnnnnn

SEQ ID NO: 27384 - DNA, 417 bp, Homo sapiens
  misc_feature: GYAE6OF02JYTO9.1.36.D03.1.454.CMB.1.raw
  modified_base (399)..(417): a, c, t, g, unknown or other
  misc_feature (399)..(417): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtccttcccctggccgccctgcctccagggacgccaccctccgaggacgccacacggccgggcccctggggcctcggccgtggtacaacggtacctaccttccacgcacctcgtcgtcgacggcggggctcgggacgaacggcgacagtagcnnnnnnnnnnnnnnnnnnn

SEQ ID NO: 27385 - DNA, 155 bp, Homo sapiens
  misc_feature: GYAE6OF02FTISD.1.36.D03.1.454.CMB.1.raw
  modified_base (155)..(155): a, c, t, g, unknown or other
  misc_feature (155)..(155): n is a, c, g, or t
tcagacgagtgcgtcacgaccggtgctcgatttagctgcgtcacgtcggcgggggaccaagctggagatcaaacgactgtggctgcaccatctgtcttcatcttcccgcatctaaaaaagcgcactcgtctgagcgggctggcaaggcgcatagn

SEQ ID NO: 27386 - DNA, 594 bp, Homo sapiens
  misc_feature: GYAE6OF02FJJUP.1.36.D03.1.454.CMB.1.raw
  modified_base (108)..(108): a, c, t, g, unknown or other
  misc_feature (108)..(108): n is a, c, g, or t
  modified_base (161)..(161): a, c, t, g, unknown or other
  misc_feature (161)..(161): n is a, c, g, or t
  modified_base (273)..(273): a, c, t, g, unknown or other
  misc_feature (273)..(273): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
  modified_base (581)..(581): a, c, t, g, unknown or other
  misc_feature (581)..(581): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
tcagacgagtgcgtcacgaccggtgctcgatttagctgcgtcacgaatcgtctgcacagaactttcagggctgggtcaccatgaccagggacaccgtccatcaaaacngcctctctggaactgaccagactgacgatctgacgacacggccgtgtattacngtgcgagagagggtactacatacggtctggacgtctggggccaaggggaccacggtcacccgtctcctcacgcctccaccgaacgggcccatcccgtcttccccctgggccncccgtgcctccgaggacgccacccgtccggaagacggcctaccaggtccggcccttgggcttggccgtcgggttacctaaacggggtacccttaaccgtttacccgaaccgggtccaacctttcggttaccgttcggaacggcccgggggtcttcggggaccgtaaacggggccggacctaagttacggactcactcacacncncncncncgncncnctactntctcgctactactacncncacactanacacactntatactacgtacgtacgagacgacgacgacgacgacgacgcgcgtcgcgcncactcncnctctc

SEQ ID NO: 27387 - DNA, 497 bp, Homo sapiens
  misc_feature: GYAE6OF02IR1D6.1.36.D03.1.454.CMB.1.raw
  modified_base (445)..(445): a, c, t, g, unknown or other
  misc_feature (445)..(445): n is a, c, g, or t
  modified_base (448)..(497): a, c, t, g, unknown or other
  misc_feature (448)..(497): n is a, c, g, or t
tcagacgagtgcgtcacgaccggtgctcgatttagctgcgtcacgatctctgcacagaactttcagggctgggtcaccatgaccaggggacacgtccatcaaaacagcctctctggagctgaccagactgagatctgacgacacggccgtgtattactgtgcgagagagggtactacagtacggtctggacgtcgtggggccgagggaaccctggtcaccgtctcctcacgccctccaccgacgggcccagtccgtcccttccccgtggccacccctcctacaacgagcctaccgtcggtcgggggcacgacggcccggcccggtggtcgtcggcccgtgggtaccgaacggtaccttaccgttacccgaccgtcctaccgttccggttcgtacggacgggtaccgggtctacggggtaccgacgggccgactaaggtacgactncgnnnnnnnnnnnnnnnnnnnnnnnnnnnnnnnnnnnnnnnnnnnnnnnnnn

SEQ ID NO: 27388 - DNA, 500 bp, Homo sapiens
  misc_feature: GYAE6OF02JL1U7.1.36.D03.1.454.CMB.1.raw
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (459)..(461): a, c, t, g, unknown or other
  misc_feature (459)..(461): n is a, c, g, or t
  modified_base (463)..(467): a, c, t, g, unknown or other
  misc_feature (463)..(467): n is a, c, g, or t
  modified_base (469)..(500): a, c, t, g, unknown or other
  misc_feature (469)..(500): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggccccatccgtccttcccctggccgcccctgccttcccgaggacgccacccgtccgagacgccaccaggccggcccctggggcctcggcccctgggtaccaaacgggaccttaacccgttcccgaccgtccgaacccgttccgttccgtaggaccggtccggggtactcgggtaccgaaacgggcccgcgtaacgtagggcctagcgntagcgcngngtgnnncnnnnncnnnnnnnnnnnnnnnnnnnnnnnnnnnnnnnn

SEQ ID NO: 27389 - DNA, 729 bp, Homo sapiens
  misc_feature: GYAE6OF02IR1R1.1.36.D03.1.454.CMB.1.raw
  modified_base (115)..(115): a, c, t, g, unknown or other
  misc_feature (115)..(115): n is a, c, g, or t
  modified_base (184)..(184): a, c, t, g, unknown or other
  misc_feature (184)..(184): n is a, c, g, or t
  modified_base (583)..(583): a, c, t, g, unknown or other
  misc_feature (583)..(583): n is a, c, g, or t
  modified_base (601)..(601): a, c, t, g, unknown or other
  misc_feature (601)..(601): n is a, c, g, or t
  modified_base (607)..(607): a, c, t, g, unknown or other
  misc_feature (607)..(607): n is a, c, g, or t
  modified_base (615)..(615): a, c, t, g, unknown or other
  misc_feature (615)..(615): n is a, c, g, or t
  modified_base (617)..(618): a, c, t, g, unknown or other
  misc_feature (617)..(618): n is a, c, g, or t
  modified_base (620)..(620): a, c, t, g, unknown or other
  misc_feature (620)..(620): n is a, c, g, or t
  modified_base (623)..(623): a, c, t, g, unknown or other
  misc_feature (623)..(623): n is a, c, g, or t
  modified_base (628)..(628): a, c, t, g, unknown or other
  misc_feature (628)..(628): n is a, c, g, or t
  modified_base (636)..(636): a, c, t, g, unknown or other
  misc_feature (636)..(636): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
  modified_base (652)..(652): a, c, t, g, unknown or other
  misc_feature (652)..(652): n is a, c, g, or t
  modified_base (655)..(655): a, c, t, g, unknown or other
  misc_feature (655)..(655): n is a, c, g, or t
  modified_base (664)..(664): a, c, t, g, unknown or other
  misc_feature (664)..(664): n is a, c, g, or t
  modified_base (692)..(692): a, c, t, g, unknown or other
  misc_feature (692)..(692): n is a, c, g, or t
  modified_base (696)..(696): a, c, t, g, unknown or other
  misc_feature (696)..(696): n is a, c, g, or t
  modified_base (728)..(728): a, c, t, g, unknown or other
  misc_feature (728)..(728): n is a, c, g, or t
tcagacgagtgcgtcacgaccggtgctcgatttagctgcgtcacgaatcgtcttggctacagtaacgtttccagggcgtgggtcaccatcgaccagggacacgtccatcaaaacngcctcgtctgagctcgacagctagagatctgtacgacgacggccgttgtattacctgtcgcgacgaggnggttactacagtacggtcgtaggaccgtcgtcggggaccgtaacggggacctacgggtacgaacccggttctcccgtcgtacgtcccttacccgaaccgaaccgggccctaacggttccccgtacccttttccccccgtggccccgtaccccgttacgaccccgtttaccgaacgggacgttacccaccccgtttccggaacggacgaaccaaaccgtaccggggccccggttacccgggtcgggtaccgtttaccggaccggtttacggggtaccgtaaaacgggtcctttaaccccggtttcccaaccggtacccgttaacccggttcgttacccgtaacggaccggtccgggttaccgttggggaaccgtaacgggctaccggtaacgtacggtanacgtcgacgacgtcgacnctagtnaccggtancnncnatntacgngtctacgntacgngngtagcgacngcncgtacgtcnctcgagcgtacgcgtctaccggtgtacncgtntccgtcgtacgtcgcgtcggacggcttaccgng

SEQ ID NO: 27390 - DNA, 697 bp, Homo sapiens
  misc_feature: GYAE6OF02JPBL3.1.36.D03.1.454.CMB.1.raw
  modified_base (159)..(159): a, c, t, g, unknown or other
  misc_feature (159)..(159): n is a, c, g, or t
  modified_base (593)..(593): a, c, t, g, unknown or other
  misc_feature (593)..(593): n is a, c, g, or t
  modified_base (602)..(602): a, c, t, g, unknown or other
  misc_feature (602)..(602): n is a, c, g, or t
  modified_base (620)..(620): a, c, t, g, unknown or other
  misc_feature (620)..(620): n is a, c, g, or t
  modified_base (625)..(625): a, c, t, g, unknown or other
  misc_feature (625)..(625): n is a, c, g, or t
  modified_base (636)..(636): a, c, t, g, unknown or other
  misc_feature (636)..(636): n is a, c, g, or t
  modified_base (646)..(646): a, c, t, g, unknown or other
  misc_feature (646)..(646): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (653)..(654): a, c, t, g, unknown or other
  misc_feature (653)..(654): n is a, c, g, or t
  modified_base (656)..(656): a, c, t, g, unknown or other
  misc_feature (656)..(656): n is a, c, g, or t
  modified_base (659)..(659): a, c, t, g, unknown or other
  misc_feature (659)..(659): n is a, c, g, or t
  modified_base (664)..(664): a, c, t, g, unknown or other
  misc_feature (664)..(664): n is a, c, g, or t
  modified_base (667)..(667): a, c, t, g, unknown or other
  misc_feature (667)..(667): n is a, c, g, or t
  modified_base (670)..(670): a, c, t, g, unknown or other
  misc_feature (670)..(670): n is a, c, g, or t
  modified_base (672)..(673): a, c, t, g, unknown or other
  misc_feature (672)..(673): n is a, c, g, or t
  modified_base (675)..(677): a, c, t, g, unknown or other
  misc_feature (675)..(677): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
  modified_base (683)..(688): a, c, t, g, unknown or other
  misc_feature (683)..(688): n is a, c, g, or t
  modified_base (690)..(694): a, c, t, g, unknown or other
  misc_feature (690)..(694): n is a, c, g, or t
  modified_base (696)..(697): a, c, t, g, unknown or other
  misc_feature (696)..(697): n is a, c, g, or t
tcagacgagtgcgtcacgaccggtgctcgatttagctgcgtcacgatctctgcacagaactttcaggctgggtcaccatgaccagggacacgtccatcaaaaacagcctctctggagctgaccagactgagatctgacgacacggcctgactactgtgngagaggagggtaacgtactagaggttcgtcggaaggtcgtcgggtccgggaaacggtaacggaccgtcggtacccgtaccgttcccttaccgacgaccgtacccctacccgaaaacggggcccggacccttaccggtttccccttcccccgttacccccggtcggcccccgttaccggtcccgtccccgttaccgggaacggtaccgtaccccgtaccccggttaccggaaccggcggtaacccaccggaaccgggccccggtccgggtccggtacggtccccggtacggttccgggaaaccggtaaccggttaacccgttttaacccgtacccggaccggtacccgtaacccggttccgtacggtacgggaaccgggtcgggtacccgggttcgaaccggggaaaaccggccgacggttaacgacggtaccgngtacccggngtccgacgtacgcgacgngttanacgtgcaacgngtcgacgttnacncncnncncgngcgcngcnacncnngnnncncncnnnnnngnnnnnann

SEQ ID NO: 27391 - DNA, 464 bp, Homo sapiens
  misc_feature: GYAE6OF02JUYOU.1.36.D03.1.454.CMB.1.raw
  modified_base (426)..(426): a, c, t, g, unknown or other
  misc_feature (426)..(426): n is a, c, g, or t
  modified_base (429)..(433): a, c, t, g, unknown or other
  misc_feature (429)..(433): n is a, c, g, or t
  modified_base (436)..(464): a, c, t, g, unknown or other
  misc_feature (436)..(464): n is a, c, g, or t
tcagacgagtgcgtcacgaccggtgctcgatttagctgcgtcacgatctctgcacagaactttcagggctgggtcaccatgaccagggacacgtccatcaaaacagcctctctggagctgaccagactgagatctgacgacacggccgtgtattactgtgcgagagagggtactacatacggtctggacgtcgtggggccaacgggaccacgggtcaccgtctcctcacgccctccaccgaacgggcccactcccgtcctttcccccgtggcccgtccccgtcgcctccgacggtacgccaacccgtccgagacggccaacgcgcccggcccgtggggacctcggaccgtggtaccgaacgggtaccttaccttccgaccgcctaccgtcgtctcggaggcgggctaggcaagggcgaccaagtgngtnnnnnagnnnnnnnnnnnnnnnnnnnnnnnnnnnnn

SEQ ID NO: 27392 - DNA, 374 bp, Homo sapiens
  misc_feature: GYAE6OF02FF8AL.1.36.D03.1.454.CMB.1.raw
  modified_base (364)..(374): a, c, t, g, unknown or other
  misc_feature (364)..(374): n is a, c, g, or t
tcagacgagtgcgtcacgaccggtgctcgatttagctgcgtcacgatctctgcacagaacttcagggctgggtcaccatgaccagggacacgtccatcaaaacagcctctctggagctgaccagactgagatctgacgacacggccgtgtattactgtgcgagagagggtactacatacggtctggacgtctgggggccaagggaccacggtcaccgtctcctcagccctccaccaaggggccccatcccgtccttcccctggcgcccctgcctccaggagcacctccgagagcacagcggccctgggctgcctggtcaaggctactccagcactcgtctgagcgggctggcaaggcgcatagnnnnnnnnnnn

SEQ ID NO: 27393 - DNA, 574 bp, Homo sapiens
  misc_feature: GYAE6OF02GOQU7.1.36.D03.1.454.CMB.1.raw
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
  modified_base (436)..(436): a, c, t, g, unknown or other
  misc_feature (436)..(436): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
  modified_base (522)..(522): a, c, t, g, unknown or other
  misc_feature (522)..(522): n is a, c, g, or t
  modified_base (525)..(525): a, c, t, g, unknown or other
  misc_feature (525)..(525): n is a, c, g, or t
  modified_base (532)..(533): a, c, t, g, unknown or other
  misc_feature (532)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
tcagacgagtgcgtcacgaccggtgctcgatttagctgcgtcacgaatcgtctgcacagaactttcagggctgggtcaccatgaccgagggacacgtccatcaaaacagcctctctggagctgaccagtactgagattctggacgtacacggccgttagtaattctgtgcgagagagggtactactagtacggtctggacgtcgtggggaccaaggggacccacggtccgacccgttccgttcccgtacgaagtcccctcccgaacccgtaacggggccccacgttcccgtccctttccccgtcgggtccnccccttgcccgtaccacgggactccaccccgtcggancgccacaggcccggccgtcgggcctgcccgtggtcaaacggtcttacccgttccacggtcctacgtcggtctacggacggccggggtntcggcaaagggtcccgaagtacggctcncgancngngcncacncagngcncgtacgtctacgtagtacncganagtcngagcgcgntgngcgtcgnngngntcgctgcgcgtgcncgcgngagcgngcgtgcgagcgc

SEQ ID NO: 27394 - DNA, 610 bp, Homo sapiens
  misc_feature: GYAE6OF02JUO7Y.1.36.D03.1.454.CMB.1.raw
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
tcagacgagtgcgtcacgaccggtgctcgatttagctgcgtcacgatctctcttggggattctctagagaatcccctgagagctccgttcctcaccatggactggacctggaggatcctcttcttggtggcagcagccacaggagcccactcccaggtgcagctggtgcagtcgtggggctggaggtgaagaagccgtgggggcctcgagtggaacggtctcctgcgaaggcttcgtggactacaacttcaccgcctcctatatacactgggtacgacacggcccctaggacaaggcttggagtggagtgggatggatcggaacctaaaggtggtaggacactaatcctcgtagcactagtaacttcgagggtcgtggtaccacagtcgaccgaggacacgtacaactaacaaacncgtacctctacgacggtacncgtacgaccagtaccgagacgactacgacggacgaacgacggtccgttagttacgttacgtcggtacgacggaagtacggaacggttacctagtaacggtcggttacggtacggtaaccggtcggtacggggaaccgtacggggacccgtacggaccgttacccggtctacccg

SEQ ID NO: 27395 - DNA, 154 bp, Homo sapiens
  misc_feature: GYAE6OF01BGQ7W.13.67.G01.1.454.CMB.1.raw
  modified_base (154)..(154): a, c, t, g, unknown or other
  misc_feature (154)..(154): n is a, c, g, or t
tcagtcacgtactacacgaccggtgctcgatttagagtatacatattgggtttgggaccaagctggacatcaaacgaactgtggctgcaccatctgtcttcatcttcccgccatctgatagtacgtgactgagcgggctggcaaggcgcatagn

SEQ ID NO: 27396 - DNA, 508 bp, Homo sapiens
  misc_feature: GYAE6OF01CC60Z.13.67.G01.1.454.CMB.1.raw
  modified_base (310)..(310): a, c, t, g, unknown or other
  misc_feature (310)..(310): n is a, c, g, or t
  modified_base (400)..(400): a, c, t, g, unknown or other
  misc_feature (400)..(400): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttaacagctcaacaataagaacttcttagcttggtaccagcagaaaccaggacagcctctaagctgctcatttacnggcatctatccgggaatccggggtcctgaccgatcagtgcagcggtctgggacagatttcactctcacatcagcagcctgcagctgaagntgtggctagtttatactgtcagtcaattattatagtactcctaccgagtctcgtacgtttcggacggtacgggaccaagggtggaacgatacgaaacgagtggtacgg

SEQ ID NO: 27397 - DNA, 533 bp, Homo sapiens
  misc_feature: GYAE6OF01B4B00.13.67.G01.1.454.CMB.1.raw
  modified_base (238)..(238): a, c, t, g, unknown or other
  misc_feature (238)..(238): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataagaacttcttagcttggtaccagcagaaaccaggacagcctcctaagctgctcatttactggcatctatccgggaatccggggtcctgaccgattccagtggcaggcgggtctgggacagtatttcactctcaccatcagcagcctgcaggctgaagagtgtggctagtttactacgtgtcagtactaattattatagtaccttcctaccggagtcctcgtacgtttccgggacggacgggaccgtaaggtcggaagactagaaacgtacgtgtacggg

SEQ ID NO: 27398 - DNA, 498 bp, Homo sapiens
  misc_feature: GYAE6OF01BYH68.13.67.G01.1.454.CMB.1.raw
  modified_base (238)..(238): a, c, t, g, unknown or other
  misc_feature (238)..(238): n is a, c, g, or t
  modified_base (410)..(410): a, c, t, g, unknown or other
  misc_feature (410)..(410): n is a, c, g, or t
  modified_base (459)..(459): a, c, t, g, unknown or other
  misc_feature (459)..(459): n is a, c, g, or t
  modified_base (486)..(486): a, c, t, g, unknown or other
  misc_feature (486)..(486): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagntgtggcagtttattactgtcagtcaatattatagtactcctcgagctcnctttggcggagggaccaggtgagatanaacgagtgtcgg

SEQ ID NO: 27399 - DNA, 510 bp, Homo sapiens
  misc_feature: GYAE6OF01B322Y.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactggcatctatccgggaatccggggtcctgaccgattcagtggcaggcgggtctgggacagatttcactctcaccatcagcagcctgcagctagaagatgtgctagtttatactgtcagtactaattattaatagtactcctcgacgtctctacgtttggacggtaggaccaaggtgagagtacaaacgactggtacgg

SEQ ID NO: 27400 - DNA, 513 bp, Homo sapiens
  misc_feature: GYAE6OF01BVXJV.13.67.G01.1.454.CMB.1.raw
  modified_base (461)..(461): a, c, t, g, unknown or other
  misc_feature (461)..(461): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacgggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcgactctcaccatcacgcagcctgccgaggctgaagtatgtggactagtttattactgtacagtcaattattatagtctcctcgngctcacgtttggcggtagggacccaaggtcgagactacaaacgatggtacgg

SEQ ID NO: 27401 - DNA, 529 bp, Homo sapiens
  misc_feature: GYAE6OF01D57KY.13.67.G01.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (413)..(413): a, c, t, g, unknown or other
  misc_feature (413)..(413): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaaacaataagaacttctagcttggtaccagcagaaaccaggacagcctcctaagctgctcatttacnggcatctatccgggaatccgggtcctgaccgattcagtggcaggcgggtctgggacagtatttacactctccaccatcagcagcctgcgaggctagaagntgtgactagtttatactgtacagctaattatatagtactcctccgagtctacgtacgtttcgggacggtacgggacctaagggtacggagtaacgtacgaaaaccgtgtggtacgg

SEQ ID NO: 27402 - DNA, 508 bp, Homo sapiens
  misc_feature: GYAE6OF01BMIXO.13.67.G01.1.454.CMB.1.raw
  modified_base (238)..(238): a, c, t, g, unknown or other
  misc_feature (238)..(238): n is a, c, g, or t
  modified_base (439)..(439): a, c, t, g, unknown or other
  misc_feature (439)..(439): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcagctgaagatgtggactagtttattactgtcagcaattnttatagtactcctcgagtctcgtactttcggcggaggaccaaggtcgagatacaaacgaagtggtacgg

SEQ ID NO: 27403 - DNA, 612 bp, Homo sapiens
  misc_feature: GYAE6OF01CMTPA.13.67.G01.1.454.CMB.1.raw
  modified_base (382)..(382): a, c, t, g, unknown or other
  misc_feature (382)..(382): n is a, c, g, or t
tcagtcacgtactacacgaccggtgctcgatttagagtatacatattgggtctggggggggcttggtccagcctggggggtccctgagactctcctgtgcagcctctggattcactttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagatggggcacggactattttgtagaggtgtacgtggggccagggacgccccggtnacccgtctcctcacgccctccaccgaacgggcccatccggtcccttccccgtggcccgcccctgccctccgaggacgccacccgtccgagacgcaccgaggcccggcccgtgggcctcggcccgttgggtaccgaacgggtacccttacgtttacccgttacggtaccggttcggaccgttgggaacgggtccggggtcgttcggggaccgaaacggggccgacgtaacg

SEQ ID NO: 27404 - DNA, 583 bp, Homo sapiens
  misc_feature: GYAE6OF01ENTC6.13.67.G01.1.454.CMB.1.raw
  modified_base (448)..(448): a, c, t, g, unknown or other
  misc_feature (448)..(448): n is a, c, g, or t
tcagtcacgtactacacgaccggtgctcgatttagagtatacatattgggtttgggggggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtcgtgggggaggtgtggtacggccgtggggggtccctcgagactctcctgtgcaacctctggattcagatttgatgagtatggcatacactgggtcccgccaacctccgaggggaagggctgcagtggtctctggtataaacgtggaatggtgccagcaacaacttatgcagactcgtggtaggaacgggccgtattccacctatcctaccagagacaggtcgaccgaagaacctccgtaanacttctgacaaagtgaactgtctacgggagtccgaaggaccacggtcctttgtatttcgtggtcgtacggtaagggttagcgtaggtcggtacgttagggttaaccttacggataaacgttgggaccggttcggg

SEQ ID NO: 27405 - DNA, 222 bp, Homo sapiens
  misc_feature: GYAE6OF01CIDOS.13.67.G01.1.454.CMB.1.raw
  modified_base (220)..(222): a, c, t, g, unknown or other
  misc_feature (220)..(222): n is a, c, g, or t
tcagtcacgtactacacgaccggtgctcgatttagagtatacatattgggtttggggccagggaaccctggtcaccgtctcctcagcctccaccaagggcccatcggtcttccccctggcaccctcctccaagagcacctctgggggcacagcggccctgggctgcctggtcaaggctacttcctagtacgtgactgagcgggctggcaaggcgcatagnnn

SEQ ID NO: 27406 - DNA, 618 bp, Homo sapiens
  misc_feature: GYAE6OF01C3JTA.13.67.G01.1.454.CMB.1.raw
  modified_base (238)..(238): a, c, t, g, unknown or other
  misc_feature (238)..(238): n is a, c, g, or t
  modified_base (326)..(326): a, c, t, g, unknown or other
  misc_feature (326)..(326): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctgactgtgtctctgggcgagaggccaccatcaactgcaagtccagccagagttgttttanacagctaccaaacaataaacgaacttacttagcgtttaggtaccagacaagaaaccaggaacagcctactaagctgctctatttacgnggacagtactagtccgggaagttcccggggtcctcgacccgtattccgagtcggcgaggcgggtcgtagggactagtactttcactctacaccgtatacagcacgtcctagacgacggtctaggaacgtagtggttcggtacttaagttttacttacgtgtacctagtactaaattactttaagtacgttacctacccgttaccgaggttcctaccgttacggtttcccgggacggggtacggaaaccggtaagggtggtaacgaagtaaccgaaacggacgttggtacggg

SEQ ID NO: 27407 - DNA, 634 bp, Homo sapiens
  misc_feature: GYAE6OF01DCNUW.13.67.G01.1.454.CMB.1.raw
  modified_base (241)..(241): a, c, t, g, unknown or other
  misc_feature (241)..(241): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgagagggccaccatcaactgcaagtccagccagagttgttttanacagcctaccaaacaataagtaacttcttagcttaggtaccagacaagaaacaggacagcctactaagctgctactatttacgtggctatctagtccgggaacgtccggggtcctagaccgtattcgaggtcggcaggcgggtctggggactaggtactttaccgactcctaccaccgactccgaacgtccgaacgcccgttacggcgaacgggtccgttaaggaagtacgttggtacggtacttaaggttttacttaacgttcgtacgtaacgtactaaagttactttaacgtacgttaacctcccgtaccggacgtacctacgttacggtttcgggacgggtacggtaaccgaagggtacggaagtaacaacgaaacggtacgtggtacgg

SEQ ID NO: 27408 - DNA, 888 bp, Homo sapiens
  misc_feature: GYAE6OF01EJ4V7.13.67.G01.1.454.CMB.1.raw
  modified_base (297)..(297): a, c, t, g, unknown or other
  misc_feature (297)..(297): n is a, c, g, or t
tcagtcacgtactacacgaccggtgctcgatttagagtatacatattgggtctgggggaggcttggtacagcctggaaggtccctgagactctcctgtgcagcctctggtattcctaccttttagcagctatgccatcgaccgtcgggtcccgccaggcctccgaggggaaggggcgtgggcggtgggtctcgtaggtattaggtggtaggtgggtaggaagcacatactacgcagacctccggtaggaacgggtccgtacacctactcctccagagaactaacttaccgaagaacncgctagtaactctagactaaagtacgaacacgtccgtaggagacggccggaacggtaccgaacccgggtacgttaattaactttacgtggtacggactaggaccgtagggtcgggacgttcggggaaccaaccggaaggggactacgtaaattttaccgttttaacgtttcggtaacccgtttaccggggtacggggaaccccggtaaaccggggtaaccccgttcgggtacccgtacccggttccctacccgtaccgaccgtacccccttaacccgaacccgggaaccggggtacccctaaccggtttccccgggttacccccctttccccccggtaccggaccccctaaccccccgtttccccgtaacccgaaccgggtaccgaccccgttaaccccggttccggggaccgggggaccctaacccggaccggggcccccgggtcccccggttaggggtccccgttacgggtaccccggttagggtaacccgggtaaaccgggttaccctttaacccggtttacccgtaacgggttacccgtacggtacccggttagggacccgggtccgggtaggtccggggaaccggg

SEQ ID NO: 27409 - DNA, 509 bp, Homo sapiens
  misc_feature: GYAE6OF01CGV3R.13.67.G01.1.454.CMB.1.raw
  modified_base (240)..(240): a, c, t, g, unknown or other
  misc_feature (240)..(240): n is a, c, g, or t
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (396)..(397): a, c, t, g, unknown or other
  misc_feature (396)..(397): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
tcagtcacgtactacacgaccggtgctcgatttagagtatacatattgggtttgggggagctacaacaggcaggcaggggcagcaagatggtgtgcagacccaggtcttcatttctctgttgctctggatctctggtgcccacggggacatcgtgatgacccagtctcagactccctggctgtgtctctgggacaggaggccaccatcaactgcaagtccagccagtagtgttttacacngctaccaataagtaaatacttnttaagctttaggtaccagacagaaaccaggacagacctctaagctgctnattactggcatcgtatccgggaatccggggtccngacgatcagtgcagcggtctgggananttcacttnacgccatcagcatccnncagtcngaatngtcgatatttacgtaatgtacatntaattcttaaggntacttcgaccgngtactcgaacgtttggacgaggaaccagagagtaanacaaaacngtntacgg

SEQ ID NO: 27410 - DNA, 576 bp, Homo sapiens
  misc_feature: GYAE6OF01BZFB0.13.67.G01.1.454.CMB.1.raw
  modified_base (240)..(240): a, c, t, g, unknown or other
  misc_feature (240)..(240): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgagagggccaccatcaactgcaagtccagccagagttgtttanacagctaccaaacaataagtaacttcttagtcttggtaccagacaagaaaccaggacagcctacctaagctgctactatttacgtgggcatctacgtccgggtaacgtcccggggtcctcgaccgtagttccgaggtcggcgacggtcgggtcgtgggactaggtactttcactcctacaccatcagcacgcctgcgaggctagaagtgtggtgacttagtttaacttgtgtcatactaattattatacgtcctaccgtcggtacgtccgtacgttaccgttgggacggtacgggaccgtaagggtgtaacgacgtaacgaaacgtagtggtacgg

SEQ ID NO: 27411 - DNA, 640 bp, Homo sapiens
  misc_feature: GYAE6OF01BEN83.13.67.G01.1.454.CMB.1.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (310)..(310): a, c, t, g, unknown or other
  misc_feature (310)..(310): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
tcagtcacgtactacacgaccggtgctcgatttagagtatacatattgggtttggggaggtctcagagaggagccttagccctggactccaaggcctttccacttggtgatcagcactgagcacagaggactcaccatggaattggggctgagcggtggtttcgtgtaggctattttagaaggtgtcagtgtgagtgcagctggtgagtgtggggagcttggccagccgtgggggtcccngagctctccgtgcgcncgccttgaggtnttcctaacctttggtanctagttggattcgagccgttggccnccgaggtctaccggaagggaccgggnggtaggnggtcggacgaactaagtaagtaacgagtaaggtagaagtagtaaacgtaatagtagtacggtacgtacgtggtaaggacggacggtaccgtactaccgacgtactaccgtacgaaggaaccgaacgaaccgaacttaacgtacctacgtacgttagtacgtacgtagaacgaacgtacgaacgcgttaccgaggaacggacgacggacggacgttccggtactacgttacgtacgtcgtggtacggacgtaaggtacgggtacggtaacgggacggttaagtaggccgtaggtacgg

SEQ ID NO: 27412 - DNA, 631 bp, Homo sapiens
  misc_feature: GYAE6OF01DO8KM.13.67.G01.1.454.CMB.1.raw
  modified_base (239)..(239): a, c, t, g, unknown or other
  misc_feature (239)..(239): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagtgttttanacagctaccaacaataagaacttcttagcttggtaccagcaagaaaccaggacagcctctaagctgctctatttctggcatctatccgggaatccgggggtccctgaccgacttcgagtcggcgacggcgggtcgtgggacagtactttcactctccacatcagcacgcctgccgaggccgtagaagagtggttcggacgttaagtttttaacttaacgttgtacgtaaggtactaaatttacgtttaacgttacgttaaccgtcccgtttaccggaacgtcccgttaccgttaaccggttttacggggaccggggtaacggggtaaacccggtaaggggttacgggtaaacggtaacctacggtaaaaaccggtacgttgggttaaccggg

SEQ ID NO: 27413 - DNA, 518 bp, Homo sapiens
  misc_feature: GYAE6OF01ESHFZ.13.67.G01.1.454.CMB.1.raw
  modified_base (238)..(238): a, c, t, g, unknown or other
  misc_feature (238)..(238): n is a, c, g, or t
  modified_base (502)..(502): a, c, t, g, unknown or other
  misc_feature (502)..(502): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataagaacttcttagcttggtaccagcagaaaccaggacagcctcctaagctgctcatttactgggcatctagtccgggaatccggggtccctgaccgattcagtggcgagcgggtctgggacagtatttcacttctccaccatcagcagcctgcaggctagaagagtggtggtactagttttactactgtcagtactaattattatacgtactcctccgagctcgtacgttcggcggaggacgaggtganatacaacgtagtgtcg

SEQ ID NO: 27414 - DNA, 555 bp, Homo sapiens
  misc_feature: GYAE6OF01CO0TS.13.67.G01.1.454.CMB.1.raw
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacngctcaacaataagaacttcttagcttggtaccagcagaaaccaggacagcctcctaagctagctcatttactgggcatctagtccggaatccggggtcctgaccgtatcagtgcagcgggtctcgggacagtacttcactctccaccatcagcaacgacgtaggaaccctaggtaagtacgttttgaccgttacttttactttctcgttactacctaagttagtggttaacggtctaaccgttactacttttcggccgtaggggaccctaaggcgtggagattcgaaggcgacgtacgtaggctggcacgtacg

SEQ ID NO: 27415 - DNA, 575 bp, Homo sapiens
  misc_feature: GYAE6OF01BQM9J.13.67.G01.1.454.CMB.1.raw
  modified_base (563)..(563): a, c, t, g, unknown or other
  misc_feature (563)..(563): n is a, c, g, or t
  modified_base (572)..(574): a, c, t, g, unknown or other
  misc_feature (572)..(574): n is a, c, g, or t
tcagtcacgtactacacgaccggtgctcgatttagagtatacatattgggtctgggggaggcttggtacagcctggaaggtccctgagactctcctgtgcagcctctggattcaccttttagcagctatgccatgacctgggtccgccaggctccagggagggggctggcgtgggtctcaggtattagtggtagtggtggaagcacatactacgcagactccgtgaagggccggttcaccatctccagagacaattccaagaacacgctgtatctgcaaatgaacagcctgagagccgaggacacggccgtatattactgtgacgaaaggtaaattttaccccctattaccttttagacttacgtcggggaccagggaaccctggtccaccggtctccctcagccctcaccgaacggcccatccggtccttacccccgtggcctacccctcctaccaagtacgcctacctccgtcgggaccacgtaggccggccctggggcctcggccgtaggtcaaggtactaccttcgtagtcgtgactgacggcgggctggaccaaggcncgagtagcnnng

SEQ ID NO: 27416 - DNA, 578 bp, Homo sapiens
  misc_feature: GYAE6OF01BTNPG.13.67.G01.1.454.CMB.1.raw
tcagtcacgtactacacgaccggtgctcgatttagagtatacatattgggtctgggggaggcttggtacagcctggaaggtccctgagactctcctgtgcagcctctggattcaccttttagcagctatgccatgacctgggtccgccaggctccagggaaggggctggcgtggggtctcaggtattagtggtagtggtggaagcacatactacgcagactccgtgaagggccggttcaccatctccagagacaattccaagaacacgctgtatctgcaaatgaacagcctgagagccgaggacacggccgtatattactgtgcagcagtggctggcacaggagcatacttactttgactacgtggggccagggaaccctggtccaccgtctcctcacgcctccaccaacgggcccactccggtccttcccccgtcggccaccctccctaccaacgacgcacccgtcgtcgggggcacgacgccggcccgtcgggctcggccgtgggtcgaacgggtaccttaccgttcccgtacggttaccggttcgacgttcggagggccggggcgtggggaccgg

SEQ ID NO: 27417 - DNA, 618 bp, Homo sapiens
  misc_feature: GYAE6OF01DI8P7.13.67.G01.1.454.CMB.1.raw
  modified_base (242)..(242): a, c, t, g, unknown or other
  misc_feature (242)..(242): n is a, c, g, or t
  modified_base (323)..(323): a, c, t, g, unknown or other
  misc_feature (323)..(323): n is a, c, g, or t
  modified_base (385)..(385): a, c, t, g, unknown or other
  misc_feature (385)..(385): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgagacgggccaccatcaactgcaagtccagccagagttgttttanacagcctaccaacaataagtacttcttagtcttggtaccagacaagaaaccaggacacgcctactagctgctctattacgnggcatactagtaccggagtccggggtcctgtaccagtcgaggtcggcgacggtcgggtacgnggggactagtactttcgaccttcctacctaccactacacgctacgccctaggtacaggtctacggaagtgtaggttacggtacttagtttacttacgtagtctagtaacgtaatttacttaacgttacgtaccttcccgtacggacgttacctacgttaccgtttacgggacgggtaacgggtacccgtaagggtacgtacggtactaaccggaaacggtacgtgggtaccgg

SEQ ID NO: 27418 - DNA, 155 bp, Homo sapiens
  misc_feature: GYAE6OF01B2I8U.13.67.G01.1.454.CMB.1.raw
  modified_base (155)..(155): a, c, t, g, unknown or other
  misc_feature (155)..(155): n is a, c, g, or t
tcagtcacgtactacacgaccggtgctcgatttagagtatacatattgggtttgtggaccaagctggacatcaaacgaactgtggctgcaccatctgtcttcatcttcccgccatctgatagtacgtgactgagcgggctggcaaggcgcatagn

SEQ ID NO: 27419 - DNA, 497 bp, Homo sapiens
  misc_feature: GYAE6OF01E4B04.13.67.G01.1.454.CMB.1.raw
  modified_base (468)..(468): a, c, t, g, unknown or other
  misc_feature (468)..(468): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctctaagctgctcatttactggcatctatccgggaatccggggtccctgaccgattcagtgcagcgggtctggacagattcactctcaccatcagcagctgcaggctgaagatgtgctagtttatacgtgtcagactaatattatacgtactcctcgagctcacgtttcggacggngggaccaggtgagacacaacgactgtcgg

SEQ ID NO: 27420 - DNA, 734 bp, Homo sapiens
  misc_feature: GYAE6OF01D55NH.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtcgcccgacggggacatcgtgatcgacccagtctccagacctcccgtggctgtgtctcgtgggcgagacgggccaccatcaactgaccaacgtccagccagtgttagttttacacgagcctaaccaaataaataaacgtaacctttgttacgtccgttacggtaccagaccaaacggaaaccgaggacccacgtacccctaccgtaaggtccttaggacccttacgttacgtttacgtgggacctaacgttacgttaacggtcccggggtaacgttccccgggggtaccctacggtacccgtagttcggagggttcggaccgtacgggtccgggttacgtacgggtaactacggtttacttccaccgttccgtaacccacctacgtacggaccgtacgacggtacccgtaggaccgagggtacgtaaggaacgtgtggttacgagttttagttaacgtcgtgtacagttaattaagtttaacgttacgtacccgttcccacggttccggacttcccgttaaccggttccgggtacgggcgggtaaaccggtacggaagggttacggaactacgaacccggtaaacggtgtcggtacg

SEQ ID NO: 27421 - DNA, 634 bp, Homo sapiens
  misc_feature: GYAE6OF01AXS56.13.67.G01.1.454.CMB.1.raw
  modified_base (241)..(241): a, c, t, g, unknown or other
  misc_feature (241)..(241): n is a, c, g, or t
  modified_base (322)..(322): a, c, t, g, unknown or other
  misc_feature (322)..(322): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagacctccctggctgtgtctctgggcgaggagggccaccatcaactgcaagtccagccagagttgttttanacagctaccaacaataagaacttcttagtcttggtaccagacaagaaaccaggacacgcctctaagctgctacatttacgnggctatctagtccgggaacgtcccggggtccctgaccgtattccgaggtcggcgaggtccggggtcgtaggggactaggtactttccacttcctaccacctatccgagccagcctgacgacggctaggaagagtgggtaggtacgttaagttttacttacgtaggttacaaggtactaaattaattaacgtacgttaccgtcccgtaccggtacgtccgttaccgttaccggtttcggggacgggtacggggtaacccggtaaggggtacggtaacggtaacgtaaccgaaaaccgggtagttcgggtacgg

SEQ ID NO: 27422 - DNA, 154 bp, Homo sapiens
  misc_feature: GYAE6OF01DEWBA.13.67.G01.1.454.CMB.1.raw
tcagtcacgtactacacgaccggtgctcgatttagagtatacatattgggtttggggaccaagctggacatcaaacgaactgtggctgcaccatctgtcttcatcttcccgccatctgatagtacgtgactgagcgggctggcaaggcgcatag

SEQ ID NO: 27423 - DNA, 575 bp, Homo sapiens
  misc_feature: GYAE6OF01EIGZP.13.67.G01.1.454.CMB.1.raw
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
  modified_base (453)..(453): a, c, t, g, unknown or other
  misc_feature (453)..(453): n is a, c, g, or t
tcagtcacgtactacacgaccggtgctcgatttagagtatacatattgggtctggggggggcttggtccagcctggggggtccctgagactctcctgtgcagcctctggattcactttttagtaggtattggatgggttgggtccgccagactccagagaagggactggagtgggtggccaacataaaaggaagatggaagtgaaagatactatgtggactctgtgaagggccattcaccatctccagagacaacgccaaagaactcactgtatctgcagatgaccagcctgagagtcgaggatacggctgtgtattattgtgcgagagagtggggcacgactattttgagaggtgtacgtggggccagggacgcccccggtcacccgtctcctcacgccctccaccgacgggcccatccggtccttccccgnggccnccctgcctccaggcnccaccgtccgagcgccacgacggccggtcccgtggggcctcggcccttgggtaccaacggccttaccgtttcccgtaggttacggtgactggaggccgggtctgggaccaagggcgcgtaag

SEQ ID NO: 27424 - DNA, 571 bp, Homo sapiens
  misc_feature: GYAE6OF01EN85V.13.67.G01.1.454.CMB.1.raw
  modified_base (242)..(242): a, c, t, g, unknown or other
  misc_feature (242)..(242): n is a, c, g, or t
  modified_base (327)..(327): a, c, t, g, unknown or other
  misc_feature (327)..(327): n is a, c, g, or t
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
  modified_base (427)..(427): a, c, t, g, unknown or other
  misc_feature (427)..(427): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacggccaccatcaactgcaagtccagccagtagttgttttanacagctaccaaacaataagaacttcttagcttaggtaccagacaacgaaaaccaggacacgcctacctaagctgctcatttacgnggcatctagtccggaactccggggtccngaccgattcagtgacaggcggtcnggactagtattcactctcacctatcagcagcctgcaggtctagaagtntggtagtacttagtttatacgtgtacgagtactaattattacgtacgttacctccgtaccgtacgtccttacgttacggtttcgggaccgggtaacgggacccgtaagggtcggaacgtaacgtaacgaaacgtagtggtacgg

SEQ ID NO: 27425 - DNA, 602 bp, Homo sapiens
  misc_feature: GYAE6OF01B03F6.13.67.G01.1.454.CMB.1.raw
  modified_base (325)..(325): a, c, t, g, unknown or other
  misc_feature (325)..(325): n is a, c, g, or t
  modified_base (358)..(358): a, c, t, g, unknown or other
  misc_feature (358)..(358): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgaggagggcccaccatcaactgcaagtccagccagtagttgttttatacagctaccaaacaataagaacttcttagcttggtaccagacagaaaccaggacacgcctacctaagctgctacatttacngggcattctacgtccgggaactccggggtcccngaccgagttcagtcggcaggtcgggtcgtagggactaggtactttcactcgtaccaacctatcagcacgtcctcgacgaggtcgtacggaaagtagtaggtcggtacttagttttacttaacgtcgtacgacgtactaattaagttaacttacgtacctcccgtaccgacggtaccttcgtacggtttcggacgggtaacgggacgaagggtacggtaagactaacgaaacgtacgtggtacgg

SEQ ID NO: 27426 - DNA, 671 bp, Homo sapiens
  misc_feature: GYAE6OF01AXNLC.13.67.G01.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (326)..(326): a, c, t, g, unknown or other
  misc_feature (326)..(326): n is a, c, g, or t
tcagtcacgtactacacgaccggtgctcgatttagagtatacatattgggtttgggggaggctacaacaggcaggcaggggcagcaagatggtgttgcagacccaggtcttcatttctctgttgctctggatctctggtgcccacggggacatcgtgatgacccagtctccagactccctggctgtgtctcgtgggcgagngggccaccatcaactgcaagtccagccagagttgttttanacagctaccaacaataagtaacttcttagcgttggacctagacaagaaaccaggacacgcctacctaagctgctactatttacgnggacatctacgtacggacgtccggggtccctgaccgattcgaggtcggacgagcggggtacgtgggactaacggtctttacgaccgttcctacctaccgtatccgacgctacgtccgtaggaccgacggtacgtacgaaagtacgtaggttacggtacttaacgttttacttacgttaggttaccaagttacttaaattacgtttaacgtaccgttaccgtaccgttacccgggtacgttacccgttaccgtttaccggttacgggtaccggggtaacgggtaacccggtaaggggtacggtaacggtaacgttaaccgaaaaccggtacgttcgggtaaccggg

SEQ ID NO: 27427 - DNA, 635 bp, Homo sapiens
  misc_feature: GYAE6OF01CD03P.13.67.G01.1.454.CMB.1.raw
  modified_base (237)..(237): a, c, t, g, unknown or other
  misc_feature (237)..(237): n is a, c, g, or t
  modified_base (409)..(409): a, c, t, g, unknown or other
  misc_feature (409)..(409): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgaggggccaccatcaactgcaagtccagccagagtgttttanacagctaccaacaataagaactttcttagcttaggtaccagacaagaaaccaggaaccagccctactaagctgctcatttaccgtgggctactctagtaccgggtaacgtcccggggttccctagtacccgatttccgagtcgggacgacgggcggtgtcggggacaacgtnttaccacgttctcactactcgaagtcacgtcctgacgagggtacaggtaacggattggtcggtactaagttttaacgttacgttaggactaggaccttaattaacgtttaattaaccggttactaccccggtcgaacggttccctacgtaccggtttacgggacgggtaccgggtaacgaaggggtacgaggtaactaccggtaaactacggtaggttcggtaccg

SEQ ID NO: 27428 - DNA, 770 bp, Homo sapiens
  misc_feature: GYAE6OF01AYJG0.13.67.G01.1.454.CMB.1.raw
  modified_base (244)..(244): a, c, t, g, unknown or other
  misc_feature (244)..(244): n is a, c, g, or t
tcagtcacgtactacacgaccggtgctcgatttagagtatacatattgggtttgggggagctacaacaggcaggcagggggcagcaagatggtgttgcagacccaggtcttcatttctctgttgctctggatctctggtgcccgacgggacatcgtgatcgacccagtctccagactccctggctgtgtctcgtgggcgaggacgggccacatcaactgacaagtccagccagagttgttttanacacgcctaccaaactaaataagtaactttctacgtcttacggtacacgacaacgaaaccgaggaccacggtcctaccgtaagcctcgactactacgtttacgtaggactagttcgtacggtaccgggtaaccgttcccgggggtacctacggtaaccgtagttaccgaggtcggacgtacgggtaccggggttacgtacggggtaacgtacgttacttttaccggacttccgtacctacctacgtacgaaccgaccgtaccgaccggtgaccgtaacgggtcgttaacggaaggtacggttaggtaacggttacttaaggttttacgttacgttacgtaccgttaacggtaacttaaacgtttaacgttaactttaaccggttacccgttacccgtaaccgggtaccgtacccgtttacccggttaaccgggtttaccggggaacggggtaacgggtaacccgggttaagggaaccggtaacgggtaaccgtaaacgggttaaacccgtacggttgggtaccggg

SEQ ID NO: 27429 - DNA, 625 bp, Homo sapiens
  misc_feature: GYAE6OF01EODTV.13.67.G01.1.454.CMB.1.raw
  modified_base (197)..(197): a, c, t, g, unknown or other
  misc_feature (197)..(197): n is a, c, g, or t
  modified_base (261)..(261): a, c, t, g, unknown or other
  misc_feature (261)..(261): n is a, c, g, or t
  modified_base (342)..(342): a, c, t, g, unknown or other
  misc_feature (342)..(342): n is a, c, g, or t
  modified_base (376)..(376): a, c, t, g, unknown or other
  misc_feature (376)..(376): n is a, c, g, or t
  modified_base (424)..(424): a, c, t, g, unknown or other
  misc_feature (424)..(424): n is a, c, g, or t
tcagtcacgtactacacgaccggtgctcgatttagagtatacatattgggtttgggggggagaggagccccagccctgagagttcccacgtgttgccattccggtgatcagcgctgaacacagacggacctcgccatggagtttgggctgagctgggttttccttgttgctatttaaaggtgtcagtgtgaagtgcngctggtggagtcgtggggagcttggacagcctggcggtcctgagactctcctgtcgtagtttcngggtctacacgtttgtgatcgtgcctatgcactggtccaccaaagtccgagggagggcctggagtggctgagtatttacgngggaacagtagaaagaacgttaggatgcgtactntggtagagggtccattcacatctcagacgacaacgcaagaactccgtntttgacaatacaactagtactaagtaaacgtagacggtactaccggtaccttaatacgtttaactgttaactaaccgtaaaagtaaaaggttaaagtaaacggttcggggttaacgtaccgtaacgttaaaccgggtcggggacccgtagggacggtaaccccgttggtacccgtaacccggttcctcccgtcgaacccgg

SEQ ID NO: 27430 - DNA, 564 bp, Homo sapiens
  misc_feature: GYAE6OF01EEV6V.13.67.G01.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaaacaataagaacttctagcttggtaccagcaagaaaccaggacagcctcctaagctgctctatttacnggcatctagtccgggaactccggggtcctgaccgattcaggtcggcaggcgggtctgggacagtatttcgactctacaccatcagcacgcctgcaggctagaacgtagtgtggtactagtttacttacgtgtacagtactaattaattagtacgtacctccgtaccgacgtcctccgtacggtttcgggacgggtaacgggaaccgtaagggtacggtaacgaacgtaccgaaaacgtagtggtaccgg

SEQ ID NO: 27431 - DNA, 569 bp, Homo sapiens
  misc_feature: GYAE6OF01EIX4A.13.67.G01.1.454.CMB.1.raw
  modified_base (332)..(332): a, c, t, g, unknown or other
  misc_feature (332)..(332): n is a, c, g, or t
  modified_base (566)..(566): a, c, t, g, unknown or other
  misc_feature (566)..(566): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaacaataagaacttctaagcttggtaccagcagaaaccaggacagcctcctaagctagctacattttacgtgggctattaccgntaacgtacccgggtaccgtcccgggtacctgtacccgtagtcgagtcggacgtcggtcgggtacgtacggtactacgtacttctactcctacaccatcacgctacgcctaggcaggctagtagtagtgtcgtacttagttatactgtacgaagtataatattactacgtacctccgtaccgacgtcgttacgtacgttacggcggacggacgaggtacgaagacgtacaaacgngtg

SEQ ID NO: 27432 - DNA, 950 bp, Homo sapiens
  misc_feature: GYAE6OF01A5J7F.13.67.G01.1.454.CMB.1.raw
tcagtcacgtactacacgaccggtgctcgatttagagtatacatattgggtctgggggaggcttggtacagcctggaaggtccctgagactctcctgtgcagcctctggattcacctttagcaactatgccatgagctgggtccgccaggctccgaggggaaggggctgggagtgggtctcaactattagtgctagtggtgcccaccacatactacgcagactccgtgaagggccattcaccatctccagagacaattccaagaacaggtgtatcttacaatgaacgacctgagagtacgaggacgacggccgtactattactggttagacgaaagagtgacaaggacggacggggtaccccccgtaaggtcgggggacccgtggggttacgggaaggggttttccgtttacggttttacgggtaccgttacgggttaccggggttaccggggggtaacccggtaaccggggggttaaacccccgttacggggttacccgttaaacccccgggttaccgtttaccccccgtttacggttccccgggtaaccccccgttacccccggtaaaaccccgggttaaacccgggggacccccccgtttaaaccgggtttacccccggggttttaccccccgttttaccccccccccgggttaccggggtcccccgggttaaccccccggtttacccgggttcccccggtttaaccccccggaaacggggggttacccgtaacccccggttaaaccccgggtttacccccgggttaaacgggtaacccggtacccgaaacccgggaaccgggtccccggggtaaccccccggttcgggggccccggttaccggtaccccggttaccggggtaaccgtaaaccgggttaacccgtttaacccgtttacccgttaacgggttacccgttaccgggtaccgtttacgggaacccggggg

SEQ ID NO: 27433 - DNA, 535 bp, Homo sapiens
  misc_feature: GYAE6OF01B2X6B.13.67.G01.1.454.CMB.1.raw
  modified_base (308)..(308): a, c, t, g, unknown or other
  misc_feature (308)..(308): n is a, c, g, or t
  modified_base (450)..(450): a, c, t, g, unknown or other
  misc_feature (450)..(450): n is a, c, g, or t
tcagtcacgtactacacgaccggtgctcgatttagagtatacatattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtcccctgagactctcctgtgcagcctctggattcaccgtcagtcacacctacatgagctgggtcccnccaggctccgagggaaggggctgggagtgcgtctcttttattatagtagtggtagtacatactccgcagactccgtgaggggcattcaccatctcagacgacaattccaaagaaccacgtctgttttcttacaaatgaaacngcctgagagccgatgacacggccgtgtattacgtgtgcgtagagagtcggggacccacggtaacgttactacgctgtgggtaccg

SEQ ID NO: 27434 - DNA, 776 bp, Homo sapiens
  misc_feature: GYAE6OF01CFQ1I.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtcgcccgacgggacatcgtgatgaccagtctccagacctcctggctgtgtctcgtggcgagacggccaccatacaactgacaacgtccagcagacgttacgttttacacgacgtacctaccaaactaaataaacgtaacctttacttagacgtttacggtaaccacggaccaacgaaaccgaggaaccaacggtccctacgtaacgcttacgccttacttaacgtttaacgtcgggtacctacgttaccgtaaccggttaacccggggtaacgttacccccgggggttccctacggtaacccgtacgtttaccgaggtaccggacgtacggggtccgggtaccggtagggtaacgtacgtttacgtttaccaccgttacctccaaacctcgttaccaacgtccaccgtcggtaacgcggacggtcgtaagaaagtcgttcgtacgtagtttaattttacgtccgtataccgtaacgttattaaacgtttacgtttaacgtaccggttaacctcccggtccggtaaacgtcccgtttaacgggttacccgggtttccggggaacggggttaaaccggtaacccgggtaagggtacgtaaacgttaaaacggaccgtaaaacggtagttccgggttaccgg

SEQ ID NO: 27435 - DNA, 771 bp, Homo sapiens
  misc_feature: GYAE6OF01DSG00.13.67.G01.1.454.CMB.1.raw
  modified_base (254)..(254): a, c, t, g, unknown or other
  misc_feature (254)..(254): n is a, c, g, or t
  modified_base (394)..(394): a, c, t, g, unknown or other
  misc_feature (394)..(394): n is a, c, g, or t
  modified_base (690)..(690): a, c, t, g, unknown or other
  misc_feature (690)..(690): n is a, c, g, or t
tcagtcacgtactacacgaccggtgctcgatttagagtatacatattgggtttgggggggagaggagccccagccctgagattcccacgtgttgccattcggtgatcagcgctgaacacagaggactcgccatgggtagtttgggctgagtcgttgggtttttccttgttgcttaagtttttaaaaaggtgtaccagtgtgaggtgcagctggtagagtcgtggggaggtgtggtacggccgtgggggtccctnacgtctctctgtcgactaacctcgtggtattcgagtagtttgatggtagtacgtggactatacgacggtcgggtcccaccctaaccgtccggaaggggacgggtctagcggtaggtggtcctcgttaggtaaactaaagnggtaagtggtacgcccgtagactaacgtaaacttgtacgactaaggtacctacgtaggtaacgggaacggggtacccttaactttaccccaacgttaccttcccgtaaccgaaggtaaccggtacgtaaccgggtaccgaacccggtaaacgaaccccgtttacccgtaactaccgtttcgaaacgtaaacggtaaaacgtaaccgaaacggttacggtaacccgggtacggtaacggggtacccggaaacggtcccgttaaccgggtttccgttaaggttttaccgtttaacggnggttacgtacgggttaaggtacgtcggtagggttcggtacgttaggttaaccctcgagttaacgggcgtccgggttacggg

SEQ ID NO: 27436 - DNA, 708 bp, Homo sapiens
  misc_feature: GYAE6OF01DM4LQ.13.67.G01.1.454.CMB.1.raw
  modified_base (571)..(571): a, c, t, g, unknown or other
  misc_feature (571)..(571): n is a, c, g, or t
  modified_base (670)..(670): a, c, t, g, unknown or other
  misc_feature (670)..(670): n is a, c, g, or t
tcagtcacgtactacacgaccggtgctcgatttagagtatacatattgggtttgggggggagaggagccccagccctgagattcccacgtgttgccattcggtgatcagcgctgaacacagaggactcgccatggagtttgggctgagctgggttttccttgttgctattttaaaaggtgcccagtgtgaggtgcagctggtggagtcgtgggaggaggcttgatccagccgtgggggtccctgagactctcctgtgcacgcctcgtcggttcaccgtcagtcaccacctacatgagtcgtcgggtccgccgaggccgtaccggaagggggaacggggcgtgggtaggtcggtccgttcgtttactttttaagtttagttaaggttaggttaggttaagttaaccgtaacgttaccgtccgacgaacgtaccgttaccgggtagggacggggtacccgtaacgtttccaacccgtaacttcccgtaacccggaaggtaacgaaccttaaacgtttaccccgaaaagtaacctaccggtctttacgttttacctaaacaaaagttcgaaacncggtacctaggaacgacgaccgtagtcgaccgtacggtccgttaattacgttacgtggtcgacgaggagtacggccgggaacccaaggttaaaccgttnaaccgtctaagtcgggtaacgtcgggcggggaaacccg

SEQ ID NO: 27437 - DNA, 735 bp, Homo sapiens
  misc_feature: GYAE6OF01ACXTW.13.67.G01.1.454.CMB.1.raw
  modified_base (362)..(362): a, c, t, g, unknown or other
  misc_feature (362)..(362): n is a, c, g, or t
  modified_base (433)..(433): a, c, t, g, unknown or other
  misc_feature (433)..(433): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccaggggacatcgtgatgacccagtctccagacctccctggctgtgtctcgtgggcgagagggccaccatccaactgacaagtccagccgagtagttgttttaacacacgtactaccaaactaataacggtaactttcttaagtcctttaggacctacgacgaacgtaaaccagggaaccacgtccctaccgtaagcctcgtccttacgtacgttttaccgngggactacgtccgtacgttaccgggaacggttcccgggtaccgtacggaacccgtattcgaggtcgggacncggtacggggtctacgggactagtacgtttcacttcacgtacccgtagtcgaacggcctaggacccgttggaccggacggtcgtaagggtaacgtacgttgggtaccgtacgtttaacggtttacccttacggtacgttaaccggacgttaacgttacgtttaacttaccggtacttaccccggtcggtaaccggtacggttcccttaacggttcggttacccggggaagggttaaccgggaaccggtaagggtcggtaaacggtaccgttaaacggaaaccggttaggtccgggttaccgg

SEQ ID NO: 27438 - DNA, 605 bp, Homo sapiens
  misc_feature: GYAE6OF01AMJIJ.13.67.G01.1.454.CMB.1.raw
  modified_base (244)..(244): a, c, t, g, unknown or other
  misc_feature (244)..(244): n is a, c, g, or t
  modified_base (330)..(330): a, c, t, g, unknown or other
  misc_feature (330)..(330): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatcgacccagtctccagactccctggctgtgtctcgtgggcgaggagggccaccatcaactgacaagtccagccagtagttgttttanacagctaccaacaataagaaccttcttagcttggtaccagacaagaaaccaggaccagccctacctaagctgcctcattttaccgngggctatcctagtaccgggaagtcccggggtcctagacccgtagttcgaggtggcaggtcgggtctgggactaggtacttcgactccgtacacatcacgctagcctgacgacggtctagaacgtgtaggtcgtcgtaagttttacttacgtagtactacgtactaattacttaatacgttacctccgtcggacgtccttacggtccgttacgggacggggtaaccggtacggtaagggtacgacggtaactaacgaaacggtacgttggtaccgg

SEQ ID NO: 27439 - DNA, 568 bp, Homo sapiens
  misc_feature: GYAE6OF01B865I.13.67.G01.1.454.CMB.1.raw
  modified_base (550)..(550): a, c, t, g, unknown or other
  misc_feature (550)..(550): n is a, c, g, or t
tcagtcacgtactacacgaccggtgctcgatttagagtatacatattgggtttgggggggagaggagccccagccctgagattcccacgtgttgccattcggtgatcagcgctgaacacagaggactcgccatggagtttgggctgagctgggttttccttgttgctattttaaaaggtgtccagtgtgaagtgcagctggtggagtcgtgggggaggcttggtacagcctggcaggtccctgagactctcctgtgcagcctctggattcattctttgatgattatgccatgcacgtgggtccgcaacgcctaccgaggggaaggccgtagggagtgggtctcgaggttatttaggttaggaattaggtagtaacagtaggctagtgcggacttcgtggtaggaacgggtccgtagttaccacctactctaccagacaaccaacgaccaagaaccctccctagtactactagacaatagaactagtctagagagcgtagagacgacggtccttagtacttacgtgtacgtacgaaacggtctagttacgngtagtcgtcgtcggttcc

SEQ ID NO: 27440 - DNA, 890 bp, Homo sapiens
  misc_feature: GYAE6OF01B9WN1.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgacggggacatcgtgatcgacccagtctccagacctcccgtggctgtcgtctcgtgggcgaggacgggccaccactacaacgtgactaacggtccagaccaggtagtttacgttttaactacgacgtcctaccaaactaaagttaaacggtaacctttacttaaggtccgtttacggtaaccagaccgtaaacggaaaacccgacgggaacctacgtacccgttaaccgtaacgtcctacgtaccttacttaacgtttttaaccggtcggggtacctaacgtttaccgtaaccggtacccggggaaccggtttaccccgggggttacccttaccggtaacccggttacgttacccggtagggttaccgggtaccggtaaggggttcccgggggttaccggttaaccggggaaaccgttaacgggtttaccgttttaccgtacccgtttacccgtacccgtaaacccgttacgtacccgaacggccgtacccggtacccgtcggtaccggtacgggtacgttaagggaacggttacggttgggttaacgttaccggttttaaacgtttacgtttaaccgttacggtaacgtacggtaaactttaagttacgttaacgttaccgttaacccggttccgtaaccgggtcgttacccgttaccggtttaccgggttcggggaacgggtaacgggaacccggttaagggtacgtaaccggtaagtaaacccgtaaagtaccggttggtaccgg

SEQ ID NO: 27441 - DNA, 634 bp, Homo sapiens
  misc_feature: GYAE6OF01C9P4T.13.67.G01.1.454.CMB.1.raw
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (468)..(468): a, c, t, g, unknown or other
  misc_feature (468)..(468): n is a, c, g, or t
  modified_base (574)..(574): a, c, t, g, unknown or other
  misc_feature (574)..(574): n is a, c, g, or t
tcagtcacgtactacacgaccggtgctcgatttagagtatacatattgggtttgggggggagaggagccccagccctgagattcccacgtgttgccattcggtgatcagcgctgaacacagaggactcgccatggagtttgggctgagcttgggtttttccttgttgcttaattttaaaaggtgtccagtgtgaggtgcagctggtagagtcgtgggggaggtggtggtacggccgtggggggtccctnagactctctgtgcactntgatcagtattgatgagtagtggacatacacgtcgggtcccaccaaccgtccggaggggaggctgcgtaggtggtctgtaggtaataacgtggaatggtcaccagactaactaacttgagcagtactgtggaggacgggtcctacgttaccaacctatcctaccgaaggacacgtaggtcgaaccggtataaccctccgtanacgtcgtaagaactaaggtcgaacgtggtaccgtacgggtagtaccggaacggtacctaccgggttctttaggttacctttcgaggttacggcggttaaacgggtnacggtagggttcgtacgttacgggttaaccttacgacgttagtcggggtccgtaccgggg

SEQ ID NO: 27442 - DNA, 635 bp, Homo sapiens
  misc_feature: GYAE6OF01ED9R3.13.67.G01.1.454.CMB.1.raw
  modified_base (491)..(491): a, c, t, g, unknown or other
  misc_feature (491)..(491): n is a, c, g, or t
tcagtcacgtactacacgaccggtgctcgatttagagtatacatattgggtttggggaggtctcagagaggagccttagccctggactccaaggcctttccacttggtgatcagcactgagcacagaggactcaccatggaattggggctgagctgggttttccttgttgctattttaaaaggtgcccagtgtgaggtgcagctggtggagtcgtggaggaggcttgatccagccgtggggggtccctgagactctcctgtgcacgcctgtcgggttccaccgtcacgtcacacctacatgagcgtcgggtccgccgacggcctccggaggggacggggcgtggagtgtcgttcttcttttattagtagtagtggtagtacataccgtccgacacgacgtccggaggacgggtcctacgttaccaccgtactcctaccaaggaactaactaacttaacccaaagaacccacggtctttagtttaccttaanaaattcgaaaccgtcgaccctaggaacgcgacccgtagtacggaccgtaccgggtcgttagttaacttcgtggacggcggaaggtacggacgggtcccgggaaccccaacggtaacgttaccaacgtctaggtcggtaaccggg

SEQ ID NO: 27443 - DNA, 665 bp, Homo sapiens
  misc_feature: GYAE6OF01B6QCD.13.67.G01.1.454.CMB.1.raw
  modified_base (243)..(243): a, c, t, g, unknown or other
  misc_feature (243)..(243): n is a, c, g, or t
  modified_base (334)..(334): a, c, t, g, unknown or other
  misc_feature (334)..(334): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtcctcgtgggcgagacgggccaccagtcaactgcaagtccagccagagttgttttanacagtcctaccaaacaataacgtaacttcttagcgttacggtaccagacacgaaaccaggcacgcctaccgtaagctgctactatttacgnggctatccgtaagtcccgggaatcccggggtacctaggacccgtattcgacggtcggacgaggtcgggtcgtacgggactaggttactttacgaccttacgtacctacccgtactaccgtacgacccgtaacgcccgttacggaccgtagggtaaccgttaggaacggtagttacggtacgggtaacgtttacggttttaacttacgtagtacgtaacgtaactaatttaattacgttacgtactaccccgtacggacgttaccgtcgtacggttacggacgggtaccggaacgtagggtacgagacgtaaccgaaacgttcgtaggtcgg

SEQ ID NO: 27444 - DNA, 781 bp, Homo sapiens
  misc_feature: GYAE6OF01BKQM0.13.67.G01.1.454.CMB.1.raw
  modified_base (248)..(248): a, c, t, g, unknown or other
  misc_feature (248)..(248): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgaggacggccacatcaactgacaagtccagccagtagttgttttanacacgtcctaaccaaactaaataaacgtaactttcttacgcgtttacggaaccagaccaaacgaaaccgacggtacacgtacctaccgtaagctcgtacctactaacgttttacgcgggtactaagttccgttaacggtacccggggtaaccgtccccgggggttaaccctacgggtaaacccgttcgttacggacggttcgggacgtagggtccggggtacggtacgggaactaacgttacgtttccaaccttccgtaccgtaacctacgtaccgaacgtaccgtacgtaccgtacggacgacggtacgtaaggaacgtgtaggtacggtaagtttacgttttaacgttacgtaggttaccgtaacgtaacgttaaatttaacggttaacttaccgttacctaccggttaccggtacggttacccttacggttaccgggtttaccgggaacgggtaaccgggtaaccggttaaggggtaaccggtaacggtaacccgttaaacggtaaaccggtaacggtcgggttaaccgg

SEQ ID NO: 27445 - DNA, 837 bp, Homo sapiens
  misc_feature: GYAE6OF01B3V44.13.67.G01.1.454.CMB.1.raw
  modified_base (409)..(409): a, c, t, g, unknown or other
  misc_feature (409)..(409): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctgacggtctcgtggtccgacccggacgggactacgtcgtagacgtaccgacctacgtcctaccgacgtaccctcccgtggtctggttcgtccgtcggtcgggacggacggaccggacccaacctataccgaacgtccgaacgtaaccgtaccgacgtccgtaagttacgtttagtttaacgacgtactaccctaacctaaaacgtaaagttaaccgttaacctttcgtaaccggttcgttaaccggaaccgacgtaaacgaaaccgaaaccggtacggtaccncccggtaaccctaacggtaacgtccgttaccgtaccttagttacgtttacggtacgtaccttacgttaccggtaacccggtaccggggtaaccggttcccggggtacccaggtaccctttaggacggtacgggtcgacgggtcgttccgggtcgtacggtaacgttacttacgttaccgtactaccgtacctacgacttacgacgtaccgtacgtccgtacgtacggtacgtacgttaggacgttagtacggtacgttacgttacgtttacgtacgtacgtacgaacgttaactaacgtttaagtttacctacgttacccgttaccgtaaccgtacgttaccttaccggtaccgggttacgggaccgggtacggaaccggttagggaacgtaacgtaacggtaaactaccggttaacgtacggtacgg

SEQ ID NO: 27446 - DNA, 659 bp, Homo sapiens
  misc_feature: GYAE6OF01BRCZE.13.67.G01.1.454.CMB.1.raw
  modified_base (247)..(247): a, c, t, g, unknown or other
  misc_feature (247)..(247): n is a, c, g, or t
  modified_base (596)..(596): a, c, t, g, unknown or other
  misc_feature (596)..(596): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctcggatctcgtggtgcccgacggggacatcgtgatcgacccagtctcagactcccgtggctggtgtctcgtgggcgaggacgggccacatcgaactgacagtccagccagagttgttttanacagctaccaacaaataacgtaactttacgttacgtcgtttacggtaccaagtactaacggaaaaccaggtaaccacggtcccgtacctaaacggcctacgtctaccgtaagttttaccgtgggtctaacgttacgtaaccgtacgggaaccgttcccggggtaccacggtaacgtaagttacaggtcggacgacggtcgggtcgtagggactaggtacttttcgacttccaccactacgtcacgtcacgtccgagacgagtaccgtaagaacgtgtaggtacgtacttagtttactaagtgtacgtacgtataattacgttagttacctaccgtccgtacgacgttcncgttaccggtagggacggtcggaacgttaggacggtaagtaccgaagtaacgtgtgtaccggg

SEQ ID NO: 27447 - DNA, 881 bp, Homo sapiens
  misc_feature: GYAE6OF01C7L10.13.67.G01.1.454.CMB.1.raw
  modified_base (196)..(196): a, c, t, g, unknown or other
  misc_feature (196)..(196): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtcgcccacggggacatcgtgatcgacccagtctccagacctcccgtggctgtgtctcgngggcgagacggccactatacaactgacaacgtccacgaccagtagtttagttttacacagaccctaccaaaactaaataaacgttaacctttacgttacgtccgtttacggtaacccagaccaaacgaaaccccgaggtaaccaccggtacccctaccgtaacgcgttacgtaccttacttaagtttacgtacgggtacctaacgttaccgtaaccgggtaccccgggtaacggttacccccgggggttccctaaccgggtacccgttaacgttaccggaagggtcgggaccggtacggggtccggggttaccgggtacgggaaccgtaacggtttactttaccgtaccgttacctacccgacccgttaactaccgaacgttacacccggtccgtaacggacccgtacgggtacgttaaggaaacggtagttacgggttacgggttaaccgttttaacgttttacgttaaccggttaccgttaacggtaaacgtaaccgtttaaagttttaacgtttaacgttaaccgttaacccgtttaccccggtaccgggtacggttcccttaacgggtttacccggtttaccgggggaaacccggggtaaacgggtaaacccgggtaagggttaaccggtaaacgggttaaaccctaaaccgggaaaccggttacgggttggtaacccggg

SEQ ID NO: 27448 - DNA, 710 bp, Homo sapiens
  misc_feature: GYAE6OF01BYFVK.13.67.G01.1.454.CMB.1.raw
  modified_base (253)..(253): a, c, t, g, unknown or other
  misc_feature (253)..(253): n is a, c, g, or t
  modified_base (330)..(330): a, c, t, g, unknown or other
  misc_feature (330)..(330): n is a, c, g, or t
  modified_base (364)..(364): a, c, t, g, unknown or other
  misc_feature (364)..(364): n is a, c, g, or t
tcagtcacgtactacacgaccggtgctcgatttagagtatacatattgggtttgggggagctacaacacggcaggcaggggcagcaagatggtgttgcagacccaggtcttcatttctctgttgctctggatctctggtcgcccgacggggacagtcgtgatcgacccagtctccagacctcccgtggctgtgtctcgtgggcgaggacggcctaacatcaactgacaagtccagccagtagtttgttttaanacagcctaccaaacgtaaataacgtaaccttcgttaacggtctttacggacctagacgtaaacgaaaccgaggaacncgtacctacgtaacgctcgcttactagtttacgnggactagtcgtaacggtaccgggtaacggttcccgggtctacggaccgtattcgacggtcgacggcggtacgggtacgtacgggtactaggtaccgtttcaccttcgtaccaactactccgagtcggaaccgtccgtagacggtacggtcgtaacggatacggtcgggtacgttacgttacgtttaactaacgttcgaaccgaagttacttaacgtttaacttaacgtaccgttaccgttccgtaacggtacgttacccgtaccgttacgggtaccggggacgggtaaccgggtaacgttaagggaacgtaacgaaccgttaacgaaacggttcggtcgtacccgg

SEQ ID NO: 27449 - DNA, 722 bp, Homo sapiens
  misc_feature: GYAE6OF01C306R.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatcgacccagtctccagacctcccgtgctgtgtctcgtgggcgagacggccaccatcaactgacaacgtccagccagtacgtttagttttacacgacgtacctaccaaaactaataaacggttaaccttttacgttacggtccgtttacggtaacccaaggaccaaacgtaaaacccgaggaacctacggtacccttaccgtaacgccgttgtaccttacttaacgtttacgtgggactacgtacgtacggtacccgggtaaccggttccccgggggtaccctacggtacccgtagttcgaggtcggcggtacgggtccgggtacggtacgggactagttactttacctacctccgtacctaccgtagtcacgcctacgtccgtacggcgtacggacgtaggaacgtgttggtacgttcttaacgtttactcgtacgtacgatacttaattattacgtacgtaccgtaccgtacggtacgtccttacggttaccggttaccggacggggtaacggaacccggtagggtacgtaacgtacctaacgaaacgttcggtggtaacccgg

SEQ ID NO: 27450 - DNA, 717 bp, Homo sapiens
  misc_feature: GYAE6OF01BV8OG.13.67.G01.1.454.CMB.1.raw
  modified_base (247)..(247): a, c, t, g, unknown or other
  misc_feature (247)..(247): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtcgcccgacggggacatcgtgatcgacccagtctccagacctcccgtggctgtgtctcgtgggcgaggacggccacatcaactgacaacgtccagccagtagttgtttanacgagcctaccaaacaagtaaacgtaacttctagtctttaggtaccagtacaagaaaccgaggaacacgcctaccgtaagtctacgtccttactacgttacgtgggactagttacgtacgtaccggggaacgttccccggggtacctaggaccgtacgttcgaggtcggacgtacgggtccgggtcgtagggactagttacttaccgaccttccgtacaccgtagtccgacggacacgtccgtagacgacggtcgaagtaacggtgtcggtacggtacgtttaacgttttacgtacgttagtaccgtaagtaacgttaaacgttagttaacgttacgtacccgttaccgtaccgggtaaccgttccttaccggttaccggttacccgggggaacgggtaacggggaacccgttaaggggtaccggtaaacgtaccggtaaaccgtaaaccggttcgggtggtaacccggg

SEQ ID NO: 27451 - DNA, 778 bp, Homo sapiens
  misc_feature: GYAE6OF01DYYH5.13.67.G01.1.454.CMB.1.raw
  modified_base (229)..(229): a, c, t, g, unknown or other
  misc_feature (229)..(229): n is a, c, g, or t
  modified_base (567)..(567): a, c, t, g, unknown or other
  misc_feature (567)..(567): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctcgtggtcgacccgacggggactatcggtgatacgaccctagtcctaccagtacctcccgtggctgtgtctcgtgggcgaggccgaccacatacacngtaccaacgtccacgacctaaggtacgtttagttttaacaccgtacgtacccttaaaccgaaaacgtaaacgttaaaacgttaaccttttacggttaacgttaccggtttaccggaaccaacgggtaaccaaaacggaaaaccccacgggtaaccctacccgtaccccgttaaccgtaacgtccgtaccgtaccttaactttacggttacggacgtacttaacgttacgtaaccgggttacccgggtaacggttccccggtaccgtacgtaccgtacgttacgagggtcgacgtcgggtaccggtgtacggactcgtactttccacttacgacctacngacgtactacgacgtcgtcgacgtacggtagacggtaagtacggtcgttacggtactttaagtacttacgacgtacgtaacttacgtaaatttacgtagttacccgtacgttaccggtacgtaccgttaccgttacgtacccgggttacggacgggtaacggtaccgaaggtacggtaacgtaaaccgtaacgtacggtaggtggtaccgg

SEQ ID NO: 27452 - DNA, 750 bp, Homo sapiens
  misc_feature: GYAE6OF01DH4CM.13.67.G01.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (366)..(366): a, c, t, g, unknown or other
  misc_feature (366)..(366): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtcgcccgacggggacatcgtgatcgacccacgtctccagacctcccgtggctgtcgtctcgtcgggcgaggacggccaccatacaacgtnacacgtccagccagtagttgtttanacgngacctaacaaacaattaaacgtacttacgttagtacgtttacggaaccacgacaaacgaaccgacggacacgtcctaacgaacgtctacgtcttacgtaacgtttaccgngggtaacacttaccgtaacggtacccggggtaaccggttcccggggtacctacggtaacccgtacgttacgtacgggcggcgacgggttacgggttccggtagggaaccgttagtttacgttaccgtacttcccgtaacctaaccctaccgttacacgtacgtaccggccgttacggacggaacggtacgtaaggtaaccggtaggttccggttaggtactttaagtttacgttacgtacgtacgtacggtacttaatttaacgtttactaacggttccgtacctacggtccgtaccgtcggttaacgggttacgggaccgggaaggtaaccggtacgggtacgaaacggtaacgtaaaccggaaacggttcgtgggtacccgg

SEQ ID NO: 27453 - DNA, 704 bp, Homo sapiens
  misc_feature: GYAE6OF01BCTWP.13.67.G01.1.454.CMB.1.raw
  modified_base (695)..(695): a, c, t, g, unknown or other
  misc_feature (695)..(695): n is a, c, g, or t
tcagtcacgtactacacgaccggtgctcgatttagagtatacatattgggtttgggggggagaggagccccagccctgagattcccacgtgttgccattcggtgatcagcgctgaacacagaggactcgccatggagtttgggctgagtcgttgggttttccttgttgtcttaagttttaaaaggtgtccagtgtgaggtgcagcgtggtagagtcgtgggggaggtggtggtaccggccggtcggggggtccctgagtacctcttccgtggtcgacctaaccgttcgtggtattcgagtatttgatgagtagtggactagtaccgacggtccgggtccgaacccaaaccgtccggaaggggaacggcctgccgtaggtcggtctacgtagtaagtaacgtaggacgtggtacgaccgtagactaacgtaacgttagacgtacacgttactcgtacggtaacggacgggtacctactaccgaaccttcgtacccgtaccgaaggaacgtacgtacggtaccgggaacctaaacgtacccgtacgttaacacgtttcaacgaacgtaaaatccggaaacgttcggtaccggtacggaacgttacggaacgtacccgttcggtactttaggttcttacgagggtccgtaggtaacgtgacgtcggtacgtcgttagtaccgacgaagtcggttcggnggtacgggg

SEQ ID NO: 27454 - DNA, 721 bp, Homo sapiens
  misc_feature: GYAE6OF01CLONH.13.67.G01.1.454.CMB.1.raw
  modified_base (255)..(255): a, c, t, g, unknown or other
  misc_feature (255)..(255): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtcgcccacggggacatcgtgatcgacccagtctccagacctcctggctggtcgtctcgtagggcgaggacgggccaaccactcaactgacaacgtccagccagtagttgttttacacngcctaccaacaataacgaacttcttagtcttggtaccagcaagaccaggacacgtcctactagctgctctattacgnggacntacgtacgtccgggaagtcccggggtcctagaccgtnttacgacggttcggacncgggtacgggtcgtagggaaccttaggtctttacgacctactccgacctacgtaccgagcaacgtcccgtggtaccggacggtacgtagtaacggtacgttcggtacggtacttaaccggtttttaacgtaccggttaacgtcgtaacgtaccgttaaattacgtttaaccgtaacgttacccgtcccggttaacccgggtcgtaacccgttaccggtttaccgggtttaccggggaacccggggtaaacggggtaaacccggtaacggggttcggaaaccgttacggtaaacccggtaaaaccgggttcgtaacggggtttaacccggg

SEQ ID NO: 27455 - DNA, 819 bp, Homo sapiens
  misc_feature: GYAE6OF01AIHOW.13.67.G01.1.454.CMB.1.raw
  modified_base (134)..(134): a, c, t, g, unknown or other
  misc_feature (134)..(134): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctntggtcgcccgacggggacatcgtgatcgacccagtcctccgagtacctcccgtggctcgtcgttcgtcggtgggacgacggacgggacccaaccactaccaacgtcgacgtaaccgtccgacgaccgtaaggttagtttcgttttaacaccgacgtacctaaccgaaataaacttaaacgttacctttccgttaagtccgtttacggaccgagtaaccgaaacgtaaacccggaggaccgaaccgtacccttaccgtaaacgccgttcgtacctttacgttaaccgttttacggacggtacctacgttaccggtacggtacccggggtaacccgttcccgggggtaccctacggtaaccgtattaccggacggtccggacgtacgggtcggttacggtacggtactacgttccttacccgtacgtacctaccgaaccgtacgtaccgtacgtccctaccggtaccgtacggacgtacggtacggtaacggtacggtaacgttcggtaacggtttacgttacgtttaacgttcgtacgtacgtaagtacttaagttaacttaccgtacgttaccgtcgtacccggttctaccgtaccggttccgggtacgggtaccgggtaacgggttaacggaacgggttaacgaaacgttaaccggtaaacgtaacgggtcggtacggttacgg

SEQ ID NO: 27456 - DNA, 629 bp, Homo sapiens
  misc_feature: GYAE6OF01B6LVS.13.67.G01.1.454.CMB.1.raw
  modified_base (244)..(244): a, c, t, g, unknown or other
  misc_feature (244)..(244): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcggccaccatcaactgacaagtccagccagtagttagttttanacagctaccaaacgaataagtaacttcttagcttacggtaccagacagaaaccaggacagcctacaagctagctactattacgtgcatcacgtccgggacgtccggggtcctggactattcgagtcggcgtacggcgggtactgggactagtacttcgactcctacgaccagtacacgtcacgctcgacgcggtacgtaaggtaacgtagttggtacgtagtttaagtttaacttcgtagtccgaacgttagtaaactttattaccgtacgttacccgtccgtaccgtacggtcccttacgtaccggtttcgggaacgggtaaccggtaaccggtaaggtacgggtaacgtaactaaccggtaaacgtaaaccggtggtaaccgg

SEQ ID NO: 27457 - DNA, 566 bp, Homo sapiens
  misc_feature: GYAE6OF01BBIY1.13.67.G01.1.454.CMB.1.raw
  modified_base (282)..(282): a, c, t, g, unknown or other
  misc_feature (282)..(282): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
tcagtcacgtactacacgaccggtgctcgatttagagtatacatattgggtctgggggggggcttggtccagccctgggggggtccctgagactctcctgtgcagcctctggattcacttttagtaggtattggatgggttgggtccgccagactccagagaagggactggagtgggtggccaaacataaaggaagatggaagtgaaagatactatgtggactctgtgaaggccattcaccatctcagagacaacgccaaagaacctcactgtaatctgcanatgaccagcctgagagtcgaggatacggctgtgtattattgtgtgagtattggcncattacttgactacgnggggccaagggaccctggtcaccgtctcctcaaccctccaacctaacggccatccgtcctccccctgacctacccctcctaccaacgacgccaacctcggtcgggcacgcgccgccgtggctcggcctggtacaacggacttaccgttacaacgtcgtacgacgtcgaggcgggactcgggacgaacgggcgtaccgtaatacggangatgng

SEQ ID NO: 27458 - DNA, 690 bp, Homo sapiens
  misc_feature: GYAE6OF01CHWOE.13.67.G01.1.454.CMB.1.raw
  modified_base (658)..(658): a, c, t, g, unknown or other
  misc_feature (658)..(658): n is a, c, g, or t
tcagtcacgtactacacgaccggtgctcgatttagagtatacatattgggtttggggaggtctcagagaggagccttagccctggactccaaggcctttccacttggtgatcagcactgagcacagaggactcaccatggaattggggctgagcgttggttttccttgttgcttacttttagaaggtgtccagtgtgaggtgcgagcgtggtggaggtcggtagggggaggtcgttggtcccgaggtcccggttcgggggggtcccctggacgtacctcctccgtgtcgcacgtcccgttcgttggtacttaccgtaccgtttagtacgtacttagttggagtggacgtcgtcgggtcccgacgacggtccgtacggaaggggacgggtcgtagggtaggtcggggtacgaccgaacgtaagtaacgtacgtaaggttaggaagtagaagtaactacgtagtgtacggtacgttcgtggtacggacgggtacctattacccaacctacgttccgacccggaaggaccaaccgaaaccgcgaaacgaaccttcgtaaccgtagtactcgagaacaggtacctaggaaccgcgtcgtaggacgtaggacggaagtaccgttacggtacgttgtaatttacgttgacggtcgaagtacggngtacgggccggaatacggtagtttggtttagg

SEQ ID NO: 27459 - DNA, 669 bp, Homo sapiens
  misc_feature: GYAE6OF01AMM04.13.67.G01.1.454.CMB.1.raw
tcagtcacgtactacacgaccggtgctcgatttagagtatacatattgggtttgggggggagaggagccccagccctgagattcccacgtgttgccattcggtgatcagcgctgaacacagaggactcgccatggagtttgggctgagctggttttccttgttgctatttaaaggtgtccagtgtgaggtgcagctggtagtagtcgtgggggaggtggtggtacggccgtggggggtccctcagctctcctgtcgcacctgtggtattcagtatttgatggagtatggctatacgacgtcgggtccgacccaaccgtccggaaggggaaggcgtggcgtaggtggttctttattttacttagtaggtagtggtaagtactagtacctcgacacgacttccggtggacggggacctacgttccaccgtactcctaccgaagtacgaactaacttaccgaaacgacctcgtactttcgtttactaaccgtaaataccgaacgtacgtacccgtagaacgtacgaccgaagtacgaacccgcgggttaccctggtttaactcgtgtcggagtgggaagtacgggtaccgggaaccctaacgggtaacgttacgtccgtacgtacggtcggtccggttacgggacggggaccgaaccgggccgttacccggg

SEQ ID NO: 27460 - DNA, 828 bp, Homo sapiens
  misc_feature: GYAE6OF01D6I5B.13.67.G01.1.454.CMB.1.raw
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
tcagtcacgtactacacgaccggtgctcgatttagagtatacatattgggtctggggggggcttggtccagcctgggggggtccctgagactctcctgtgcagcctctggattcacttttagtaggtattggatgggttggtccgccagactccagagaaggactggagtgggtggccaacataaaaggaagatggaagtagaaagatactatgtggacttcgtggtagaagggccattcacctatcctaccaggacgaaccaacgaccaaacgactcacgtgtatctgcanatgaccngtccgtagacgagtacggagtacgtacggtctaggtagttatttagttcgtggcgtaagaggaggtgggacacgtacttagtttgaagtggttgtacggtcggggaccgtacggggcccgtccccgggtactacccgttccgtccgtaccgtacgtcccccgtaaccgaacccgtaacccgggtccccttaaccggttccccggtttcccccggtttccccccggtcgggtcccccggtcccccgttacccgtccccggttaccgaacgggtacccgtacccccgtaccccgttaccgggaaccgttaaccgaccctaaccggtacccgggcccgggttccccggggtcgggttcccgttccgggcccgggtttacgggtaaccccgtaaacgggtaccccccttttaaccggtttaccccggttaacggttttacccggacgggttaacccggacgggggttcccgggacccggggttaccggttaccgggggaaaccgggggttaacccgcggggtaaaccgtaacg

SEQ ID NO: 27461 - DNA, 724 bp, Homo sapiens
  misc_feature: GYAE6OF01AF2AH.13.67.G01.1.454.CMB.1.raw
  modified_base (327)..(327): a, c, t, g, unknown or other
  misc_feature (327)..(327): n is a, c, g, or t
  modified_base (344)..(344): a, c, t, g, unknown or other
  misc_feature (344)..(344): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtcgcccgacggggacatcgtgatgacccagtcctccagacctccctggctgtgtctcgtgggcgaggacgggccaccatacaactgacaacgtccagccagtagttgttttaacactacgcctaccaaactaaataacgtaactttctagtcttacggtaccagacaacgaaccgagacacgcctacganctcgctactatttacgngtacactacgtacgtaccgggtacgtcccggggtcccgtacggaccgtacgttcggacggtcggcggacggtcggggtacgagggactacgttactttcacctcgtaccaccgtactcgacgcgtacggaccctcggacggacggttacgaacggtagtacggttcgggtaacggtttactttaacgttttacgtaccgtttagtaccggtaactaagttaaactttacggtttaccgtaccgtttcccgtacccggtaccgtaccgggtaccctttaccgggttaccgggttacccggggaccggggtaacccggaaaccgggttagggaacggttaacggtaacctaaacccgggtaaccggtaggtccggtaccggg

SEQ ID NO: 27462 - DNA, 890 bp, Homo sapiens
  misc_feature: GYAE6OF01B2TJQ.13.67.G01.1.454.CMB.1.raw
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctcgtggatctcgtggtacgacccgacggggactgtcgtagactacggaccctgtcctaccgacgtaccctcccgtggtcttggtcgttcgtcggtacgggacgacgggacggacccaacctacgtacgaacgtggactaaccgtccgaacgtacctaggttagttttcgtttaanaaccncgtaccctaacctaaaagtaaattaacgttaaccgtttacgttaacggttccggttaaccggaaccgaggaacccgtaaacggaacccggtacggaaccttaaccgtccctaacgtacggtacctacgtacctttaaccggtttactttaccggacgggacttacggtttaccccggtaaccgggtacccggggtaaccggttccccggggtaccttaacgaccgtttaggttaacgacggggtccgcgggacgggttacccggtgggtacggaaccttacgtttaccggtcctacctacgtacccaccgtaactcgaaacggtccgtaacgtaccgttacgaccggaggtaaccgtagggtaagtacgttacgggtacggttagttttaaccgtttacgtaacgttgtaaacgtaaggttaccttaaagttttaacggtaactttacccggttacgtcccgggtaacggtaaaccctttcggtaaccgggtttaccgggttaaccggggaaccgggtaccggttaacgggtaggtacggtaaaccgttaaaccgaaaccggttacgtaacgggttccggtaaccg

SEQ ID NO: 27463 - DNA, 645 bp, Homo sapiens
  misc_feature: GYAE6OF01DV382.13.67.G01.1.454.CMB.1.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacgggggacatcgtgatcgaccagtctccagactccctggctgtgtctctgggacgaggacgggcccacctagtacaactgacaacggtcccagccagagttnttttanacacgctaccaacaataagaacttactagctttacgtaccagacaagaaaccaggacagaccctaccgtaagtacgtgctactactttacgtagggtctatctaacgtccgggaacgtccggggtcccngaccgtnttccgtagtaggccgaggtcggggtcgtagggacgtagtaactttacgactactaccaccgtagcaggcacggtcctcggaccgtacggcgtacgaaggtatcggttgacgtttagttttactacgttcgtacgagtactaattatttacgtacgttacctcccgtccgtacggtacctacgtacccgttcgggtacgggtaaccgggccggtaagggtaccggtaaaggtacctaaggaaacccgtgtcggtacggg

SEQ ID NO: 27464 - DNA, 748 bp, Homo sapiens
  misc_feature: GYAE6OF01BN2KA.13.67.G01.1.454.CMB.1.raw
  modified_base (539)..(539): a, c, t, g, unknown or other
  misc_feature (539)..(539): n is a, c, g, or t
tcagtcacgtactacacgaccggtgctcgatttagagtatacatattgggtttgggggagctacaacaggcaggcaggggcagcaagatggtgttgcacgacccgaggtcttcatttctctgttcgctctggtatctcgtgtacgcccgaagggactacgtcgtagactcgacccagtcctaccagcctccgtggctgtcgtcgtcggagggacgaggacggaccacgataccgaacgtggacctaacggccgaagaccgtaaggttaacgtttagttttaacaaccggacgtaacctaaaccgtaaaataaaacgttaaacgttactttacggtaacgttacgttacggaaccaagaccaaaacggtaaccgaggtaacacctcgtaaccgtaagccgttacacttacgttacgtaccggtaggtactaacgttacgtaacggtacccgggaacggtttcccgggaaccttacgaaccgtattacggaacggtcggacgtaccggtcggttagaacggtactaacgttccttcgaacnccttacgaactcgacacgtacgaaccgtcgtaacgtaggacgtacggtagaactggtaacgtggtaacttacgttactacgtcgtacaaggtaactttaagtacgttaacgtaccgtaccgtacggtacgaccgttacgtacgtacggtacgggtacggacgaaccggtaaggaccgtagtaaccctaagacgtaacggtcgtaaacgg

SEQ ID NO: 27465 - DNA, 605 bp, Homo sapiens
  misc_feature: GYAE6OF01A3BEH.13.67.G01.1.454.CMB.1.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (316)..(316): a, c, t, g, unknown or other
  misc_feature (316)..(316): n is a, c, g, or t
  modified_base (374)..(374): a, c, t, g, unknown or other
  misc_feature (374)..(374): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctcagactccctggctgtgtctctgggcgagacgggccaccatcaactgcaagtccagccagagtgtttanacagctaccaanaataagaacttctagcttggtaccagcaagaaaccaggacacgcctacctaagctgctcatttacgnggcatctagtccgggtaactcccggggtcctcgaccattccgagtggcaggcgggtcngggtacagtacttcactctacaccatcgacgcacgcgtcgacgacggtctaggaagtacgtggtcgtacgttacgttttacttaacgttcgtacgtatacgtaaactttagttaacttagtacccgttccgtaccgtacgtaccgttaccgttaccgtttacggggacggggtaacgggtaaccgtagggtacgtaacggtactaaaccggtaaacgtacgttggtaccgg

SEQ ID NO: 27466 - DNA, 799 bp, Homo sapiens
  misc_feature: GYAE6OF01CHQ71.13.67.G01.1.454.CMB.1.raw
  modified_base (158)..(158): a, c, t, g, unknown or other
  misc_feature (158)..(158): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctcgtggtatctcgtgggtcgcccggacggggacncgtcggtagactcggaccctagttcctacgacgtccgtcccgtggtcgttggtcgttcgtcggtgggacgagggacggccacgactacacgtcgacgtacgccgacgacgaggtagtttagtttaacacgacgtacctaaccaaaagtaaaacgttaacgttaactttacgttaacgtcgttacgggtaacctagaaccgtaaacgaaaccgacggtaccgacgtacccgtaacgtagccgtccgtacttacgttacgttcggtacggtactacgtaccgtaccgggttaacccggtaccggttaccccggggtcctacggtacgtcgttacggtaggtacgggagtccgggtcggggtaggacggaaggttcgtaacgttccgtactaccgtacctaccgtacgtacgtaacgtcgaaacgtccggtacgtacggtacggtaacggtaaggtaacggtcggttacggtaaggtttacgtaacggttttaacttccgtaggtactacgtaagttaaacttcggttaacttacggtcccgtaccggttcgtaccgttaccgtacggttaccgggtacgggtacggtaacgggtaaccggaagggtaacggtaacgtaacgtaaccgtaaggaggttggacgg

SEQ ID NO: 27467 - DNA, 897 bp, Homo sapiens
  misc_feature: GYAE6OF01A7H60.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttctatttctcttgttgctctggatctcgtggtcgacccgacggggacatcgtgatcgacccagtccaccacgtacccttcccgtgggtcttggtcgttccgtccggtcggggccgaacgggaccgggacccaccactaccaacgtcgactaaccgtcccgacgtaccgtaaggttagttttacgttttaacaccgacgtaccctaaacccaaattaaacgttaaaccgtttaccgtttacttacggttccggtttaaccgggaacctacggtaaccgaaaccgaaaccggtaacggtaaccgtaccgtacccttaaccgtaacggtccgtaccgtaccttacgtttacgtttacggcgtacttacgtaccggttaccggtaccgggttacccggtccccggggtaccgtacggtacccgttacgtacggacggtacggacggtaacggggtccggtacggtacggtaaccgttacgtttaaccgttaccgtacccttaccgtacccaaccggtacgtaccgtacgtacccggtccgtaccggtacggacccgggtaacgtccgggtaagtaacggttcgggttaacggtacggtttaactttaacgttttaccgttagtaaccggtacctaacgttacttaagttacgttacttaccggttccccgtacggtaccgtaccggttacccgttacgggttaccgggtacccgggtaagggtaacccgggtacgtaaaggggttacgaaaccggtttaccgaaaccggtaaccgggttgttccgggtaacg

SEQ ID NO: 27468 - DNA, 783 bp, Homo sapiens
  misc_feature: GYAE6OF01EHSBR.13.67.G01.1.454.CMB.1.raw
  modified_base (249)..(249): a, c, t, g, unknown or other
  misc_feature (249)..(249): n is a, c, g, or t
  modified_base (354)..(354): a, c, t, g, unknown or other
  misc_feature (354)..(354): n is a, c, g, or t
tcagtcacgtactacacgaccggtgctcgatttagagtatacatattgggtttgggggagctacaacaggcaggcaggggcagcaagatgggtgttgcagacccaggtcttcattttctctgttgctctggatctctggtcgcccgacggggacatcgtgatgacccagtctccagacctcctggctgtcgtctcgtgggcgaggacggcccaccatacaactgacaagtccagaccagtattgtttanacgacgtctaccaaactaataagtactttcgtagtcttaggaaccagacaacgaaaccgagtaacacgcccttaactaaggcctgacctacgtaagttttaccgngggactaatcccgtaacggtacccggggtaacggttcccgggtaccctaggaccgtaacgttcgaagggttcggactacgggtacgggtacgtagggaactaaggttactttaccacgtcctactaaccgtagtacacggtccacggtccgtagacccgaagggtacgtaacggtaaagcgttacgggttacgttaactttaaacggttttaacgtaccgttaaggtaacccgaaaggttaaaccctttaaagttttaacgtttaaccgttaaaccgtttaccccgttaccggtaaccccggtaaaggttcccttaaaccggttaccggggtttaaccggggacggggtaaaccggtaaccgggtaaagggttacggggaaaaccttaacccggtaaaacggtaaaccggttaggttgggtaaacccgg

SEQ ID NO: 27469 - DNA, 781 bp, Homo sapiens
  misc_feature: GYAE6OF01C2EJQ.13.67.G01.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (609)..(609): a, c, t, g, unknown or other
  misc_feature (609)..(609): n is a, c, g, or t
tcagtcacgtactacacgaccggtgctcgatttagagtatacatattgggtttgggaggtctcagagaggagccttagccctggactccaaggcctttccacttggtgatcagcactgagcacagaggactcaccagtggaagttggggctgagcgttgggttttccttagtgtcttattttagaaggtnccagtgtcgagtncgagcgtggtggagtcggtgggagtcgttggtcctacggcccggttacggggggtaccccaacggtccttccgttcccgtggtaccgcgtaccgtcccgttcgttacggtaccttaccggttaaccctttaaggttacgtaccgttagttacggtagtacggtacggtcggtccggaccgtaccgacggtccgaccggtaggggacgggtcgtagggtacggtgggtacgaaccacgtaaagtaacggacgtaaggtacgggaagttagaaacgttaataccgttagtacggttacgtacgttacggtacggtaggacgggttaccgtacgttccaaccgttacgtaccgtacgaacgaacaaccgaacggtaacccaagtacccgtattaacgtaattacgtaanaaccggtaacgtcccggaccgtacggtaagaaccggtacgtaacggaacgaccggttaactaccgttaaggttaacttcccgtagtccggtaggtaacgacgtcgtaagaccggtaagtcggtacggtaacgttaccggggtaaaccgggtggggtaaccccggtaacccgg

SEQ ID NO: 27470 - DNA, 935 bp, Homo sapiens
  misc_feature: GYAE6OF01CXEYL.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtcgcccgacgggcatcgtgatgacccagtctccagacctccgtggctgtgtcctcgtggcgagacggacccaccataccaacgtcgaccgaacgtccgacgaccgaggtacgtttagttttacacgacgtacctaaccaaaataaattaaacgtaacctttcgttaacgtccgtttacggaaccctagaaccaaacggaaacccgtacgggaacctaccggtaccccttaaccgttaacgccgttaccgacccttacgtttaacgtttaccggtgggtacccttaacgttccgtaaccggttacccggggtaaccggtttcccccggggtccttaacggtacccgttaagtttaccggacgggtacgggccgtaacggggtcccggggttacggtacgggaaccgttacgttacctttacgtaccttaccctaccgtaacctaccgtaacgaccggtactcccggttacccgtacgtaccggaacggttaccggtaaaggttaaaccgggacgttttacgggttaacgggtttaacccgtttttacgtttttaaccgtttaacgtaccgggttttaaccaacggttaacggttaaacttttaaacgttttacccgtaaccggttttaacccttcccccgggttaacccgttaccggttaaccccgtttaaccggttaccgggggttttacccggggaaaccggggtaacgggtaaaaccccgggttaaggggtaaccgggttaaacgtaaaacccggtaacgtaaaaaccggggttttcccggtgggttaacccgggg

SEQ ID NO: 27471 - DNA, 855 bp, Homo sapiens
  misc_feature: GYAE6OF01EH8C0.13.67.G01.1.454.CMB.1.raw
  modified_base (200)..(200): a, c, t, g, unknown or other
  misc_feature (200)..(200): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctgatctcgtggtcgcccgagggacagtcgtgatcgaccagtcctccgagtacctcccgtggctgtgtccgtcgngggcgaggacgggccaacctataccaacgtgaccgtacgtaccgagaccgtaagtagtttagttttaataccgaccgtacctaacccgaaataaacgtaaacgttacctttacgtacggtacgttacggtaaccaggaaccgaaaaccgtaaaccgaagaaccgtccgtacccgtaaccgtaacgtccgtacgtacctaacgtttaacgtttacggacggtacttaaccgtaccggtttaaccggaacccgggtacccgtcccggggtaccctacggacccgttaaggtacgacgggtcggaaccggtaccggggttgggttaacccgggaagggaccgtttacgttaacccgtttacccgaccgtttacctacccctaaacggtacctacggacggtacccgaccggttaaccgcgtaccggtaaccggtacgttaagtaggttagttaccgggttagttaacgttttaacggttacgttaccggttagtaccgtaattaacgtttaacgttaaccttaacgtaaccccgttaccgtcccggtaccggttaccgttccgttacgggttaacccggttacgggggtaaaccggaacgggtaagggtaacggaggtaactaaacggaaccggtaaacggttcggtacggtaccggg

SEQ ID NO: 27472 - DNA, 841 bp, Homo sapiens
  misc_feature: GYAE6OF01EWB1U.13.67.G01.1.454.CMB.1.raw
  modified_base (795)..(795): a, c, t, g, unknown or other
  misc_feature (795)..(795): n is a, c, g, or t
tcagtcacgtactacacgaccggtgctcgatttagagtatacatattgggtttgggggagctacaacaggcaggcaggggcagcaagatggtgttgcagacccaggtcttcattttctcttgttgctctggatctcgtggtcgcccgacgggactacttcgtgatcgaccctacgttctaccacgtcccttcccgtggtcttcgttcgtcgttcggtcgggcgtaacgggaccgggcccaaccacttaccgaaacgttcgaaccgaacgttccgaacggcctaagggttattttacggttttaacacgtacggtaccctaaccgaaaacggtaaatttaaaaccgttaccgtttacgttacggttacctttacgggtaaccagtaaccgaaacgaaacccgaaggactaccgccttaccgtaagtccgtacgtcccttaacgttacgtttacgcgggtactacgttacgtaaccgggttacccgggtaaccggttcccgggggttaccacggggttaccctaggttaccgacgggtcggtaacggcgggttacgtacgggacggttacaaggttcctttacccgacttacggaaccctccttaacgacgacccgtagaccggttaccaggtaccgggacgttacggtaacggtagttacgggttcgtaccgggtttaatttaccgggtttaacttacggtacgtaacgtaccgtaaattaccggttttaatacggttaccctacggttcccgtacgtccggtaagttcccgttacgggtcgggacgggttaaacnccgggttaaggtagacgtaactaaaccggtaggtagttcccggacg

SEQ ID NO: 27473 - DNA, 498 bp, Homo sapiens
  misc_feature: GYAE6OF02FUPF4.13.67.G01.1.454.CMB.1.raw
tcagtcacgtactacacgaccggtgctcgatttagagtatacatattgggtttggggagctacaacaggcaggcagggcagcaagatggtgttgcagacccaggtcttcatttctctgttgctctggatctctggtgcccacgggacatcgtgatgacccagtctccagactccctggctgtgtctctgggcgagagggccaccatcaactgcaagtccagccagagtgttttatacagctccaacaataagaacttcttagcttggtaccagcagaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaattattatagtactcctccgagctcgactttcggcggaggaccaaggtggagatcaacgactgtacgg

SEQ ID NO: 27474 - DNA, 526 bp, Homo sapiens
  misc_feature: GYAE6OF02JCJ2Y.13.67.G01.1.454.CMB.1.raw
tcagtcacgtactacacgaccggtgctcgatttagagtatacatattgggtctggggaggcttggtacagcctggaaggtccctgagactctcctgtgcagcctctggattcacctttagcagctatgccatgacctgggtccgccaggctccagggaaggggctggcgtgggtctcaggtattagtggtagtggtggaagcacatactacgcagactccgtgaagggccggttcaccatctccagagacaattccaagaacacgctgtatctgcaaatgaacagcctgagagccgaggacacggccgtatattactgtgcagcagtggctggcacaggagcatattactttgactactggggccagggaaccctggtcaccgtctcctcagcctccaccaagggcccatccggtcttccccctcggccaccctcctccaacgacgcacctcgtcgggggccacacgcggccctgggctcgcctggtcgaaggactacttcctagtacgtgactgagcggctggcg

SEQ ID NO: 27475 - DNA, 500 bp, Homo sapiens
  misc_feature: GYAE6OF02J2B2X.13.67.G01.1.454.CMB.1.raw
  modified_base (238)..(238): a, c, t, g, unknown or other
  misc_feature (238)..(238): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtgcagtttattactgtcagcaatatatagtactctccgagctcactttcggacggaggaccaaggtggagatcaaacgtactgtacgg

SEQ ID NO: 27476 - DNA, 541 bp, Homo sapiens
  misc_feature: GYAE6OF02GYX3T.13.67.G01.1.454.CMB.1.raw
  modified_base (412)..(412): a, c, t, g, unknown or other
  misc_feature (412)..(412): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcaggcgggtctgggacagtatttcactctcaccatcagcagcctgcaggctgaagntgtgctagtttattactgtcagtctaattattatacgtacttccgtaccgagtcctcgtaccgtttcgggacgggtacgggtaacccgaagggttcggaagtacgtaaccgaaacgtacgtggtacggg

SEQ ID NO: 27477 - DNA, 549 bp, Homo sapiens
  misc_feature: GYAE6OF02JU8GT.13.67.G01.1.454.CMB.1.raw
  modified_base (429)..(429): a, c, t, g, unknown or other
  misc_feature (429)..(429): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcaagaaaccaggacagcctcctaagctgctcatttactggctatctagtccggaattccggggtccctggaccgtattccgaggtcggcgaggtcgggtcgtagggacagtactttcactcctcaccatcagcacgcctgcaggctagaacgntgtgctagtttatactgtacagactaattattaatacgtaccttccgtaccgagtctacgtacgtttcggacgggtacggtaaccgtagggtaggacgtagtaccgaacgtacgtgtcgg

SEQ ID NO: 27478 - DNA, 501 bp, Homo sapiens
  misc_feature: GYAE6OF02IFK8M.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttatactgtcagcaatattatagtactcctcgagctcgactttcggcggtaggaccaaggtggagatcaaacgactgtacgg

SEQ ID NO: 27479 - DNA, 506 bp, Homo sapiens
  misc_feature: GYAE6OF02FNSE4.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtgctagtttattactgtcagcaatattatagtactcctccgagctcgtacttcggcggaggaccaaggtggagagtacgaacgtacgtgtacgg

SEQ ID NO: 27480 - DNA, 550 bp, Homo sapiens
  misc_feature: GYAE6OF02ITTNW.13.67.G01.1.454.CMB.1.raw
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (454)..(454): a, c, t, g, unknown or other
  misc_feature (454)..(454): n is a, c, g, or t
  modified_base (469)..(469): a, c, t, g, unknown or other
  misc_feature (469)..(469): n is a, c, g, or t
  modified_base (511)..(511): a, c, t, g, unknown or other
  misc_feature (511)..(511): n is a, c, g, or t
  modified_base (540)..(540): a, c, t, g, unknown or other
  misc_feature (540)..(540): n is a, c, g, or t
tcagtcacgtactacacgaccggtgctcgatttagagtatacatattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcaggcctctggattcacctttagtagctagttggatggagctggggtccgccaggctccgaggggaagggctgggagtgggngaccaanagtaaagcaaggttggaagtgaagaaatactatgtaggactcgtgtaggaagggccgaattccaccatctaccagacgacaacgcaaagacctcactgatcngacaaaatgaaaccngcctgaagacgccggagaaccgaggctgtactagttactggngacgaaggagtaggttggggacgtaaggntaggctaggg

SEQ ID NO: 27481 - DNA, 524 bp, Homo sapiens
  misc_feature: GYAE6OF02IQEEH.13.67.G01.1.454.CMB.1.raw
  modified_base (238)..(238): a, c, t, g, unknown or other
  misc_feature (238)..(238): n is a, c, g, or t
  modified_base (390)..(390): a, c, t, g, unknown or other
  misc_feature (390)..(390): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataaagaacttcttaagcttaggtaccagcaagaaaccaggacagcctccaagctgctcatttactggcatctatccgggaatccggggacctgaccgattcagtcggcaggcggtcgtgggacagtactttcgactcncaccatcagcagcctgcagctagaagatgtgctagtttatactgtcagacaattattatatacctcctccgagtctacgtacgttccggacggaacggaccgaaggtcggagactacgaaacgtacgtgtacgg

SEQ ID NO: 27482 - DNA, 517 bp, Homo sapiens
  misc_feature: GYAE6OF02GZ0E9.13.67.G01.1.454.CMB.1.raw
  modified_base (238)..(238): a, c, t, g, unknown or other
  misc_feature (238)..(238): n is a, c, g, or t
  modified_base (413)..(413): a, c, t, g, unknown or other
  misc_feature (413)..(413): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcaggcgggtcgtgggacagatttcgactctcaccatcagcagcctgcaggctgaagntgtggctagtttatactgtcagcaattattatagtactcctcgagtctcgtactttcggcggagggtaccgaaggtcggagagtacgaaacgtacgtggtacgg

SEQ ID NO: 27483 - DNA, 542 bp, Homo sapiens
  misc_feature: GYAE6OF02GE8IR.13.67.G01.1.454.CMB.1.raw
  modified_base (238)..(238): a, c, t, g, unknown or other
  misc_feature (238)..(238): n is a, c, g, or t
  modified_base (412)..(412): a, c, t, g, unknown or other
  misc_feature (412)..(412): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcagcgggtctgggacagatttcgactctcaccatcagcagcctgcaggctagaagntgtggctagttttattactgtcagcagttatagttactagggataacccgtttcggacctaaagggaccaacggtaaccgtagggaacgtaagttaaaacggaccgtaggtaggaccttggacctaaccg

SEQ ID NO: 27484 - DNA, 624 bp, Homo sapiens
  misc_feature: GYAE6OF02GQ7BM.13.67.G01.1.454.CMB.1.raw
  modified_base (459)..(459): a, c, t, g, unknown or other
  misc_feature (459)..(459): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
tcagtcacgtactacacgaccggtgctcgatttagagtatacatattgggtttggggggggtaggagggaggccccgacgcccctgagattcccaccgtgttgccattcggtgatcagcgctgaacacagaggactcgccatggagtttgggctgagctgggttttccttgttgctattttaaaggtgtccagtgtgaggtgcagctggtagagtcgtgggggaggtggtggtacggccgtgggggggtccctcgagactctcctgtgccaacctcgtggacttcagatttgatgagtatggcatacacgtcgggtcccgcccaacctccggaggggaagggctggcaggtgggtctcgtgggtaactaacgtggaagtggtcgaccagcaactaacgttatgacagacctgtagtggaacgggcctattccaccatcctacagagacagtcgccgaanacctccgtanctcnacaaatgaactaggtcctcgggaagtcggaacggacgtccgggttccttaggtactttccgtagcggtaccggtaaaggtttcggaccgtagggtcggaccgtttacgggttaacccttaaggacctaaggttacgggaccgtttccgggg

SEQ ID NO: 27485 - DNA, 665 bp, Homo sapiens
  misc_feature: GYAE6OF02IMMI8.13.67.G01.1.454.CMB.1.raw
  modified_base (240)..(240): a, c, t, g, unknown or other
  misc_feature (240)..(240): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttttaanacagctaccaacaataacgaacttactagtacttacgtaacagacaacgaaaccgacggaacacgtacctaccgtaacgactcgactactactttacgtggactactactacgtaccggaacgtccgggtccctacgaaccgtacttcgaggtcggacgtacggcgggtcgtaggacgagtactttcactctactacctacgtacacgcacgtccgtcgacgacggctaaggaacgtagtacggtacggtacgttaagttttaacttacgttacgtacgtacgtacgtaaattaacgttaacttaacgttaccgttacccgttaccggtacgtaccgttaccgtaaccggtttaccgggaccgggtaaccggtaaccgtaagggtacggacgtaacgttaaccggaaacgttacgtacggtacgg

SEQ ID NO: 27486 - DNA, 514 bp, Homo sapiens
  misc_feature: GYAE6OF02I7W7E.13.67.G01.1.454.CMB.1.raw
  modified_base (238)..(238): a, c, t, g, unknown or other
  misc_feature (238)..(238): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctagaacgatgtgctagtttattacgtgtcagctaatattatagtactctccgagtctcgtactttcggcggtagggaccgtaaggtggacgatacaaacgacgtgtacgg

SEQ ID NO: 27487 - DNA, 714 bp, Homo sapiens
  misc_feature: GYAE6OF02H9389.13.67.G01.1.454.CMB.1.raw
  modified_base (290)..(290): a, c, t, g, unknown or other
  misc_feature (290)..(290): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggcccacatcaactgcaacgtccagaccacgagtgttttatacagctaccaacaaataagaacgttcttagtcttggttaccagtacganaaaaccgaaggacacgccttaccctaagctgctactactttactggcattctacgccgggtaacgtccggggtccctacgtaccgacttcgagtggccaggtaccggggtcttggggaacctagtaacgttttcctactctaccgtaacccattacgacgtacgacgtccctacggtccgaagggtacgttacggaaacggtaagttcgggtacggtacggtaaccttttttaaagtttaccgtttaccggttcgtaacggttaaccgttaacgtttaaacttttacggtaaacgtttaaccctttccccgttaccgggttaaccgggtccttaccgttaacccggtttttacgggaccggggtaacgggtaaccggaacgggttgggaacgtaacgtaacgtaaaccgtacggtaggtacggg

SEQ ID NO: 27488 - DNA, 653 bp, Homo sapiens
  misc_feature: GYAE6OF02JOZ0K.13.67.G01.1.454.CMB.1.raw
tcagtcacgtactacacgaccggtgctcgatttagagtatacatattggtctgggggaggcttggtacagcctggaaggtccctgagactctcctgtgcagcctctggattcaccttttagcagctatgccatgacctgggtccgccaggctccgagggaaggggctggcgtgggtctcagttatttatgtcgacggtgccacattctacgcagactccgtggagggccggttcaaccatctccagacgacaacttccaaagaacacggtgtatcttcaaatgaacgacctgagagtcgaggacacggccgtctattactgtgacgaaagagtgcagacgacggaccccggtaaagtcggggccgtgggtcgggtagggttcgtttcgtttgacgttcgtcgtcggggaccgacgggtaacccgtggtaccgtaccggttactcccgttcgtaccgtcccgtacccaccgaaccgggtccctagttcccggtcccttccccgtacggtcccgtccctcgcctccgacggcgccgacccgtcgacgacgcctacgccgtaccggcccgtgggcctcgtccgtcggtacgaacgtaccgttaccgttcccgtacggttacgttacggaccgttaggacggccgggtccgtacggg

SEQ ID NO: 27489 - DNA, 535 bp, Homo sapiens
  misc_feature: GYAE6OF02G6ZO2.13.67.G01.1.454.CMB.1.raw
  modified_base (344)..(344): a, c, t, g, unknown or other
  misc_feature (344)..(344): n is a, c, g, or t
tcagtcacgtactacacgaccggtgctcgatttagagtatacatattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttgggtccagcctgggggggtccctgagactctcctgtgcagcctctggattcacctttagtagctattggatgagctgggtccgccaggctccaggggagggctggagtgggtggccaanataaagcaaggttggaagtgagaaatactatgtgactctgtgaagggcattcaccatctcagacacaacgccaagactcactgtatctgctaaatcgaacagcctaggacgagccgaaggaccacgggctagtcctagttacctggtgcgaagaggtagtttggggggacgtaagggtataggcgtaaggg

SEQ ID NO: 27490 - DNA, 509 bp, Homo sapiens
  misc_feature: GYAE6OF02F44DE.13.67.G01.1.454.CMB.1.raw
  modified_base (238)..(238): a, c, t, g, unknown or other
  misc_feature (238)..(238): n is a, c, g, or t
  modified_base (412)..(412): a, c, t, g, unknown or other
  misc_feature (412)..(412): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcagcgggtctgggacagatttcactctccaccatcagcagcctgcaggctagaagntgtgctagtttattactgtcagcaattattatacgtactcctcgagctcgtacgttcggcggacggacgtaaggtagaggatcaaacgatggtacgg

SEQ ID NO: 27491 - DNA, 547 bp, Homo sapiens
  misc_feature: GYAE6OF02H3DY3.13.67.G01.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (367)..(367): a, c, t, g, unknown or other
  misc_feature (367)..(367): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataagaacttcttagcttggtaccagcagaaaccaggacagcctacctaagctgctcatttacnggcatctagtccgggaactccggggtcctgaccgtatcagtggcagcgggtntgggacagatttcactctcaccatcagcagcctgccaggctagaagagtggtgactagtttactacgttgtcaagtcgtaaattattaactacgttactcccgtacgagtcctacgtcgtttccgggacggtacgggaccgaagggtcggaagtacgtaccaaacggtaccgtggtacgg

SEQ ID NO: 27492 - DNA, 538 bp, Homo sapiens
  misc_feature: GYAE6OF02GBYY3.13.67.G01.1.454.CMB.1.raw
  modified_base (237)..(237): a, c, t, g, unknown or other
  misc_feature (237)..(237): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagagtgttttanacagctccaacaataagaacttcttagcttggtaccagcaagaaccaggacagcctcctaagctgctctatttactgggcatctatccgggaatccggggtccctgaccgattcagtggcagcgggtctgggacagatttcactctcacatcagtagcctgcaggctagaagatgtgctagtttatacgtgtacagtactaattattatacgtacttcctaccgagtcctctacgtttcgggaacggtacgggaacccgtaagggtcggaagtacgtaccgaaacgtacgtggtggtaccg

SEQ ID NO: 27493 - DNA, 685 bp, Homo sapiens
  misc_feature: GYAE6OF02JWZ2F.13.67.G01.1.454.CMB.1.raw
  modified_base (138)..(138): a, c, t, g, unknown or other
  misc_feature (138)..(138): n is a, c, g, or t
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
  modified_base (270)..(270): a, c, t, g, unknown or other
  misc_feature (270)..(270): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
tcagtcacgtactacacgaccggtgctcgatttagagtatacatattggtttggggagcgtacaacaggcaggcaggggcagcaagatggtgttgcagacccaggtcttcatttctctgttgctctggatctctggtncccagggcatcgtgatgacccagtctcagctccctggctgtgtcctctggcgagngggccacatcaactgcaagtccagccagagtgttttanacagcctccaacaataagacttcttagcttaggtaccancaagaaccaggacaggccctaccgtaagctgctacattttacngggacattactagtcccgggaattcccgggggtccctggaacccgtntttccgaaggtttcggactaggtacgggtcgtacgggaccaggtacttttcgaaccttcgtccgacctataccgagccctaaggtcccttacggaccgacggtacccgttagaaacgtacgttcggtacggacttaacggtttttactacggttacgtaccgtacggtacttaaagttacgtttaacttacgttaacccgttaccgttccgggaaccgttcgtttacccgtcggtttttaacccggggcgggttaaacccggtaccgttaaaggggtcgtaacggtaaaccgttaccgaaaaccggttaccggttggttaaccgg

SEQ ID NO: 27494 - DNA, 552 bp, Homo sapiens
  misc_feature: GYAE6OF02G6IYJ.13.67.G01.1.454.CMB.1.raw
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
  modified_base (412)..(412): a, c, t, g, unknown or other
  misc_feature (412)..(412): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagtgttttanacagctccaacaataagaacttcttagcttggtaccagcaagaaacaggacagccctacctaagctgctacatttacnggcatctatccggaatccgggtcctgaccgtattcagtgcagcggtctggacagtatttcactctacacctatcagcagcctgccagctagaagntgtgactagtttatacgtctacagactaattattaatacgttacctccgtccgtacggtcttaccgtacgttacgggacgggtaacgggtaccgaacggggttaggaagtaacgttaaccgaaacgttaccgtggtacgg

SEQ ID NO: 27495 - DNA, 578 bp, Homo sapiens
  misc_feature: GYAE6OF02I09FK.13.67.G01.1.454.CMB.1.raw
  modified_base (384)..(384): a, c, t, g, unknown or other
  misc_feature (384)..(384): n is a, c, g, or t
  modified_base (530)..(530): a, c, t, g, unknown or other
  misc_feature (530)..(530): n is a, c, g, or t
tcagtcacgtactacacgaccggtgctcgatttagagtatacatattgggtttgggggggggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggccgtggggggtccctcagactctcctgtgcaacctctggattcagatttgatgagtatggcatacacgtgggtcccgccaaccctccgaggggaaggggctgcgaggtttgggtctcgtggtaataaacgtggaatggtgccagcaacaacttangacagtactctgtggaagggccgattcaccatcctaccagacgacaggtcgaccgagaacctccgtaacatctagactaaatgaactgtcctacggagtcgaggaccgacggtcctttagtactttcgtgtggacggtagggttancggtaagtcggtctacgggttacttacgataacggtcggtacgtcggg

SEQ ID NO: 27496 - DNA, 660 bp, Homo sapiens
  misc_feature: GYAE6OF02HLB40.13.67.G01.1.454.CMB.1.raw
  modified_base (239)..(239): a, c, t, g, unknown or other
  misc_feature (239)..(239): n is a, c, g, or t
  modified_base (322)..(322): a, c, t, g, unknown or other
  misc_feature (322)..(322): n is a, c, g, or t
tcagtcacgtactacacgaccggtgctcgatttagagtatacatattgggtttgggggaggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaaccagacaagaaaccaggtaccacgcctacctaagctagctcatttacngggcatctagtccgggtaatccggggtccctagaccgtattccgagtcggaccaggtcggtgtacggggacagtacttttcacttcctaccactactacagcagtccctgcacggcttaggaacgagttcgggtacgtaccgttaaggttttacttacgttacggtacgtaacggtacctaaatttaagtttaacgttaacgttaaccctttcccgtacccggtacgggtaccctttacccggttaacggttttaccggggacggggtaaacgggtaacccggtaaggggttcggtaacggaacgttaaccgaaaacggttacggtaggttaaccggg

SEQ ID NO: 27497 - DNA, 637 bp, Homo sapiens
  misc_feature: GYAE6OF02HM8L3.13.67.G01.1.454.CMB.1.raw
  modified_base (303)..(303): a, c, t, g, unknown or other
  misc_feature (303)..(303): n is a, c, g, or t
  modified_base (559)..(559): a, c, t, g, unknown or other
  misc_feature (559)..(559): n is a, c, g, or t
tcagtcacgtactacacgaccggtgctcgatttagagtatacatattgggtttgggggggagaggagccccagccctgagattcccacgtgttgccattcggtgatcagcgctgaacacagaggactcgccatggagtttgggctgagcgtggttttccttgttgctattttaaaaggtgtccagtgtgaggtgcagctggtagagtctgggggaggtgtggtacggcctggggggtccctcagactctcctgtgcaacctctggattcagtatttgatgagtatggcatacactggggtccnccaacctcgagggaagggctgcgaggtgggtctcgtaggtaataaacgtggaattgggtgccgagctaacaacttatgacagactcgtaggtaggaacgggccgtattccgaacctagtcctaccgaagtaacgacgagtcggaccgaacgaaaccgttcccgtaacacgttccgtagaacctaaagtacgaaacctaggtcccttacggggacgttacggaacggtaccaccgggtcctttagttacttttccgnggttcggtacggtaaggttaacgcgtaaggttcggccgttaggtacttaccgacgtaacgttcgggtaacgtccgggg

SEQ ID NO: 27498 - DNA, 722 bp, Homo sapiens
  misc_feature: GYAE6OF02IXE7O.13.67.G01.1.454.CMB.1.raw
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggagggccaccatcaactgcaagtccagccagagtgttttanacngctccaaacaataacgaacttctaagcttacggtaccagaccaagaaaaccaggacacgaccctaccgtaaagcctaggcctactattttacgcgggctaattccgtagtcccgggtaaagtcccggggtaccctaggaaccgtacttcgaaggtttcgggacgtaggccggggttacgtacggggactaaggttacgtttttaccgacccgttaccgtaaccctaacccgtaacgtaccgtaacggtaccgtaacgcccggttacggaccgtaacgggtccgtaagggtaaacgttacgttacgggttacgtaccgttaacgttttattaccggttacgtaccgtacgtaacgtaactttaacgttacgttaaacgtaccgttaccgtaccgtaggtccttacgtaaccggtttacggaccgggtaaggtacccgtaaggtacggtaacgtacgtaacgaaacgtaccgtggtaccgg

SEQ ID NO: 27499 - DNA, 552 bp, Homo sapiens
  misc_feature: GYAE6OF02ILHG6.13.67.G01.1.454.CMB.1.raw
  modified_base (244)..(244): a, c, t, g, unknown or other
  misc_feature (244)..(244): n is a, c, g, or t
  modified_base (457)..(457): a, c, t, g, unknown or other
  misc_feature (457)..(457): n is a, c, g, or t
  modified_base (491)..(491): a, c, t, g, unknown or other
  misc_feature (491)..(491): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggagggccaccataccaactgacaagtccagccagagttgttttanacagctaccaacaaataagaacttctagcttaggaccagacagaaaccaggacacgacctctaagctgctactattactggcatcctagtcggaacgttccgggccctagaccgtattcgaggtcggcaggtcgggtctacgggactagatttccactcgtcactatcagcacgctgacgagctagagtagtgtacgtactagtttactacgngtaccagtactaatattagtactactcgtaccgngtactcgtacgttcggacggtacgacgtaggtcgaagtactaacgtaacgtacgtagtcgg

SEQ ID NO: 27500 - DNA, 660 bp, Homo sapiens
  misc_feature: GYAE6OF02JVKWD.13.67.G01.1.454.CMB.1.raw
  modified_base (240)..(240): a, c, t, g, unknown or other
  misc_feature (240)..(240): n is a, c, g, or t
  modified_base (322)..(322): a, c, t, g, unknown or other
  misc_feature (322)..(322): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagttgttttanacagcctaccaaacaataagaacttctagtcttggtaccagcaagaaaccaggacagcctactaagctgctactatttacgnggcatctacgtaccggtaacgtcccggggtaccctagacccgtattcgacggtcggcgacggtcgggtcgtaggggacaggttactttccgactctacgaccctattcgacgctacgtaccctggaccgaggtcctagtaagtacgttggtacgtacttaagttttacgttacgtgtaccgtaagtactaagttaacttaaagtaccggttaccttacccgtacggtacgttaccttaaccggttaccggtttaccgggacgggtaaaccgggtaaccggtaagggttacggtaacggtaaacgttaaccggtaaaccggtacggttacggttacggg

SEQ ID NO: 27501 - DNA, 625 bp, Homo sapiens
  misc_feature: GYAE6OF02H0O70.13.67.G01.1.454.CMB.1.raw
  modified_base (549)..(549): a, c, t, g, unknown or other
  misc_feature (549)..(549): n is a, c, g, or t
  modified_base (570)..(570): a, c, t, g, unknown or other
  misc_feature (570)..(570): n is a, c, g, or t
tcagtcacgtactacacgaccggtgctcgatttagagtatacatattgggtttgggggggagaggagccccagccctgagattcccacgtgttgccattcggtgatcagcgctgaacacagaggactcgccatggagtttgggctgagctgggttttccttgttgctattttaaaggtgtccagtgtgaggtgcagctggtagagtcgtgggggaggtgtgggtacggccgtggggggtccctcagactctcctgtgcaacctctggattcagtatttgatgagtatggcatacacgtcgggtcccgacccaaccgtccgaggggaacggggctggcaggtgggtctcgtaggtaataaacgtggaagtgggtcgccagacctaactaactttagtagacagtacttcgtggtaggacgggccgtagttcccaactatcccgtacgagacgacgtgtcgaccgagtaacctccgaatactcgtacactaaatcgaaacgtcgtaccgtcggaagtacggacgaaccgtcggttacctttgtacttttgnggttacggtcggtaaggttcncgtaggtcgtacgtttaggtaaccttacggcgtaagttcggggacccgttcgggg

SEQ ID NO: 27502 - DNA, 569 bp, Homo sapiens
  misc_feature: GYAE6OF02HPQ1I.13.67.G01.1.454.CMB.1.raw
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataagaacttctagcttggtaccagcagaaccaggacagcctactaagctgctcattcgnggcatactagtccgggaatccggggtccctgaccgtattcgaggtcgcaggtcgggtactgggacagtatttcactctacaccatcagcacgcctgcaggctagacgntgngtactatttagtactgtacagtactaattattacgtacgtaccgttccgtaccgtacgtcttaccgtaccgtttccgggacgggtaacgggtacccggtaagggtacggaacggtaacgttaaccggaaaacgtaccgtaggtacgg

SEQ ID NO: 27503 - DNA, 513 bp, Homo sapiens
  misc_feature: GYAE6OF02GBG0I.13.67.G01.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (409)..(409): a, c, t, g, unknown or other
  misc_feature (409)..(409): n is a, c, g, or t
tcagtcacgtactacacgaccggtgctcgatttagagtatacatattgggtttgggggagctacaacaggtaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttacngggcatctatccgggaatccggggtccctgaccgattcagtggcaggcggtctgggacagatttcactctcaccatcagcagcctgcagctgaagntgtgctagtttatactgtcagacaattattatacgtactcctcgaggctctacgtttcggacggtaggaccaggtggacgacgtacaaacgtactggtggtacg

SEQ ID NO: 27504 - DNA, 585 bp, Homo sapiens
  misc_feature: GYAE6OF02GDLMC.13.67.G01.1.454.CMB.1.raw
  modified_base (273)..(273): a, c, t, g, unknown or other
  misc_feature (273)..(273): n is a, c, g, or t
  modified_base (464)..(464): a, c, t, g, unknown or other
  misc_feature (464)..(464): n is a, c, g, or t
  modified_base (478)..(478): a, c, t, g, unknown or other
  misc_feature (478)..(478): n is a, c, g, or t
tcagtcacgtactacacgaccggtgctcgatttagagtatacatattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggnttcaccttttagagctattggatggagcgtggggtccgccgaggtctccggaaggggaacggggctagggaggtggggtcgggaccaaacaagtaaaagctaaggttaggaaagtggaagtaaatactaagtgtaggacttcgtaggtggaagggccattacactatctacagacacaacgaccaagaacncactgtactcgtanacaaatagaactacgacctagacgacgccgaggaccgacgtctgtctaagttactggtacggacgagagtagggttcggggaacggtaagggtacgtaggtcgtagg

SEQ ID NO: 27505 - DNA, 658 bp, Homo sapiens
  misc_feature: GYAE6OF02JQT19.13.67.G01.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttctagcttggtaccagcaagaaaccaggacagctcctaagctgctcatttacngggcatctagtccggaagtccgggtcctgaccgattcagtggacaggcggtctcgggacagtacttttacactctacactaatccgagccgagtccctggaccgtaggcgttagaaacgtagtcggtagggtaccgttaacgttttaagttaccttaggtaccgtacggtacgtaacggtttaatttaacggtttaaaccgttacgggggtaaacgttaaacccgggtttaccgggtaacccgtaaacgggggttaaccaaccgggtaacggttaacgggtaaacgttaaacggtttaaacgggaaccggttacggtacgggtaccgttacgggaccctaacccgg

SEQ ID NO: 27506 - DNA, 590 bp, Homo sapiens
  misc_feature: GYAE6OF02I0FJO.13.67.G01.1.454.CMB.1.raw
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
tcagtcacgtactacacgaccggtgctcgatttagagtatacatattgggtttgggggggagaggagccccagccctgagattcccacgtgttgccattcggtgatcagcgctgaacacagaggactcgccatggagtttgggctgagcgtggtttcgtgttagctatttaaaagtgccagtgtgagtgcagctggtgagtctggaggaggcttgatccagccgtggggggtccctgagctctcctgtgcagcctctggtcaccgtcagtcacactacatgagcttgggaccnccaggctccgagggaaggctaggatgcgtctcttttattatagtagtggtagtacatactccgnagactccgtgacgggtccattccacctatctaccagagacaacttacaaagaacacgactcgtttctttacaaatagaacacgcctagacgagaccgatacgacgaaccggtgtaccccccggttattaccgtagttgacggaggaaggaaggtcggggaccccggtaacggtaaccggttaaccgttaccgtacgtaacgttagggaacggtacggttcggggtaacccggg

SEQ ID NO: 27507 - DNA, 647 bp, Homo sapiens
  misc_feature: GYAE6OF02HJF0A.13.67.G01.1.454.CMB.1.raw
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
tcagtcacgtactacacgaccggtgctcgatttagagtatacatattgggtttgggggggagaggagccccagccctgagattcccgcgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggccgtggggggtccctcagactctcctgtgcaacctctggattcagtatttgatgagtatggcatacacgtcgggcccgccaacccgtccgaggggaacggggctggcgaggtgggtctcgtggtaataaacgtggaatggngccagcaacaattangacagactntggtacggaagggccgtacttacgaacctatcctaccgagaacgacgtaggtcgaccgaacgtaacctccgtaactatctacgaacctaaaatacggaaactacggttacgtacgggaacggtccggaaggacccgtacgggtccctttagtttacgtttcgtggttaggaccgggtagggtttacggcgtaacgggttcggtacgttacgggtttaaccgttacggacgtaacggttcggaccggtttaccggg

SEQ ID NO: 27508 - DNA, 612 bp, Homo sapiens
  misc_feature: GYAE6OF02IFWLB.13.67.G01.1.454.CMB.1.raw
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (338)..(338): a, c, t, g, unknown or other
  misc_feature (338)..(338): n is a, c, g, or t
  modified_base (379)..(379): a, c, t, g, unknown or other
  misc_feature (379)..(379): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgacggggacatcgtggatgacccagtctccagactccctggctgtgtctcgtgggcgagagggccaccatcaactgacaagtccagccagagttgtttananagtcctaccaanaactaaacgtaactttcttagtcgtttacggtaccagaccaacgaaaccaggacagcccttactagactgctactatttacngggactatactagccgggtaacgtcccgggtcctcgacgtntcgagtcggacacggtcggtcgtaggaccgtagtactttccactcacaccatcgagcacgtctacgacgtacggctaggaagagttacgtggtacttaagtttacttcgtagtcgtaagtataattattaattaccgtacctaccgtacgtagtccgtcgttaccggttacggaccgggtacggtaaccgtaagggtacgtaacgtaacgtaacgtaaacggtcgtggtacgg

SEQ ID NO: 27509 - DNA, 659 bp, Homo sapiens
  misc_feature: GYAE6OF02J05QI.13.67.G01.1.454.CMB.1.raw
  modified_base (241)..(241): a, c, t, g, unknown or other
  misc_feature (241)..(241): n is a, c, g, or t
  modified_base (319)..(319): a, c, t, g, unknown or other
  misc_feature (319)..(319): n is a, c, g, or t
  modified_base (379)..(379): a, c, t, g, unknown or other
  misc_feature (379)..(379): n is a, c, g, or t
tcagtcacgtactacacgaccggtgctcgatttagagtatacatattgggtttgggggaggctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatcaactgcaagtccagccagagtgttttanacagcctaccaacaataagacttcttagcttggtaccagcaagaaaccagacagcctactaagctgctacatttacgnggctatctagtaccggaacgtcccggggtcctgaccgtattccagtcggcaggccgggtntcggggacaggtacttttcgactctacacctatcgacgcgacgtcctagaccaggtcttaggaagtacgtggttggaccgttagtttaacgttacgtacgtaccaaggtaaccttaagtttaacgtttacgttaaaccggttccttcccgttaacccggtagggtaccctttaccgttaacgggttttaccggggaccgggttaaaccgggaacccgttaaggggttaggtaaccgtaaccggtttaaccgaaaaccgggttcgttagggttaacccggg

SEQ ID NO: 27510 - DNA, 713 bp, Homo sapiens
  misc_feature: GYAE6OF02JG2Q2.13.67.G01.1.454.CMB.1.raw
  modified_base (182)..(182): a, c, t, g, unknown or other
  misc_feature (182)..(182): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
  modified_base (389)..(389): a, c, t, g, unknown or other
  misc_feature (389)..(389): n is a, c, g, or t
tcagtcacgtactacacgaccggtgctcgatttagagtatacatattgggtttgggggggtaggaggagccccgagccctgagattcccaggtgtttccattcagtgatcagcactgaacacagaggactcaccatggagttgggactgagctggattttcctttggcttattttaaaggtntccagtgtgaagtgcagctggtgagtcgtgggggagcgttggtacagcctggctaggtcccngagactcgtctgancagctctaggattcgacctttggatgtattagntaccnttcacctggcggtccgagaacncgtacgagggacggcgtgacggtgtctgaggttaattcggtgtaagtaggtggtagacgtagtcggttacngtagggacgtcttacggtggtaccgggtaaggtaccgggtacttacggtaacctacgttacccgtacgaacgtacggtaacccgtaaaccgaaccggtaaaccggtaccttaccccggtattacgtacgtacaaccggtaaagtaacgtaaccgaccgtaacgtacggaagtaccgagttacggaaacgttacggaaccggtttcccgtaaggtttaacgtttaacgttccgggtaagtaacggttaaacgtaacccgtttaacccttaacccggttaaagttttaccgggttttaacgggttacggttacgtttaaacccggg

SEQ ID NO: 27511 - DNA, 509 bp, Homo sapiens
  misc_feature: GYAE6OF02FGCWX.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttataccagcctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtgctagtttactactgtcagacaattatatagtacctcctccgagctctacgttcggcggtacggacgaaggtcggagacacaacgacgtgtcgg

SEQ ID NO: 27512 - DNA, 606 bp, Homo sapiens
  misc_feature: GYAE6OF02IOFPE.13.67.G01.1.454.CMB.1.raw
tcagtcacgtactacacgaccggtgctcgatttagagtatacatattgggtttggggggagctacaacaggcaggcaggggcagcaagatggtgttgcagacccaggtcttcatttctctgttgctctggatctctggtgcccacggggacatcgtgatgacccagtctccagactccctggctgtgtctctgggcgaggagggccaccatcaactgacaagtccagccagtagtgttttaatacacgctaccaaacaaataaagaactttcttagcttaggtaccagacaacgaaaccaggacagacccttaccgtaagcctgactactaatttacgtggacatactagtacccgggaacgttcccggggtcctacggaccgtattcgagtggcgaggcgggtcgtgggactagtactttcactcctacaaccatacgagacacgcctgccaggactagaaagagttggtacggtattagtttattacgttgtacgagaactaattatttaagacgttacctaccgtacgacgtcttacgtacggttccgggacgggtacggaaccgtaaggtggaactacgttaacgaaacgttacgtggtacg

SEQ ID NO: 27513 - DNA, 554 bp, Homo sapiens
  misc_feature: GYAE6OF02FZMAN.13.67.G01.1.454.CMB.1.raw
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
  modified_base (394)..(394): a, c, t, g, unknown or other
  misc_feature (394)..(394): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttctagcttggtaccagcagaaccaggacagcctcctaagctgctcatttacngggcatctatccggaatccggggtcctgaccgattcagtggcaggcgggtctgggacaggtatttcgctctacaccgatcgancacgcctgcaggctagaagacgttgaggtctagtttaacttactgttacagacaagttattagtacgttactcctcgtacggtcctacgtacgtttcggaccgggtacgggtaaccgtaagggtcggtaagacgtaacgaaacggtaccgttaggtacgg

SEQ ID NO: 27514 - DNA, 591 bp, Homo sapiens
  misc_feature: GYAE6OF02I284E.13.67.G01.1.454.CMB.1.raw
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgaggagggccaccatcaactgcaacgtccagccagagttnttttanacanctaccaanaataaagaacttnttagcttggtaaccagacaagaaaccaggacagccctctaagctgctacatttacgtggcatctagtccgggaactccggggtccctgaccgtattcgagtggcacggtcgggtctagggactagtactttcactcctcaccatcagcacgccgtgcgacgctagagtagtggtgtactagttttattacgttgtcgtagtataattagttaattacgttaccgttaccgttaccgacggtccttacgttaccggtttccgggacgggtacgggtaaccggtaagggtacggaacggtacgttaacgaaacgtaacgtggtacgg

SEQ ID NO: 27515 - DNA, 573 bp, Homo sapiens
  misc_feature: GYAE6OF02HYSRV.13.67.G01.1.454.CMB.1.raw
  modified_base (189)..(189): a, c, t, g, unknown or other
  misc_feature (189)..(189): n is a, c, g, or t
  modified_base (240)..(240): a, c, t, g, unknown or other
  misc_feature (240)..(240): n is a, c, g, or t
  modified_base (318)..(318): a, c, t, g, unknown or other
  misc_feature (318)..(318): n is a, c, g, or t
  modified_base (393)..(393): a, c, t, g, unknown or other
  misc_feature (393)..(393): n is a, c, g, or t
  modified_base (417)..(418): a, c, t, g, unknown or other
  misc_feature (417)..(418): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactcctggctgtgtctntgggcgagaggccaccatcaactgcaacgtccagccagacgttgtttttanacagctaccaacaataagaacttcttagcttggtaccagcagaaaccagacagcctacctaagctgactctatttacnggctatctaagtaccgggaacgtcccggggtcctacgaccgtattcgaggtggaccaggcgggtctgggacagtntttcactctcacatcagcacgccnncgagtctagaagatgtagcttagtttacgttagtagtacgagtaactaattagttaactacgtacctaccgtccgtacgtcctacgtaccggttcggacggtaacgggaaccgtaaggtacggaacgtaacgtaacggaaacgtacgtagtacgg

SEQ ID NO: 27516 - DNA, 807 bp, Homo sapiens
  misc_feature: GYAE6OF02IJCJ7.13.67.G01.1.454.CMB.1.raw
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (279)..(279): a, c, t, g, unknown or other
  misc_feature (279)..(279): n is a, c, g, or t
  modified_base (377)..(377): a, c, t, g, unknown or other
  misc_feature (377)..(377): n is a, c, g, or t
tcagtcacgtactacacgaccggtgctcgatttagagtatacatattgggtttgggggagctacaacaggcaggcaggggcagcaagatggtgttgcagacccaggtcttcatttcctctgttgctctggatctcgtggtcgccccgacggggacatcgtgatcgacccagtcctccagacctcccgtggctgtgtctcgtgggcgagacggccaccgatcaacgtgacaacgtccagccagagttgtttanacngcctacaacaataacgtaaccttnttaacgctttacggtaaccagtaccgaaacgaaaaccccgaggaaccgacgtaccccgttaacctaaaggtccttagaccttaccgtagttttaccgngggtacctattaccgtacggtacccggggtaaccgtccccggggtacctacggaccgtacttcggagttcggacgacgggtcgggtactagggcagtacctttcaccttcgaccacctacgtcgacgtcgaacgccctagaccggacgtctaacggaagtcgttacggtcgttacgtttaacggttttaacttacggtacgtttacgaacgttaacgtttaaacttagttttaaaccgtaccgtttaaacccgttacccgggttacccggttaaacggtttcccggtttacccgttttaaccggggttttaccggggaacccgggggttaaaacgggtaaccccgggtaaaggggtttaccgggaaaccggttaaccccggttaaaaccggtaaaaccgggtttaccccgggttaggttaaccccccggg

SEQ ID NO: 27517 - DNA, 674 bp, Homo sapiens
  misc_feature: GYAE6OF02IITF9.13.67.G01.1.454.CMB.1.raw
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggcctaccatcaacgtggcaagtccagccagagttgttttanacngcctaccaacaactaaagaactttacttagtcttaggtaccagctaagaaaccaggacacgtcccgtacctaagctggctccgtattttacgagggtaccaagttcgtaacgtacccggggtaaacgttcccgggggttccctaggaccgtagttaccgagttcggacgaggtccggggtactcgggggtaacaggttacttttaccgacttacctaccgtaaccctaacgttaccgaacgccaacgtccccgtggaccgtacggccgttaggaacgtagtcggtcgtacgtaagttttagttcgtagtcgacgactaattatttagtacgtaaccttcccgttcggtacgtcctacgttaccgtttacgggacgggttaccggtaaccgtaagggtacgagtaccgtacgaaacgtacgtagtaccgg

SEQ ID NO: 27518 - DNA, 774 bp, Homo sapiens
  misc_feature: GYAE6OF02IXO6K.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtcgggcgagagggccaccatccaactgcaagtccagaccagagttgtttagtacagctaccaaccaataacgaacttcttagcttacggtaccagacaagtaaacccaggaccaggaccttacccgtaacgcctcggtacctctaacttttaccgtcggggtacctattaccgttaacgtacccggggtaacgttccccgggggttaccccgttacggaaccgtactttaccgacgggttacggtaccggaggtaccggggtccgtacggggtaaccgtaggtacctttttccgaacccttccgttacccaacccgtaagttacccgtaggtacctaccggtacccttacgggaccgtaaccggtacgtaacgtaaacggaacgttcggtacggttaccgttaacgttttacgttaacttaccggtaacgtacgacgttaacgtttaacgtttaacgtaacgtttacccgtcccgttaccggtacggttccgttaaccggttccgtttaccgggcgggttaaaccggggaaccttaagggttacggaaccggtaactaacgaaaccggttacggtagtacggg

SEQ ID NO: 27519 - DNA, 601 bp, Homo sapiens
  misc_feature: GYAE6OF02GMKLI.13.67.G01.1.454.CMB.1.raw
  modified_base (284)..(284): a, c, t, g, unknown or other
  misc_feature (284)..(284): n is a, c, g, or t
  modified_base (326)..(326): a, c, t, g, unknown or other
  misc_feature (326)..(326): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagacgggccaccatcaactgcaagtccagccagagttgttttaatacagcctaccaaacaataagtaacttcttaagtcttggaaccngacaagaaaccaggacagccctactaagctgctatatttacnggctatctagtccggaacgtcccggggtccagacgtatcgagtggcaggcgggtctagggacagtactttacgactcctcaccatcaagccacgtcctgcgaggctagaagtagtcgcggtacttagtttacgttactgtactagtaccttaaagtttaattagttaacgtaccttaccgtaccggtagtaccttacggtccggtttacggggaccgggtaacgggtaaccgtagggtacggaagtacgtaaccgtaaacgtacggttcgtacgg

SEQ ID NO: 27520 - DNA, 753 bp, Homo sapiens
  misc_feature: GYAE6OF02JBTW3.13.67.G01.1.454.CMB.1.raw
  modified_base (244)..(244): a, c, t, g, unknown or other
  misc_feature (244)..(244): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgaggacggccaccatcaactgcaacgtccagccagagttgttttaanacagacctaccaaactaaagtaagtaaccttcttaacgcgtttacggtaaccagaccaacgaaaaccgacggtaacacggtaccctaccgtaacgtcgtacgacctactacgtttacgtcgggactaacgttccgttacgtacccggggtaacgtcccggggtaccctaggaccctagttaccgacggtcggacgacgggtcgggttcgtagggtacgagttactttcctactcctccgtaactactacgacgaccagtccctgaccgtacggtctaaggtaaacgtcggttaggtacgtacgtaacgttttaccgttacgttacgtaccgtaacgtaccgttaaattttacgttaaacgttacccgttaccttacccgggttaccgggtaaccgttaccgtttaacccggtacccgggttttaccggggaaccgggtaccgggtaaaccggttaacgggtaggtaaccggtacgtaaccggtaaaccggttacggtcggttaaccggg

SEQ ID NO: 27521 - DNA, 578 bp, Homo sapiens
  misc_feature: GYAE6OF02IL0R6.13.67.G01.1.454.CMB.1.raw
  modified_base (237)..(237): a, c, t, g, unknown or other
  misc_feature (237)..(237): n is a, c, g, or t
  modified_base (362)..(362): a, c, t, g, unknown or other
  misc_feature (362)..(362): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtggcgagaggccacatcaactgcaagtccagccagagttgttttanacagtcctaccaactaataagtaactttcttagcttagtaccagacaagaaccaggacacgcctactaagctgctactatttacgtggcattcgtacgtccgggacgtccgggtccctgaccgtnttcgagtcgacaggcggtcgtggactgtacttcactctacacctatcacgcacgtcctgcgtaggctacgagtagtggtacgtatagtttaacttcgtacgtacgtagtactaatttattaacgtacgttactaccgtacgagtacctccgtaaccggttcggacgggtaaggtaccgaagggttcgaacgtactaacgaacgtacgtagtaccgg

SEQ ID NO: 27522 - DNA, 765 bp, Homo sapiens
  misc_feature: GYAE6OF02IW8C0.13.67.G01.1.454.CMB.1.raw
tcagtcacgtactacacgaccggtgctcgatttagagtatacatattgggtttggggaggtctcagagaggagccttagccctggactccaaggcctttccacttggtgatcagcactgagcacagaggactcaccatggaattgggctgagctggtttccttgtgctattttagaggtgtccagtgtgaggtgcagctggtggagtcgtgggggaggcgttggtccaggccgtgggggtccctgagtactctccgtgtgcgacgtcctcgtggtacttccgtaccttttaaggtagtccttagttaggatggagtcggtcggggtcccgccgtacgggtcctaccggaagggggaacgggccggtagggtacggggttacggggtacgggacccgaaaccgtaagtaaaacggacgttaaggtagggtaaaggtcggtaaagtaaactaacgtatagggttaaggaccttcgtaggtacgggaacggtccgtattacccgacctactccctaaccgagaccgtaaccaacggtacccgaaagtaacccttcgaacgtttctaacgttccgtaacgtaacaaacgttacgaaccctaagggtccgttagaacgggaacggtacccgggaacggtaaacccgtccgggtacttacgggtttaacttacggtttaacccggtggtttaccggaaccgggtaggtaaacggttacgggggttacggggtaaacggtaaggggttaacgttaccgggacggttaacggg

SEQ ID NO: 27523 - DNA, 679 bp, Homo sapiens
  misc_feature: GYAE6OF02GK9UR.13.67.G01.1.454.CMB.1.raw
  modified_base (391)..(391): a, c, t, g, unknown or other
  misc_feature (391)..(391): n is a, c, g, or t
tcagtcacgtactacacgaccggtgctcgatttagagtatacatattgggtttggggggggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggccgtggggggtccctcgagactctcctgtgccaacctctgtattcagtatttgatgagtagtggcatacacgtcgggtcccacccaacctccgaaggggacgggctgcgaggtggtctcgtaggtataaacgtggaagtggtcgacgagacaactaacgttangcgaatactcgtggtaggaacggcccgtagttccaacctacttccgtaccgaaggacgaacgtagtcgacccggtaagtaccctccgtatacttacgtcgaaacttaacgtacaacgcgttaaccggcggtaacggtaacggtacggaacccgtacccggttagtttacgttaacgtttgtacggtacggtaaccgggttaggggttaccgagttaaccgggttcggtaccgtttaaccgggttaacgttcgggaaccgtaacggttcggggttaccggtcccggggg

SEQ ID NO: 27524 - DNA, 686 bp, Homo sapiens
  misc_feature: GYAE6OF02JF0GX.13.67.G01.1.454.CMB.1.raw
  modified_base (245)..(245): a, c, t, g, unknown or other
  misc_feature (245)..(245): n is a, c, g, or t
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggcctgtgtctctgggcgaggacgggcccaccatcaactgcaacgtccagccagtagttgttttanacagtcctaccaaactaataagaacttcttagcttggtaccagctaagaaacccnggaacagccctactaagtcngtctactatttacgcggactatactacggtaccgggaacgtcccggggtacctcgaccgtagttcgagtcggtacgacgggtcggtacgtacgggtactaggttacctttaccgtaccttacctacccgtacctaacgtcccaaaggtccgtacgtacccgtagaccgtacggtaccttaagaacgttgtacgggtcgtaagttacgtttacgtacgtacgtaccgtaagtactaaagtttcttaacggtactttcccgaccgtttcggacgttacctacccggttcggttaccgggacgggaacggttaccgtaaagggtccgtaagttaacccggtaaccgtaaacggttaccgtggttaccgg

SEQ ID NO: 27525 - DNA, 732 bp, Homo sapiens
  misc_feature: GYAE6OF02HQRJ1.13.67.G01.1.454.CMB.1.raw
  modified_base (242)..(242): a, c, t, g, unknown or other
  misc_feature (242)..(242): n is a, c, g, or t
  modified_base (322)..(322): a, c, t, g, unknown or other
  misc_feature (322)..(322): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgaggagggccacctatcaactgcaagtccagccagagtgttttanacagctacaacaataagaacttctagcttggtaccagcaagaaaccaggacagcctacctaaggctcgctctatttacgnggacattactagtaccgggtaacttcccgggggttaccctcggtaacccgtagtttccgtaacggttcggtaccgtaacgggtccgggggttacgttaacggggggacctaacgggttacttttttcccgaacgtttccgttacccgaacccgttaacgttaccgaacggtacgaaccgtcccgttggacccgtaaggtccgttaaggaacgtaagttcggttacgggtaccttaagtttttacgttaaccgttgttaccgaaggttacctaaagtttagtttaacgtaagttacccttccgtaccggtacggttccttaccggttaaccgtttaccggggacggtaacggggtaacccttaacggggttacgacggtaacgttaaccgaaacgtacggttagtaccggg

SEQ ID NO: 27526 - DNA, 1054 bp, Homo sapiens
  misc_feature: GYAE6OF02HY50U.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtcgcccacggggacatcgtgatcgacccagtctccgagacctcccgtggctgtcgtctcgtgggacgtaggacgggcccaccgtatacctaacgtgacctaacgtccgacgaccgtaaggtacgttttacggttttaactacgacggtacctaacccgaaaacgttaaaacgtaaacggttaaacccttttaccggttacggttaaccgtttaccgggtaaaacccgtacggtacccggaaaaccggtaaaaacccggaaacgggttaacccgaaccccgggtttaacccccgttaaacccgggtttaaaaccggtacccgtttccgggttaacccttttaccggttttaaaaccgtttttaccggggacgggtaaaccccttacggtttaaccccggttaacggggtttaccccgggggtaaacccccggttccccgggggtttaccctaaccggggtacctttaacgttacccggtgggtaccgggtaccgtaacgggtttccccgggggttacgggttaaccgggtaccgtttaaaggtttcccgttttaacccgtacccgtttacccgtaaccccggtaccgtaaccgttcccgtaacggaaccgttaccggtacccgttacggggcccgtaccggttaaccggttaacgggaaagtttacgggttaccgggttaggttaccgttttaaagggttttaacctttaccgggttacggttaacccgtaaacggttaaactttaaacggttacgttttaaaccggttaaccttaaccccggtttacgtacccggttaccgtttaccgtttaccggggtaaccggtttacccggggtaacggggtaacggttaaacggtacgggtacggtaaaccggtaccgttaaaccggtaaacccggtgttaccgggttaaccg

SEQ ID NO: 27527 - DNA, 692 bp, Homo sapiens
  misc_feature: GYAE6OF02IBKF8.13.67.G01.1.454.CMB.1.raw
  modified_base (273)..(273): a, c, t, g, unknown or other
  misc_feature (273)..(273): n is a, c, g, or t
  modified_base (440)..(440): a, c, t, g, unknown or other
  misc_feature (440)..(440): n is a, c, g, or t
  modified_base (499)..(499): a, c, t, g, unknown or other
  misc_feature (499)..(499): n is a, c, g, or t
  modified_base (588)..(588): a, c, t, g, unknown or other
  misc_feature (588)..(588): n is a, c, g, or t
  modified_base (599)..(599): a, c, t, g, unknown or other
  misc_feature (599)..(599): n is a, c, g, or t
  modified_base (638)..(638): a, c, t, g, unknown or other
  misc_feature (638)..(638): n is a, c, g, or t
tcagtcacgtactacacgaccggtgctcgatttagagtatacatattgggtttggggggggagaggagccccagccctgagattcccacgtgttgccattcggtgatcagcgctgaacacagaggactcgccatggagtttgggctgagcttgggtttccttgttgctaagttttaaaaggtgtccagtgtgaagtgcagcgtggtgagtcgtgggggagcgttggtaccagcctgggctacgggtccctgacggtacttcctccgtgcgacncggtcctcgtggactttcctacctttgatagtatttcgccgatagtgtaccgtcggtcggggtccgaccgaagcccgttaccgggaagggtacggcccggtgggtaccggtggtctacgttacggtagttacggtagacgttaggtggtacgacgtaaggtcggtancggtcgtaacggtaccttggtcggtacgggtaaccgggcttaccttaccaaccggttcnccgtaagtaccgaagaaccccgaacgaccgttaaacggtaaccttccccattaccgtacgaacggactaaacgtaccgaagttcccgtnaggttaaggcncggtagacggtaccctaggtaccggttttaacgttggtnacggtaaccaagtaccctcccgtaaaccttgtttcggtagtacgtttggaacgg

SEQ ID NO: 27528 - DNA, 752 bp, Homo sapiens
  misc_feature: GYAE6OF02H8GY0.13.67.G01.1.454.CMB.1.raw
  modified_base (248)..(248): a, c, t, g, unknown or other
  misc_feature (248)..(248): n is a, c, g, or t
  modified_base (337)..(337): a, c, t, g, unknown or other
  misc_feature (337)..(337): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgacggggacatcgtgatcgacccagtctccagactcccgtggctgtgtctcgtggcgagagggccacatccaactgacaacgtccagccagtattagttttacaancgtctaccaactaaataacgtaactttctagtcgtttacgtaccagacaacgaaacgagacacgcctactacgctgctacttattacgnggctattacgtacggtccgggtaaccgtcccgggggtacctacggacgtcgttacgacggtgggcgtacgggtacgggtaccgtacggggtaactacggttacgttttaccaccgtttctacccaactacttacgaacgtaccgtacgtaccgtacggtaccgtacgggtaacacgggtaacgttaggttcggtacgggttaacctttaaggtttttacgtaacggtttggacgtaacgtaacttaacgttttaaagtttaaccgttaccgttaccgtacccggttacccggttaacggtttccctttaaccgggttcccgggtttaaccgggggccggtaaaccggggtaacggtaaacggggtggtaaaccggttaaccgtaaaccgggtaaacgttaccgggtggttaccgg

SEQ ID NO: 27529 - DNA, 768 bp, Homo sapiens
  misc_feature: GYAE6OF02JH8CA.13.67.G01.1.454.CMB.1.raw
  modified_base (134)..(134): a, c, t, g, unknown or other
  misc_feature (134)..(134): n is a, c, g, or t
  modified_base (281)..(281): a, c, t, g, unknown or other
  misc_feature (281)..(281): n is a, c, g, or t
  modified_base (542)..(542): a, c, t, g, unknown or other
  misc_feature (542)..(542): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctntggtcgcccgacggggacatcgtgatcgaccctagtctaccacgacctcccgtggtctgtcgtcttcggtcgggcgaggacgggccaaccgtataccgaacgtcgacgtaacgtaccacgaccgtaaggtagttttacgttttaaanaaccgactacccttaccaaaactaaacgttaaaacgttaccttacgtttacgtacgtttacgtaaccaacggtacctaaacggaaaccgaacggaacctaccggtacccttaaccgaaacgtctacgtaccgttctaacgttttacgcggtactacgttacgtaccggtaccgggtaacggtccccgggttccgtacggtaaccttacgttcgacggtcggtccggagggtccggtacgtacggaacgtagttctttaccncgttcctaccactacgtacgactacgtaacgtacgtaacgtaacgtagaacggtttcttaccgttacgtttctttaccgttcgttacctacgttacgtacggttacgttggttaaccgtcgtaacgtttacgttcggttaacggaccggtaacggacctaggtcggtaacgtcttaaacggtacgtaacctagggtactcggttcgaaccgtcgtaccgttctacg

SEQ ID NO: 27530 - DNA, 670 bp, Homo sapiens
  misc_feature: GYAE6OF02IH057.13.67.G01.1.454.CMB.1.raw
  modified_base (391)..(391): a, c, t, g, unknown or other
  misc_feature (391)..(391): n is a, c, g, or t
tcagtcacgtactacacgaccggtgctcgatttagagtatacatattgggtttggggggggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtcgtgggggaggtgtgggtaccggccgtggggggtccctcgacgactctcctgtcgcaacctctggacttcgagtatttgatgagtatggacatacgacgtcgggtcccgacccaaccctccggagggggaacggggtctcggcgaggtcggttctacgtaggtaataaacgtggaagtggtanccagacaactaacttatcgacgagtacttcgtaggtaggaacgggtaccgtacttccaacctacgttccctaacgacgacgacgacgtcgaccgtaaacggtaacctaccggtaacagtacgtacgaactaagtacgaatcggtaccgtggaacgtcggaacgggacctccggttcttacgggttacttttggaggttccggacggttaaggttacgacgttaacggttcggaccggtttaggttaccgttacgacgtaaggttccggagttcccgggg

SEQ ID NO: 27531 - DNA, 832 bp, Homo sapiens
  misc_feature: GYAE6OF02G0WE8.13.67.G01.1.454.CMB.1.raw
tcagtcacgtactacacgaccggtgctcgatttagagtatacatattgggtttgggggagctacaacaggcaggcaggggcagcaagatggtgttgcagacccgaggtcttctatttctcttgttgctcgtggtactctcgttggtcgacccggacggggactacgttcgtagtataccgaacccgtacgttcctaccgacgtaccttccgtggtcttggttcgttcctcggtgggacggagggaccgggaccaaccgtactacaacgtcgacaacgtccacgaccgtaggtagtttacttttacacgacgtcctaaccaaactaaagttaacgtaactttcgttacgtcgttacggtaaccagacaaacgaaaccgacgaactaccgtaccttacgaacgtccgtcgtcttacgtacgttttacggcggtactacttacgtaacggtaccgggtacgttcccggggtacctacggaccttacgttcgtagggtcgacggtacgggtccgggtacgtacgggtaacgtacgttttacctttaaccgtaccgttacccgtaaccgaaccttaacgtaaccgacgtaccgacgttcccgacggaccggtacgtaccgttaaggtaacgtgtcggttacgtacgtttacgttttaacgttcgttacgtcgtaacgtaacttaacgtttattaacgttaccgttacccgttaccgttaccggtacgttcctttaaccgggtttaccggtttaccgggaaccggggtaaccggttaacgggtaacggttaacggtacggttaacctaaaccgggtaacggttacggtaccggtacgg

SEQ ID NO: 27532 - DNA, 753 bp, Homo sapiens
  misc_feature: GYAE6OF02IFU6R.13.67.G01.1.454.CMB.1.raw
  modified_base (247)..(247): a, c, t, g, unknown or other
  misc_feature (247)..(247): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtcgccccgacggggacatcgtgactcgacccagtcctccagcctcccgtggctgtctcgtcgtgggcgagacggccacgatcaactgacacgtccagcagagttgtttanacgagcctacaaactaataacgtaacttactagtcgttacgacgacgtacaagtaaccgaggaccacgtacctacgtaaccgtctacgtctaccttaacttacgtacgggtactacgttacgtaacggtaccgggtaaccgttcccggggtaaccctggtaacccgttaagttccgtacggggttacgccggtacgggtaccggttacggtagggtaacgtacggttaactttccgaacccgttacctaccgtaacccgtagttacccgaacggaccgttcggtaaccccgttggacccggtaaccggttagtaaaccgggtaaagtcggtaaccgggttcgttaacgtttaaccgttttagtaccgggttaattacgacgtaacttaacgttacgttaacgttactacccgttaccgttacgaccgtctaccgttaggttacccgggaggaacccggttaggtacggtcggtaacgaaccggtaactaaccggtgtcgttaacgg

SEQ ID NO: 27533 - DNA, 666 bp, Homo sapiens
  misc_feature: GYAE6OF02J11BD.13.67.G01.1.454.CMB.1.raw
  modified_base (139)..(139): a, c, t, g, unknown or other
  misc_feature (139)..(139): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtncccagggtacatcgtgatgacccagtcctccagtactcccgtggctgtcgtctgtggcgagcggccacatcaacgtgcaagtcctagccagtacgttagttttacacgagccttaccaaactaaataacggtacctttatacgtcttacggtaccaaggcctaacgaaaccgcggacaccggtcccttacctaaggcttacgacttacctaacttttcggtcgtactacctacgtacgtccgggacgttcccgggtccctagaccgtatcgaggttcgcgtaaggtcccggtgtagggtactacgtactttcgacctcgtaccacctagtcgaacgcgtaccgtccgtgtccgtacggcttacgaacgtcgtgtacggtcttaacgtttctaacgtcgtacgagacttaattacgtagttaaccgtccttaccgtcgactaccgtttccgtaacggtttacccgcgggtaacggtaacccggttagggacgttaccgtacggtaacctaacggttcgtacggttccg

SEQ ID NO: 27534 - DNA, 604 bp, Homo sapiens
  misc_feature: GYAE6OF02FYJT5.13.67.G01.1.454.CMB.1.raw
  modified_base (139)..(139): a, c, t, g, unknown or other
  misc_feature (139)..(139): n is a, c, g, or t
  modified_base (237)..(237): a, c, t, g, unknown or other
  misc_feature (237)..(237): n is a, c, g, or t
  modified_base (319)..(319): a, c, t, g, unknown or other
  misc_feature (319)..(319): n is a, c, g, or t
  modified_base (481)..(481): a, c, t, g, unknown or other
  misc_feature (481)..(481): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtncccacggggacatcgtgatgacccagtctccagactccctggctgtgtctctggcgagagggccaccatcaactgcaagtccagccagagtgttttanacagctaccaacaataagaactttcttagcttaggaccagcagaaccaggacagcctacctaagctagtctactatttacgngggacatctagtccgggaatcccggggtccctaggaacccgtattccaggttcggacaggcgggttctggggaccagttattttccacgtacgtccactactacagcctaacgtccgtgacgaggtactacgaagtaatcgggagtactagtttagttacgngttacagtacgaatttacttaatacgttacctacccgtacgtacgtcgtccgtaacgttttcgggaccgggtaacggaccgttagggtacggtaacgtagtaccgaaacgaccgttggtacgg

SEQ ID NO: 27535 - DNA, 659 bp, Homo sapiens
  misc_feature: GYAE6OF02HZGUY.13.67.G01.1.454.CMB.1.raw
  modified_base (432)..(432): a, c, t, g, unknown or other
  misc_feature (432)..(432): n is a, c, g, or t
  modified_base (508)..(508): a, c, t, g, unknown or other
  misc_feature (508)..(508): n is a, c, g, or t
  modified_base (529)..(529): a, c, t, g, unknown or other
  misc_feature (529)..(529): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctgatctcgtggtcgcccgacggggacatcggtagagtcgacccacgtcctccacgaccctcccgtcggctgttgtctcgtgggacgaggacggccaccactacaacgtcgacacgtaccacgaccgagtacgtttagttttaacgtacaccgtacctaccaaaactaaagtaacgtaactttacgttacgtacgttacgtaccacgacgaaacgaaaccgacggaccacgtcctaactacgctctacctacttatttacgtgactactcgtacggtacggtaccggtcccggtcctacgtaccgtnttacgaggtcgacgtcgggtacgggtcgtacggtacgtattactttacgcctcgaccacgcgttacacgctaccgntacgcgacgagagactggttntcgtaagttttaacgcgtgtaactgtaactagttaactagtcttacccgtcgtactccgtacttcggtaccgggaccgggacgtaaggtaccggtagtacgagtaaccgaccggtaacgtggtccgtacg

SEQ ID NO: 27536 - DNA, 598 bp, Homo sapiens
  misc_feature: GYAE6OF02HX578.13.67.G01.1.454.CMB.1.raw
  modified_base (243)..(243): a, c, t, g, unknown or other
  misc_feature (243)..(243): n is a, c, g, or t
  modified_base (322)..(322): a, c, t, g, unknown or other
  misc_feature (322)..(322): n is a, c, g, or t
  modified_base (360)..(360): a, c, t, g, unknown or other
  misc_feature (360)..(360): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgaggagggccaccatcaactgcaagtccagccagagttgttttaanacagctaccaaacaataagaacttctagtcttggtaccagcaagaaaccaggacagcctactaagctgctcatttacgnggcatctacgtaccgggaactccgggtacctgaccgtntacagtggacaggtcggtgtagggactacgtatttcgactctccacactcacgacacgcctgaccgaggtactaggaaagtgttcggtagtacttaaggttttactaacgtcgtactaggaacctaagttattaagtacgtaccgttccctacggtacgtcctacgtcggtttaccgggacgggtaacggaccggtaaaggtcggagtaacgtaaccgaaacggtacggtagtaccgg

SEQ ID NO: 27537 - DNA, 877 bp, Homo sapiens
  misc_feature: GYAE6OF02FN1PQ.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgacgggacatcgtgatcgaccagtctccacgacctccctggtctgtcgtctcgtggcgagacggccacactacaactcgacacgtaccgacgacctagtagttgttttaactacgacgtactaaccgaaactaaacgtaaaggttaacctttaccgttaacggtaccttttacggtaaccgaacgtaccaaaacgtaaaaccccggtaacgggaccgtaaccggtcccctaacccgttaaacggtccgttaccgtaccgttaccgtttaacgtttaccggttacgggtacttaccgtttaccggttaaccgggttaccccggggtaaaccgggtttcccccggggttaccccgttaacggtaacccgttaagtttccggtaagggtccgggaaccggtccgggtaccggggttaccgggtacgggtaacgtaacgtttacgtttacccgtaaccggttcctaaccaacccgtttagacccgtaacttaccggaacctttccgggacggtacggtacgttacgaagggtaaccgttggtacggttcggtacttttaacgttagtacccgtttaagcgtaaacgttacgtaacttttaacttaacgtttccgtaacccgttacccgtacggttcctaccggttaccgtttaaccgggttaccggggaaccgggtaaccggtaccggtaaagggtcgtaagttaaccggtaaacccggaagttccggtaggttcccgg

SEQ ID NO: 27538 - DNA, 772 bp, Homo sapiens
  misc_feature: GYAE6OF02G4NGM.13.67.G01.1.454.CMB.1.raw
  modified_base (515)..(515): a, c, t, g, unknown or other
  misc_feature (515)..(515): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgacggggacatcgtgatcgacccagtcctccacgacctcccgtggctgtcgtctcgtgggcgaggacgggccaccgataccaacgtgaccgtaacgtccgacgacccaaggtagtttagttttaacacgtacgtacctaccaaactaaataaacgtaacctttacttagtacgttaggtaccacgaacaacgaaccgaaggacacgtcctaccgaagcgtcgactactaactttcggacggtactacgtacgtacgtacccgggtaacggtccccgggtaccgtaccggaccggtattcggaacggtcggtaccgacggtcgggtcgaacggtacgtacgttctttaccgactccgtaccaacctgtaaccgngtaccctacgtccgtagtaccggagtcgtaacggtaagttcgtgggttacggtacttttaaggttacttacggttacgtaacgtagtaaccgtttaattaagtttaactaccggtttacctaccggttaccggtacggtttacctaccggggtttcccgggttaaccggggaacggggttaccggaaacgggttacggggtaaaaggaccgggttaaaccgtaaaccggttaaccgggtaggtttaccgtaccgggg

SEQ ID NO: 27539 - DNA, 753 bp, Homo sapiens
  misc_feature: GYAE6OF02FP0FZ.13.67.G01.1.454.CMB.1.raw
tcagtcacgtactacacgaccggtgctcgatttagagtatacatattgggtttggggggagctacaacaggaaggcaggggcagcaagatggtgttgcagacccaggtcttcatttctcttgttgctctggattctcgtggtcgcccgacggggacatcgtgattgacccagtctccagactccctggctggtgtctcgtgggcgaggacgggccaccatcgaactggaacacgtccacggaccagtagtttgttttaactacgacgtcctaaccaaacgtaaaataaacggtacctttacgttaacgtcgttacggtaaccaggtacaaacggaaaaccagggtaccacgtcccgtaccgtaagccttacggtcctacgttaacgtttcgacggtcgtaactccgttaacggtaccccggggtacgttccccggggttaccctacggtacccgttagtttcggacgggtacggtccggaagggttccgggtcgtaacgggaccgtaacgtttaccggtcctactccgtaccgtacgtacgttacgacggtacctacgccgtacggtaccggcggtacgtaacggtaacgtagtcgggttaactacgttagtttacgttaacgtcgtacggtactaagttaacttacgtttaacgaaccttacgttccgtactccgtactccggttacgtcgggacggtaggaaccgtagggacgtcggtaacaccgttaaacggtacggtacggtcgtaacg

SEQ ID NO: 27540 - DNA, 729 bp, Homo sapiens
  misc_feature: GYAE6OF02FW70H.13.67.G01.1.454.CMB.1.raw
  modified_base (345)..(345): a, c, t, g, unknown or other
  misc_feature (345)..(345): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatccaactgacaacgtccagccagtagttgttttatacagcctaccaacaataacgtaacttcttaagctttaggaacctagcaaagtaaacccaggaacacggtcctacctaacgcttgccttactattttacgngggactagttcgttaacgtccggggtaacgttccccgggggttaccctacggtacccgtaactttcgaacggttcgggcgtacgggtcggggtacgtcggggtaactacggttacgtttccacgtttcctaacgtcccagttaccacggaccgtaggcccttaggaccgtacggtacgtaggaacgtagttacggcggtactttacggttttaatacgtcggtactaggtaacttaagttacttaacgttaaccgttaccttacccgtcgtacgttccgtaaccgtttccggttaccgggggaaccggttaacccgggtaacggtaacgggggttacggtaacttaaccggtaaccgtaaaccggtaaccgttgggtaacccgg

SEQ ID NO: 27541 - DNA, 737 bp, Homo sapiens
  misc_feature: GYAE6OF02HWUG6.13.67.G01.1.454.CMB.1.raw
  modified_base (211)..(211): a, c, t, g, unknown or other
  misc_feature (211)..(211): n is a, c, g, or t
  modified_base (400)..(400): a, c, t, g, unknown or other
  misc_feature (400)..(400): n is a, c, g, or t
  modified_base (512)..(512): a, c, t, g, unknown or other
  misc_feature (512)..(512): n is a, c, g, or t
  modified_base (525)..(525): a, c, t, g, unknown or other
  misc_feature (525)..(525): n is a, c, g, or t
tcagtcacgtactacacgaccggtgctcgatttagagtatacatattgggtttgggggggggaggaggagccccagccctgagattcccacgtgttgccattcggtgatcagcgctgaacacagaggactcgccatggagtttgggctgagcttgggttttccttgttgcttaattttaaaaggtgtccagtgtgaggtgcagctggtagngtcgtgggggagtgtcggtacggccgtgggggtccctgagactctcctgtcgccaacctcgtggattcagtatttgatgagtagtgacatacgtacgtcgggacccgtacccaacccgtccggaagggggtacgggctggacgtaggtcgggttctcgtacgtaataaacgtggtaagtggtcgacganacctaactaacttgcgactacgactcgtaggtacggaacgggtcctagtacccaatacgtacctccgtaagaaccgtaacgcggtacgaacgtaaccgtactacccgttaanacgtctaccgaanaacgtagaaacgtcgttaacccgtgggaaccgttaggaaccgtaccgtacccggtttacgtttaattttacggttccgttacggggtgtaaaccgggtttcggggtttaacacccgtttagggggttaaccggttacccggtttaacccgggtttaaaccttccgggtaaaccggtaaccggtttagggggttaacccccggtaacgggggg

SEQ ID NO: 27542 - DNA, 651 bp, Homo sapiens
  misc_feature: GYAE6OF02G9C6F.13.67.G01.1.454.CMB.1.raw
  modified_base (271)..(271): a, c, t, g, unknown or other
  misc_feature (271)..(271): n is a, c, g, or t
  modified_base (637)..(637): a, c, t, g, unknown or other
  misc_feature (637)..(637): n is a, c, g, or t
tcagtcacgtactacacgaccggtgctcgatttagagtatacatattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagtctggtggagtcgtgggggaggcttggtccagccgtggggggtccctgagactctcctgtgcagccttntggattctacctttagtcgacttagttggactggacgtcgtcgggtcccgccacgggtcctaccgaggggacgggtcgtggaggtgggtcgaccaacgataagctaagttcggaagtagaagaaatactagtagtgactcgttagtaggaagggtcccgtaatttccgaccctatccctaccgaacggacgtaaccaccggtacccaaagtacctactacgttacgttatcctacgaacaaggttacgaaactccgtaccgtagacgtacggccggtacggaaacgtccgtactgtacctttaacggttcgtggttacgacggttaacggagtttaacggggttgggggtaaccggaacggtttanaccggtagtcgggg

SEQ ID NO: 27543 - DNA, 783 bp, Homo sapiens
  misc_feature: GYAE6OF02JQVV1.13.67.G01.1.454.CMB.1.raw
  modified_base (710)..(710): a, c, t, g, unknown or other
  misc_feature (710)..(710): n is a, c, g, or t
  modified_base (725)..(725): a, c, t, g, unknown or other
  misc_feature (725)..(725): n is a, c, g, or t
tcagtcacgtactacacgaccggtgctcgatttagagtatacatattgggtttggggaggtctcagagaggagccttagccctggactccaaggcctttccacttggtgatcagcactgagcacagaggactcaccatggaattggggctgagctgggtttttccttgttgctattttagaggtgtccagtgtgaggtgcagcgtggtggagtcggtggggggaggtcttgggccaggccgtcggggggtccctggagacttcgtcctgtcgcacgcctgtggtacttccgtaccttttaggtacgtcttacgttggtataggacgtacggttcggggtcccgaccgtacggtcccgtaccggaacggggggaacggggtcggtaggggacgggtttcgggggtaccggaaccccgtaaacgtaacgtaaaacggtcggtaaacgggttagggtaaggtaggtaaaagaaacgttaccggtaagttcggtacggtaccgttggtagggtacgggaacggggttaccgtaactttacccggaaccctagttaccgtaaccccgaaggaaccgaaccggtaaccaacccgaaacgtaacctacgtaacgtgttaactacgttaccgaaccgttaaataaaccgaaccgtagtaccgtaacggaacggtaccggaacgggtaaaccgccgaaaccggttctcgtttaaccgtntttaaccggtggganaccggtaaggaggttacggggtaggggtaaccgaaagttttacgacgggttcaacggg

SEQ ID NO: 27544 - DNA, 894 bp, Homo sapiens
  misc_feature: GYAE6OF02IJ6K4.13.67.G01.1.454.CMB.1.raw
tcagtcacgtactacacgaccggtgctcgatttagagtatacatattgggtttgggggagctacaacaggcaggcaggggcagcaagatggtgttgcagacccaggtcttcatttctctgttgctctggatctcgtggtcgcccgacggggacatcgtgatcggacccagtcctaccacgtacctcccgtggcttggtcgtcctcggtcgggacgaggacgggcccaaccgtattacaacgtgaccgtaacgtaccgacgtaccgaggttaagttttatttaacgtacgacgtacctacaaacgtaaattaaacgtaacgtttacttaggtcgttacggtaccagacaacgtaaaccgacggtaccacggtacccctaacgtaacgtccgttacgtaccctttacgttaaccggttttacgggtacgggtaccttaaacgtttcccgggtaaacccgggggttaccccggggttaaaccggggtttccccccggggggttaccccgttaaccgggtaaacccgttttacggtttaccggggttaccggggttacgggaaccccggttagggggttaccccggggtttacggggtaaacccgggggtaacttaccgggtttacccttttacccggtacccgttaacccgttaccgtaaccgtactacggaccgtacgtaccgtccgtcggaaccgtacggtacggtacggtaagttaccggttaggtacgttacggttaacgttttacgttacggtacgtacgtacgttaattaacttaaccgttacgtacttaccgtccgtacgtacgtactaccggtacggtaccgggtacggtaacgggtaccgttaaggggtctaacggtacgtaaccggtacggttcggtggtaacccgg

SEQ ID NO: 27545 - DNA, 766 bp, Homo sapiens
  misc_feature: GYAE6OF02JZPT3.13.67.G01.1.454.CMB.1.raw
  modified_base (162)..(162): a, c, t, g, unknown or other
  misc_feature (162)..(162): n is a, c, g, or t
  modified_base (389)..(389): a, c, t, g, unknown or other
  misc_feature (389)..(389): n is a, c, g, or t
tcagtcacgtactacacgaccggtgctcgatttagagtatacatattgggtttgggggagctacaacaggcaggcagggcagcaagatggtgttgcagacccgaggtcttcatttctctgttgctctggactcttctggtcgcccgacggggacagtcgtgntcgaccctagtctccagcctccgtgctgtcgtcgtcgtgggcgagacggcctacgatccaagtgacgaacggttcccaaggccgtaagtacggtttagttttaacgacgacgtcctaaccgaaactaagtaaactactttcgtacgtcgttacggtaccagacgtaaagaaccgaagtaccaacggtccttacccgtaagctacgtacctacgttacggttaaccgngggtacctaacgtaccgttaaccggtaacccgggtaaccggtttccccgggaacctttaccggaaaccgtttcgttacggtaacggtcggtacggacgggttcccgggtaacgtacgggaaccgttcgttaaactttccgtaaacccgttcgtaaccctacgtacgtaccggtacgtacgtacgtccgttaacggcgtaccggtagttaacggacgttcgtagggtcggttacttaggtttaacgtccgtaatcgtaaagtacgttaaagttctttaaacgttcccgtcgttacccgtacgacgtcttacggtaccggtacggcgggttaacggacgttacggagtaacgttacgaaccgtaaggccgttaggcccg

SEQ ID NO: 27546 - DNA, 770 bp, Homo sapiens
  misc_feature: GYAE6OF02JCX49.13.67.G01.1.454.CMB.1.raw
tcagtcacgtactacacgaccggtgctcgatttagagtatacatattgggtttggggaggtctcagagaggagccttagccctggactccaaggcctttccacttggtgatcagcactgagcacagaggactcaccatggaattggggctgagctgggtttcctgttgctatttaaaggtgcccagtgtgaggtgcagcgtggtggagtcgtgggaggaggcttggactccgagtcccggttggggggtccctggacgactcgtccgtgtggcacgtcctcgtcgggttccaccgtcacgtcacgtacctacagtcgacgtcggtcggggtacccgaccgtacggtacccgtccggaagggggtaacggggcgtggggaaggttccggtccggtttcctttagtttttaagtttaacgtaggttacggtttagggtaacgtactacttacgtccgataccgtacgtcggtggacggggtcctacgttaccgaacctacgttccgttaccgaacggtaacgaaccgttaaacttacccgaaacgtaaccgtaccgttgtttacgtttaccgtaaactaaacgtacgtaacgtacggtaccgtaggtaacgtaaccggtcgtaaacggtcggtaacccggtaacgggttccgtaggttttaaccgttcggttaggaccggtaacggggaagtaaccgggtcggacccggggtaaaccctaacggtttaaaccggtccgtaaacggtcccgttaaggtcccggttaaccgggg

SEQ ID NO: 27547 - DNA, 440 bp, Homo sapiens
  misc_feature: GYAE6OF01COU5Q.9.80.H03.1.454.CMB.1.raw
  modified_base (433)..(440): a, c, t, g, unknown or other
  misc_feature (433)..(440): n is a, c, g, or t
tcagtgatacgtctcacgaccggtgctcgatttagctgtgcgtcgaagggaaaggggctggtgtgggtcgcacgtattaatgaagacgggactactataaattacgcggactccgtgaagggccgattcaccatctccagagacgacgccaagaacacgctgtatctgcaaatgaacagtctgagagtcgaggacacggctgtatattactgcgcaaaggattgtttcggggagactgactcctggggccagggaaccctggtcaccgtctcctcagcctccaccaagggcccatcggtccttccccctggccgcccctgcctcccaggacgccaccctccgagacgccacaggccggcccctgggcctcggcctgggtcaaggacctacttccgagacgttatcaactgagcgggctggcaaggcgcatagnnnnnnnn

SEQ ID NO: 27548 - DNA, 443 bp, Homo sapiens
  misc_feature: GYAE6OF01DLTST.9.80.H03.1.454.CMB.1.raw
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
  modified_base (433)..(443): a, c, t, g, unknown or other
  misc_feature (433)..(443): n is a, c, g, or t
tcagtgatacgtctcacgaccggtgctcgatttagctgtgcgtcgaagggaaaggggctggtgtgggtcgcacgtattaatgaagacgggactactataaattacgcggactccgtgaagggccgattcaccatctccagagacgacgccaagaacacgctgtatctgcaaatgaacagtctgagagtcgaggacacggctgtatattactgcgacaaaaggnttggttcgggganactgactccgtgggccagggaccctggtccacgtctcctcagcctccaccaacgggcccatccggtcttccccctggccgccctgcctccgaggcgccacctccgagacgcacgagccggccctgggctgcctggtacaacggtacctacttaccgagtacgtatcacgtgagcgggntggcaaggcgnagtagnannnnnnnnnnn

SEQ ID NO: 27549 - DNA, 154 bp, Homo sapiens
  misc_feature: GYAE6OF01BX3FC.31.24.C02.1.454.CMB.1.raw
  modified_base (154)..(154): a, c, t, g, unknown or other
  misc_feature (154)..(154): n is a, c, g, or t
tcagcagtagacgtcacgaccggtgctcgatttagtacagatcgttagggaaagggaccatggtggacgtcaaacgaactgtggctgcaccatctgtcttcatcttcccgccatctgaacgtctactgctgagcgggctggcaaggcgcatagn

SEQ ID NO: 27550 - DNA, 576 bp, Homo sapiens
  misc_feature: GYAE6OF01EZ4XS.31.24.C02.1.454.CMB.1.raw
  modified_base (184)..(188): a, c, t, g, unknown or other
  misc_feature (184)..(188): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (197)..(199): a, c, t, g, unknown or other
  misc_feature (197)..(199): n is a, c, g, or t
  modified_base (201)..(203): a, c, t, g, unknown or other
  misc_feature (201)..(203): n is a, c, g, or t
  modified_base (205)..(205): a, c, t, g, unknown or other
  misc_feature (205)..(205): n is a, c, g, or t
  modified_base (207)..(208): a, c, t, g, unknown or other
  misc_feature (207)..(208): n is a, c, g, or t
  modified_base (210)..(210): a, c, t, g, unknown or other
  misc_feature (210)..(210): n is a, c, g, or t
  modified_base (212)..(213): a, c, t, g, unknown or other
  misc_feature (212)..(213): n is a, c, g, or t
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (233)..(234): a, c, t, g, unknown or other
  misc_feature (233)..(234): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (267)..(268): a, c, t, g, unknown or other
  misc_feature (267)..(268): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
tcagcagtagacgtcacgaccggtgctcgatttagtacagatcgttagggtaaaggggtaccggagtaggtggacgtcaaacggtaacgtcgtggcgtacgcaccgaatccctgtctttcatcctttcccgcctactcctgaacgtctactgctcgagcgggctgggcaaaggtcgctagtagnnnnngcncntntnnngnnncncnncngnngcngcgngtntagtatatgnngacacanacngcngcncncgctcnctntntntnntgtctacacgagcgcgtcggccgccgccgtcgtcgngngcgtggtggtcggcggacgacgtacgtctctctccgaccgtcgacgacgacgtcgtacgacgtacgtacgtacgttacgtttacgttacgtttacgttacttcgtcgacgaccgtacgtcgtccgtccgtccggtccgtaccgttaccggttcgggtcggggtacgggtagggtcgggaggaggacggtacggtacggtcggtcggtcgtcgtccgtacgtcgtcgttcgttcttctccttccttccctcctactatacgtagtcgtacg

SEQ ID NO: 27551 - DNA, 154 bp, Homo sapiens; identical to SEQ ID NO: 27549
  misc_feature: GYAE6OF01E3FYE.31.24.C02.1.454.CMB.1.raw
  modified_base (154)..(154): a, c, t, g, unknown or other
  misc_feature (154)..(154): n is a, c, g, or t

SEQ ID NO: 27552 - DNA, 155 bp, Homo sapiens
  misc_feature: GYAE6OF01CMOMD.31.24.C02.1.454.CMB.1.raw
  modified_base (154)..(155): a, c, t, g, unknown or other
  misc_feature (154)..(155): n is a, c, g, or t
tcagcagtagacgtcacgaccggtgctcgatttagtacagatcgttagggaaagggaccatggtggacgtcaaacgaactgtggctgcaccatctgtcttcatcttcccgccatctgaacgtctactgctgagcgggctggcaaggcgcatagnn

SEQ ID NO: 27553 - DNA, 155 bp, Homo sapiens
  misc_feature: GYAE6OF01BBAII.31.24.C02.1.454.CMB.1.raw
  modified_base (154)..(155): a, c, t, g, unknown or other
  misc_feature (154)..(155): n is a, c, g, or t
tcagcagtagacgtcacgaccggtgctcgatttagtacagatcgttagggaaagggaccatggtggacttcaaacgaactgtggctgcaccatctgtcttcatcttcccgccatctgaacgtctactgctgagcgggctggcaaggcgcatagnn

SEQ ID NO: 27554 - DNA, 168 bp, Homo sapiens
  misc_feature: GYAE6OF01CT2Z5.31.24.C02.1.454.CMB.1.raw
  modified_base (149)..(168): a, c, t, g, unknown or other
  misc_feature (149)..(168): n is a, c, g, or t
tcagcagtagacgtcacgaccggtgctcgatttagtacagatcgttagggaaggaccatggtggacgtcaacgaactgtggctgcaccatctgtcttcatcttccgcatctgaacgtctactgctgagcgggctggcaaggcgcatagnnnnnnnnnnnnnnnnnnnn

SEQ ID NO: 27555 - DNA, 168 bp, Homo sapiens
  misc_feature: GYAE6OF02IM4X5.31.24.C02.1.454.CMB.1.raw
  modified_base (156)..(168): a, c, t, g, unknown or other
  misc_feature (156)..(168): n is a, c, g, or t
tcagcagtagacgtcacgaccggtgctcgatttagtacagatcgttagggaaaggggaccatggtggacgtcaaacgaactgtggctgcaccatctgtcttcatcttcccgccatctgaacgtctactgctggagcgggctggcaaggcgcatagnnnnnnnnnnnnn

SEQ ID NO: 27556 - DNA, 154 bp, Homo sapiens; identical to SEQ ID NO: 27549
  misc_feature: GYAE6OF02H4FVU.31.24.C02.1.454.CMB.1.raw
  modified_base (154)..(154): a, c, t, g, unknown or other
  misc_feature (154)..(154): n is a, c, g, or t

SEQ ID NO: 27557 - DNA, 155 bp, Homo sapiens
  misc_feature: GYAE6OF02HF8CW.31.24.C02.1.454.CMB.1.raw
  modified_base (154)..(155): a, c, t, g, unknown or other
  misc_feature (154)..(155): n is a, c, g, or t
tcagcagtagacgtcacgaccggtgctcgatttagtacagatcgttagggaaagggaccaaggtggagatcaaacgaactgtggctgcaccatctgtcttcatcttcccaccctcctcacgtctactgctgagcgggctggcaaggcgcatagnn

SEQ ID NO: 27558 - DNA, 161 bp, Homo sapiens
  misc_feature: GYAE6OF02FWVX8.31.24.C02.1.454.CMB.1.raw
  modified_base (154)..(161): a, c, t, g, unknown or other
  misc_feature (154)..(161): n is a, c, g, or t
tcagcagtagacgtcacgaccggtgctcgatttagtacagatcgttagggaaagggaccaaggtggagatcaaacgaactgtggctgcaccatctgtcttcatcttcccaccctcctcacgtctactgctgagcgggctggcaaggcgcatagnnnnnnnn

SEQ ID NO: 27559 - DNA, 154 bp, Homo sapiens; identical to SEQ ID NO: 27549
  misc_feature: GYAE6OF02FO2A6.31.24.C02.1.454.CMB.1.raw
  modified_base (154)..(154): a, c, t, g, unknown or other
  misc_feature (154)..(154): n is a, c, g, or t

SEQ ID NO: 27560 - DNA, 290 bp, Homo sapiens
  misc_feature: GYAE6OF01CXTUW.30.1.A01.1.454.CMB.1.raw
  modified_base (287)..(290): a, c, t, g, unknown or other
  misc_feature (287)..(290): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctggtcactctgttcccacctctcacgtagcgtgctgagcggctggcaaggcgcatagnnnn

SEQ ID NO: 27561 - DNA, 301 bp, Homo sapiens
  misc_feature: GYAE6OF01EUU61.30.1.A01.1.454.CMB.1.raw
  modified_base (287)..(301): a, c, t, g, unknown or other
  misc_feature (287)..(301): n is a, c, g, or t
tcagcacgctacgtcacgaccggtgctcgatttagacgtctcatcagggatcccagaccgattctctggctccagctcaggaaacacagcttccttgaccatcactgggctcaggcggaagatgaggctgactattactgtaactcccgggacaccagtggtaacagtcgggagtgttcggcggagggaccaagctgaccgtcctaggtcagcccaaggctgccccctggtcactctgttcccacctcctcacgtagcgtgctgagcggctggcaaggcgcatacgnnnnnnnnnnnnnnn

SEQ ID NO: 27562 - DNA, 317 bp, Homo sapiens
  misc_feature: GYAE6OF01COFR2.30.1.A01.1.454.CMB.1.raw
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
  modified_base (288)..(317): a, c, t, g, unknown or other
  misc_feature (288)..(317): n is a, c, g, or t
tcagcacgctacgtcacgaccggtgctcgatttagacgtctcatcagggatcccagaccgattctctggctccagctcaggaaacacagcttccttgaccatcactgggctcaggcggaagatgaggctgactattactgtaaactcccgggacaccagtggtaacagtcggggagtgttcggcggagggaccaagctgaccgtcctaggtcagcccaaggctgccccctggtcactctgtcccacctcctnacgtagcgtgctgagcgggctggcaaggcncatagnnnnnnnnnnnnnnnnnnnnnnnnnnnnnn

SEQ ID NO: 27563 - DNA, 306 bp, Homo sapiens
  misc_feature: GYAE6OF01CC1QU.30.1.A01.1.454.CMB.1.raw
  modified_base (289)..(306): a, c, t, g, unknown or other
  misc_feature (289)..(306): n is a, c, g, or t
tcagcacgctacgtcacgaccggtgctcgatttagacgtctcatcagggatcccagaccgattctctggctccagctcaggaacacagcttccttgaccatcactgggctcaggcggaagatgaggctgactattactgtaactcccgggacaccagtggtaacagtcggggagtgttcggcggagggaccaagctgaccgtctaggtcagcccaaggctgccccctggtaactctgttcccaccctcctcacgtagcgtgctgagtccgggctggcaaggcgcatagnnnnnnnnnnnnnnnnnn

SEQ ID NO: 27564 - DNA, 294 bp, Homo sapiens
  misc_feature: GYAE6OF01BEXDY.30.1.A01.1.454.CMB.1.raw
  modified_base (291)..(294): a, c, t, g, unknown or other
  misc_feature (291)..(294): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctcggtcactctgttcccaccctcctcacgtagcgtgctgagcgggctggcaaggcgcatagnnnn

SEQ ID NO: 27565 - DNA, 292 bp, Homo sapiens
  misc_feature: GYAE6OF01A0D2Q.30.1.A01.1.454.CMB.1.raw
  modified_base (288)..(292): a, c, t, g, unknown or other
  misc_feature (288)..(292): n is a, c, g, or t
tcagcacgctacgtcacgaccggtgctcgatttagacgtctcatcagggatcccagaccgattctctggctccagctcaggaaacacagcttccttgaccatcactgggctcaggcggaagatgaggctgactattactgtaactcccgggacaccagtggtaacagtcgggagtgttcggcggagggaccaagctgaccgtcctaggtcagcccaaggctgcccctcggtcactctgttcccaccctcctcacgtagcgtgctgagcgggctggcaaggcgcatagnnnnn

SEQ ID NO: 27566 - DNA, 293 bp, Homo sapiens
  misc_feature: GYAE6OF01CRBLS.30.1.A01.1.454.CMB.1.raw
  modified_base (288)..(293): a, c, t, g, unknown or other
  misc_feature (288)..(293): n is a, c, g, or t
tcagcacgctacgtcacgaccggtgctcgatttagacgtctcatcagggatcccagaccgattctctggctccagctcaggaacacagcttccttgaccatcactgggctcaggcggaagatgaggctgactattactgtaactcccgggacaccagtggtaacagtcggggagtgttcggcggagggaccaagctgaccgtcctaggtcagcccaaggctgccccctggtcactctgttcccaccctcctcacgtagcgtgctgagcgggctggcaaggcgcatagnnnnnn

SEQ ID NO: 27567 - DNA, 294 bp, Homo sapiens
  misc_feature: GYAE6OF01A368A.30.1.A01.1.454.CMB.1.raw
  modified_base (289)..(294): a, c, t, g, unknown or other
  misc_feature (289)..(294): n is a, c, g, or t
tcagcacgctacgtcacgaccggtgctcgatttagacgtctcatcagggatcccagaccgattctctggctccagctcaggaaacacagcttccttgaccatcactgggctcaggcggaagatgaggctgactattactgtaactcccgggacaccagtggtaacagtcggggagtgttcggcggagggaccaagctgaccgtcctaggtcagcccaaggctgccccctggtcactctgttcccaccctcctcacgtagcgtgctgagcgggctggcaaggcgcatagnnnnnn

SEQ ID NO: 27568 - DNA, 290 bp, Homo sapiens
  misc_feature: GYAE6OF01CPQ21.30.1.A01.1.454.CMB.1.raw
  modified_base (284)..(290): a, c, t, g, unknown or other
  misc_feature (284)..(290): n is a, c, g, or t
tcagcacgctacgtcacgaccggtgctcgatttagacgtctcatcagggatcccagaccgattctctggctccagctcaggaaacacagcttccttgaccatcactgggctcaggcggaagatgaggctgactattactgtaacctcccgggacaccagtggtaacaggtcgggagtgttcggcggaggaccaagctgaccgtctaggtcagccaaggctcgcccctggtcactctcgtcccacctctcacgtgcgtgctgagcgggctggcaaggcgcatagnnnnnnn

SEQ ID NO: 27569 - DNA, 310 bp, Homo sapiens
  misc_feature: GYAE6OF01BX97I.30.1.A01.1.454.CMB.1.raw
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
  modified_base (296)..(310): a, c, t, g, unknown or other
  misc_feature (296)..(310): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccgagttggtaacaggtcggggtagtgttcggcggagggaccaagctgaccgtctaggtcagccaaggctcgccccctggtcactcgtcgttcccgcctctcacgtagcgtncctgacgcgggctggctaaggctnaatgnnnnnnnnnnnnnnn

SEQ ID NO: 27570 - DNA, 297 bp, Homo sapiens
  misc_feature: GYAE6OF01DLOTW.30.1.A01.1.454.CMB.1.raw
  modified_base (286)..(287): a, c, t, g, unknown or other
  misc_feature (286)..(287): n is a, c, g, or t
  modified_base (290)..(297): a, c, t, g, unknown or other
  misc_feature (290)..(297): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtgtaacagtcggggagtgtcggcggaggaccaagctgaccgtctaggtcagccaagctcgccccctggtcactctcgttcccaccctcctcacgtagcgtgctgaggcggctggcaaggcgcatagnntgnnnnnnnn

SEQ ID NO: 27571 - DNA, 323 bp, Homo sapiens
  misc_feature: GYAE6OF01ACBOR.30.1.A01.1.454.CMB.1.raw
  modified_base (155)..(155): a, c, t, g, unknown or other
  misc_feature (155)..(155): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (294)..(302): a, c, t, g, unknown or other
  misc_feature (294)..(302): n is a, c, g, or t
  modified_base (304)..(305): a, c, t, g, unknown or other
  misc_feature (304)..(305): n is a, c, g, or t
  modified_base (307)..(323): a, c, t, g, unknown or other
  misc_feature (307)..(323): n is a, c, g, or t
tcagcacgctacgtcacgaccggtgctcgatttagacgtctcatcaggggatcccagaccgattctctggctccagctcaggaaacacagcttccttgaccatcactggggctcaggcggaagatgaggctgactattactgtaactcccggganaccagtggtaacagtcggggagtgttcggcggagggaccaagctgaccgtctaggtcagcccaaggctcgccccctggtcactctcgttccccaccctcctcacgtagcgtgctgagcggctggcaaggcncatcgntnnnnnnnnntnnannnnnnnnnnnnnnnnn

SEQ ID NO: 27572 - DNA, 352 bp, Homo sapiens
  misc_feature: GYAE6OF01A5TJU.30.1.A01.1.454.CMB.1.raw
  modified_base (305)..(305): a, c, t, g, unknown or other
  misc_feature (305)..(305): n is a, c, g, or t
  modified_base (307)..(352): a, c, t, g, unknown or other
  misc_feature (307)..(352): n is a, c, g, or t
tcagcacgctacgtcacgaccggtgctcgatttagacgtctcatcagggatcccagaccgattctctggctccagctcaggaaacacagcttccttgacccatcactggggctcaggcggaagatggaggctgactattactgtaactcccgggacaccagtggtaacagtcggggagtgttcggcggagggacaagcgtgaccgtcctaggtcacgccaaggcctcgccccctggtcactctctccccaccctcctcacgtcgccgtgcgtagagcgggctggacgaaggccgacacgtagcancnnnnnnnnnnnnnnnnnnnnnnnnnnnnnnnnnnnnnnnnnnnnnn

SEQ ID NO: 27573 - DNA, 296 bp, Homo sapiens
  misc_feature: GYAE6OF01EZF15.30.1.A01.1.454.CMB.1.raw
  modified_base (293)..(296): a, c, t, g, unknown or other
  misc_feature (293)..(296): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctcgccccctggtcactctcgttccccgccctcctcacgtagcgtgctgagcgggctggcaaggcgcatagnnnn

SEQ ID NO: 27574 - DNA, 297 bp, Homo sapiens
  misc_feature: GYAE6OF01EXUPL.30.1.A01.1.454.CMB.1.raw
  modified_base (289)..(297): a, c, t, g, unknown or other
  misc_feature (289)..(297): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccggacaccagtggtaacagtcggggagtgttcggcggaggaccaagctgaccgtcctaggtcagcccaaggctcgccccctggtcactctcgttcccacctcctcacgtagcgtgctgagcgggctggcaaggcgcatagnnnnnnnnn

SEQ ID NO: 27575 - DNA, 378 bp, Homo sapiens
  misc_feature: GYAE6OF01CKE34.30.1.A01.1.454.CMB.1.raw
  modified_base (333)..(336): a, c, t, g, unknown or other
  misc_feature (333)..(336): n is a, c, g, or t
  modified_base (338)..(338): a, c, t, g, unknown or other
  misc_feature (338)..(338): n is a, c, g, or t
  modified_base (341)..(344): a, c, t, g, unknown or other
  misc_feature (341)..(344): n is a, c, g, or t
  modified_base (347)..(378): a, c, t, g, unknown or other
  misc_feature (347)..(378): n is a, c, g, or t
tcagcacgctacgtcacgaccggtgctcgatttagacgtctcatcagggatcccagaccgattctctggctccagctcaggaaacacagcttccttgaccatcacgtggggctcaggcggaagatgaggctgactattactgtaaccgtcccgggacaccagtggtaaccaggtcggggagtggttcggcggacgggaccaagctcgacccgtcctaggtccaggcccgaaggcctccgcccccgtcggtcaccgttcctccgttccccgcccctcctccgtaccgtagtcgtgccttggacggccgggctcgggacgaacggcgacagtgannnnanctnnnngcnnnnnnnnnnnnnnnnnnnnnnnnnnnnnnnn

SEQ ID NO: 27576 - DNA, 293 bp, Homo sapiens
  misc_feature: GYAE6OF02GEDFW.30.1.A01.1.454.CMB.1.raw
  modified_base (291)..(293): a, c, t, g, unknown or other
  misc_feature (291)..(293): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctcggtcactctgttcccaccctcctcacgtagcgtgctgagcgggctggcaaggcgcatagnnn

SEQ ID NO: 27577 - DNA, 299 bp, Homo sapiens
  misc_feature: GYAE6OF02G7BMZ.30.1.A01.1.454.CMB.1.raw
  modified_base (293)..(299): a, c, t, g, unknown or other
  misc_feature (293)..(299): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctcggtcactctcgttccccaccctcctcacgtagcgtgctgagcgggctggcaaggcgcatagnnnnnnn

SEQ ID NO: 27578 - DNA, 299 bp, Homo sapiens
  misc_feature: GYAE6OF02IW82N.30.1.A01.1.454.CMB.1.raw
  modified_base (292)..(299): a, c, t, g, unknown or other
  misc_feature (292)..(299): n is a, c, g, or t
tcagcacgctacgtcacgaccggtgctcgatttagacgtctcatcagggatccagaccgattctctggctccagctcaggaaacacagcttccttgaccatcactgggctcaggcggaagatgaggctgactattactgtaactccgggacaccagtggtaacagtcgggagtgttcggcggagggaccaagctgaccgtctaggtcagcccaaggctggcccctcggtacactctgttcccaaccctcctcacgtagcgtgctgaagcgggctggacaaggtcgctatagnnnnnnnn

SEQ ID NO: 27579 - DNA, 293 bp, Homo sapiens
  misc_feature: GYAE6OF02I31W6.30.1.A01.1.454.CMB.1.raw
  modified_base (289)..(293): a, c, t, g, unknown or other
  misc_feature (289)..(293): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctggtcactctgttcccacctcctcacgtagcgtgctgagcgggctggcaaggcgcatagnnnnn

SEQ ID NO: 27580 - DNA, 297 bp, Homo sapiens
  misc_feature: GYAE6OF02G44T6.30.1.A01.1.454.CMB.1.raw
  modified_base (289)..(297): a, c, t, g, unknown or other
  misc_feature (289)..(297): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctggtcactctgttcccaccctcctcacgtagcgtgctgagcggctggcaaggcgcatagnnnnnnnnn

SEQ ID NO: 27581 - DNA, 296 bp, Homo sapiens
  misc_feature: GYAE6OF02IZOQL.30.1.A01.1.454.CMB.1.raw
  modified_base (290)..(296): a, c, t, g, unknown or other
  misc_feature (290)..(296): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctggtcactctcgttcccaccctcctcacgtgcgtgctgagcgggctggcaaggcgcatagnnnnnnn

SEQ ID NO: 27582 - DNA, 293 bp, Homo sapiens
  misc_feature: GYAE6OF02GDM1G.30.1.A01.1.454.CMB.1.raw
  modified_base (291)..(293): a, c, t, g, unknown or other
  misc_feature (291)..(293): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctcggtcactctgttcccgccctcctcacgtagcgtgctgagcgggctggcaaggcgcatagnnn

SEQ ID NO: 27583 - DNA, 299 bp, Homo sapiens
  misc_feature: GYAE6OF02HU3V3.30.1.A01.1.454.CMB.1.raw
  modified_base (292)..(299): a, c, t, g, unknown or other
  misc_feature (292)..(299): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctcggtcactcctgttccccgccctcctcacgtagcgtgctgagcggctggcaaggcgcatagnnnnnnnn

SEQ ID NO: 27584 - DNA, 297 bp, Homo sapiens
  misc_feature: GYAE6OF02IM7ZG.30.1.A01.1.454.CMB.1.raw
  modified_base (285)..(285): a, c, t, g, unknown or other
  misc_feature (285)..(285): n is a, c, g, or t
  modified_base (291)..(297): a, c, t, g, unknown or other
  misc_feature (291)..(297): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtctaggtcagcccaaggctgccccctggtcactctcgttccccaccctcctcacgtagcgtgctgagcgggctggcaaggcncatagnnnnnnn

SEQ ID NO: 27585 - DNA, 437 bp, Homo sapiens
  misc_feature: GYAE6OF02GRZ92.30.1.A01.1.454.CMB.1.raw
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (314)..(315): a, c, t, g, unknown or other
  misc_feature (314)..(315): n is a, c, g, or t
  modified_base (317)..(317): a, c, t, g, unknown or other
  misc_feature (317)..(317): n is a, c, g, or t
  modified_base (329)..(330): a, c, t, g, unknown or other
  misc_feature (329)..(330): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (348)..(349): a, c, t, g, unknown or other
  misc_feature (348)..(349): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (393)..(395): a, c, t, g, unknown or other
  misc_feature (393)..(395): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (401)..(402): a, c, t, g, unknown or other
  misc_feature (401)..(402): n is a, c, g, or t
  modified_base (407)..(409): a, c, t, g, unknown or other
  misc_feature (407)..(409): n is a, c, g, or t
  modified_base (411)..(414): a, c, t, g, unknown or other
  misc_feature (411)..(414): n is a, c, g, or t
  modified_base (416)..(418): a, c, t, g, unknown or other
  misc_feature (416)..(418): n is a, c, g, or t
  modified_base (421)..(426): a, c, t, g, unknown or other
  misc_feature (421)..(426): n is a, c, g, or t
  modified_base (428)..(428): a, c, t, g, unknown or other
  misc_feature (428)..(428): n is a, c, g, or t
  modified_base (430)..(435): a, c, t, g, unknown or other
  misc_feature (430)..(435): n is a, c, g, or t
tcagcacgctacgtcacgaccggtgctcgatttagacgtctcatcagggatccgagaccgatctctgctcagctcaggaacacagcttccttgaccatcacgtgggctcgaggcgaagactggaggctgactattactgtaactccggacaccagtgtaacagtcgggatgtcggcggagggaccaagctgaccgtctaggtcagccaaggctgcccctggtaactcgtcgttcccacctctcacgtacgcgtcgctggacgtccgggctggacaaggtcncgtatagcncacgtgacgcagtcncgngcgngnngnagcgacacgtanntangagagcgtcgncatnnactcgcncactcacncacgnacgntanctnancgtanctagcannnananannacacnnncnnnnannntgnnnnnntntnnnnnncg

SEQ ID NO: 27586 - DNA, 303 bp, Homo sapiens
  misc_feature: GYAE6OF02G64P1.30.1.A01.1.454.CMB.1.raw
  modified_base (293)..(303): a, c, t, g, unknown or other
  misc_feature (293)..(303): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacaggtcggggagtgttcggcggagggaccaagctgaccgtcctaggtcagcccaaggctcgccccctcggtcactctcgttccccaccctcctcacgtgcgtgcgagcgggctggcaaggcgcatagnnnnnnnnnnn

SEQ ID NO: 27587 - DNA, 298 bp, Homo sapiens
  misc_feature: GYAE6OF02GQR8Z.30.1.A01.1.454.CMB.1.raw
  modified_base (289)..(298): a, c, t, g, unknown or other
  misc_feature (289)..(298): n is a, c, g, or t
tcagcacgctacgtcacgaccggtgctcgatttagacgtctcatcagggatcccagaccgattctctggctccagctcaggaaacacagcttccttgaccatcactggggctcaggcggaagatgaggctgactattactgtaactccgggacaccagtggtaacagtcggggagtgttcggcggagggaccaagctgaccgtctaggtcagcccaaggctgcccctggcactctcgttcccaccctcctcacgtagcgtgctgagcgggctggcaaaggcgcaatagnnnnnnnnnn

SEQ ID NO: 27588 - DNA, 511 bp, Homo sapiens
  misc_feature: GYAE6OF01AH8T0.22.5.A05.1.454.CMB.1.raw
  modified_base (195)..(195): a, c, t, g, unknown or other
  misc_feature (195)..(195): n is a, c, g, or t
  modified_base (487)..(487): a, c, t, g, unknown or other
  misc_feature (487)..(487): n is a, c, g, or t
  modified_base (508)..(508): a, c, t, g, unknown or other
  misc_feature (508)..(508): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaanagccaccctctcctgcagggccagtcagagtgttaactactacttagcctggtaccaacagaaacctggccaggcctcccaggctcctcatctatgatgcatcttacagggccactggcatcccagccaggttcagtggcagtggtctgggacagacttcactctcaccatcagcagcctagacgcctagaagtattttgctagtttattactgtcagcagcgtagctaactccctcacgttcggcggagggtaccaagggtggagagtacaaacgactgtggcgtgacacntctgtctcactcctcccgctntcg

SEQ ID NO: 27589 - DNA, 503 bp, Homo sapiens
  misc_feature: GYAE6OF01EFXQL.22.5.A05.1.454.CMB.1.raw
  modified_base (475)..(475): a, c, t, g, unknown or other
  misc_feature (475)..(475): n is a, c, g, or t
  modified_base (500)..(500): a, c, t, g, unknown or other
  misc_feature (500)..(500): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtgcagtgggtctgggacagacttcactctcacatcagcagcctagagcctgaagtattttgctagtttattactgtcagcagcgtagcaactccctcacgttcggcggagggaccaaggtggagatacaaacgactgtggctgnaccatctgtcttcatcttcccgctntcg

SEQ ID NO: 27590 - DNA, 575 bp, Homo sapiens
  misc_feature: GYAE6OF01DY7O1.22.5.A05.1.454.CMB.1.raw
  modified_base (195)..(195): a, c, t, g, unknown or other
  misc_feature (195)..(195): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgctccgaaggggaancgcccaccctctcctgcagggccagtcagagtgttaactctacttagcctggtaccaacagaaacctggccaggcctcccaggcctcctcatctatgatgctatctacgagggccacgtggcactcccagcccgaggttcaggtggcgaggtgggtctggggacaggtacttcactctacaccatcagcacgcctagacgtcctagagtatttgacttagtttactactgtcagcagcgtagcctaactcccacgtcgtaccgggacggacgggtaccgtaagggtggaacgacgtaacgaaaccggtagtggtacgtacgtcgacctactacgttccgtacgttccttactaccttacccgtccccgtctacgttcccg

SEQ ID NO: 27591 - DNA, 516 bp, Homo sapiens
  misc_feature: GYAE6OF01BRWIK.22.5.A05.1.454.CMB.1.raw
  modified_base (196)..(196): a, c, t, g, unknown or other
  misc_feature (196)..(196): n is a, c, g, or t
  modified_base (510)..(510): a, c, t, g, unknown or other
  misc_feature (510)..(510): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctgtgtctccaggggaaanagccaccctctcctgcagggccagtcagagtgttagcaacaacttagtctggtaccagcagagacctggccaggctcccaggctcctcatctatggtgcttctaccagggccactggtactccccgcaggttcagtgccagtgggtctggggacagagttcactctcaccatcagcagcctgcagtctgaagtattttgctactttattactgtcagctaatataatgacttggttctcgatctaccgttcggaccaagggaccacgactaggagtaagttaaacgacttaggtggctgcactatctgttctcnttcccg

SEQ ID NO: 27592 - DNA, 500 bp, Homo sapiens
  misc_feature: GYAE6OF01D0UCY.22.5.A05.1.454.CMB.1.raw
  modified_base (491)..(491): a, c, t, g, unknown or other
  misc_feature (491)..(491): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctacaaaagcaagtgtcctacatgaccaacatgaccctttggacacagccacatattactgtgcacaccacaggtctctactgctgcttcagtacactggttcaacccgtgggaccagggaaccctggtcagtcgtctcctcngcctacccg

SEQ ID NO: 27593 - DNA, 534 bp, Homo sapiens
  misc_feature: GYAE6OF01ALTU0.22.5.A05.1.454.CMB.1.raw
  modified_base (193)..(193): a, c, t, g, unknown or other
  misc_feature (193)..(193): n is a, c, g, or t
  modified_base (250)..(250): a, c, t, g, unknown or other
  misc_feature (250)..(250): n is a, c, g, or t
  modified_base (357)..(357): a, c, t, g, unknown or other
  misc_feature (357)..(357): n is a, c, g, or t
  modified_base (427)..(427): a, c, t, g, unknown or other
  misc_feature (427)..(427): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgctccaggggaangccacctctcctgcagggccagtcagagtgttaactactacttagcctggtaccaanagaaacctggccaggcctcccaggctcctcatctatgatgcatcttacgaggccagtggcatcccagccaggttcagtggcaggtggtctgggacagacttcactcncaccatcagcagcctagacgctagaagtatttgctagtttatactgtcagcagtcgtagctactcccgtnaccgttcggcggacggaccgtaaggtgacgtatacgaaacgtacgtggtaggacgtgacctaccgtattccgtgttaccttactacttcccgttccccgctacgtcg

SEQ ID NO: 27594 - DNA, 667 bp, Homo sapiens
  misc_feature: GYAE6OF01AVHWV.22.5.A05.1.454.CMB.1.raw
  modified_base (189)..(189): a, c, t, g, unknown or other
  misc_feature (189)..(189): n is a, c, g, or t
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (650)..(650): a, c, t, g, unknown or other
  misc_feature (650)..(650): n is a, c, g, or t
tcagacatacgcgtcacgaccggtgctcgatttagatagatagacgggggactcctgtgccccaccatggacacactttgctccacgctcctgctgctgaccatcccttcatgggtcttgtcccagatcaccttgaaggagtctggtcctacgctggtgaaacccacacagaccctcacgctgaccctnacctctctggttcgtcncncncactatgngtggtggtggcgtgngtctcgngcccgaccgaaggaccgtcancggtcgtgtcactacattatttaggtagtagtagtagtagtaaagtacggcctactaacgacccgacctattcctcgtaaggaaggacacgaactcctaacaatctacccaaacggaacgaaccctaccctaaaaacgaaacgactagggttccgttaacctaaatagtaccaacctaatacggtaccgttacccgttaggaaccctacgaccgaccaagtaactttaacttacgtgtacaccgtaaccaccgaacgggtacgttccttacgttacgaccggtcgtttacgtacgtttacaaccttacggttaccgtaccggttaccggacccggtacgggacccgtacgggtaccgtcgaccgtcgtcccgttaccacgtacccgccncccgtaaccggaacccg

SEQ ID NO: 27595 - DNA, 507 bp, Homo sapiens
  misc_feature: GYAE6OF01EIISD.22.5.A05.1.454.CMB.1.raw
  modified_base (372)..(372): a, c, t, g, unknown or other
  misc_feature (372)..(372): n is a, c, g, or t
  modified_base (498)..(498): a, c, t, g, unknown or other
  misc_feature (498)..(498): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaggccctagactggcttgcactcatttattggaatgatgataagcgctacagcccatctctgaagagcagactcaacatacaccaaggacacctacaaaaagcaagtgtaccttanaatgaccaacatgtaccttaggacacagcacatatactgtgcacaccacaggtctctactagctcgtcttcagtacacgtcggtacgaaccgtcgggaccagggaccctggcacgtcgtctcctcngcctacccg

SEQ ID NO: 27596 - DNA, 511 bp, Homo sapiens
  misc_feature: GYAE6OF01ACPF0.22.5.A05.1.454.CMB.1.raw
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctaccaaaaagcaagtggtccttacaatgaccaacatggaccctttggacacagccacatattactgtgcacaccacagggtctctactgctggcttcagtacactggttcgaacccgtggggaccagggaccctggtcagtccgtctccncngccctacccg

SEQ ID NO: 27597 - DNA, 556 bp, Homo sapiens
  misc_feature: GYAE6OF01D3S3B.22.5.A05.1.454.CMB.1.raw
  modified_base (196)..(196): a, c, t, g, unknown or other
  misc_feature (196)..(196): n is a, c, g, or t
  modified_base (382)..(382): a, c, t, g, unknown or other
  misc_feature (382)..(382): n is a, c, g, or t
  modified_base (523)..(523): a, c, t, g, unknown or other
  misc_feature (523)..(523): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctcctcatctatgatgcatcttacgagggccactggcatcccagccaggttcagtggcaggtgggtctggggacagacttcactctcacatcagcagcctagancctagaagtattttgacttagtttacttactgtcagcagtcgtagcaacttccctactaccggttcgggaccgggacggggtaaccgaaggggttcggaagtacgtaacgaaaacggtacgtaggtcggcgtcggccactnttctgttccttcacttccttcccgcctgttccg

SEQ ID NO: 27598 - DNA, 526 bp, Homo sapiens
  misc_feature: GYAE6OF01BPCVL.22.5.A05.1.454.CMB.1.raw
  modified_base (451)..(451): a, c, t, g, unknown or other
  misc_feature (451)..(451): n is a, c, g, or t
  modified_base (498)..(498): a, c, t, g, unknown or other
  misc_feature (498)..(498): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcaggtgggtctggggacagacttcactctcaccatcagcagccctagacgcctagaagtattttgctaagttttattactgtcagcagcgtagcctaacctccctcacggttcgggnggacgggtaccaagggtggagatacgaaacgacgtggtggctgcacntctgtcttcacttccttcccgctgtccg

SEQ ID NO: 27599 - DNA, 639 bp, Homo sapiens
  misc_feature: GYAE6OF01CPZ2J.22.5.A05.1.454.CMB.1.raw
  modified_base (297)..(297): a, c, t, g, unknown or other
  misc_feature (297)..(297): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcacacttatggagtgggtgtgggctggatccgcacgccccaggaaggccctagactggcttgcactcatttatggaatgatgataancgctacacgccatctctagaaggagcagactacaaactatacaaccgaagaccaacctaaccaaaaagcaaaggtcggtacctttaacaactacgaaccaaactacgtacggtaacccgtttaggaaccaacgaacgacccaactattaacttactcgtacgtacacaacccgacgtaacgggttaccttacccgtttaacgttccgttacggttaccttttacgaacgttaactaaccgttcggttacccgtaacccgtcggggacccgtaacgggtaaccccggtggtaccgacggtccgttccctacccttaccgaccgtcccgtacccgaaccccggg

SEQ ID NO: 27600 - DNA, 576 bp, Homo sapiens
  misc_feature: GYAE6OF01BNTY9.22.5.A05.1.454.CMB.1.raw
  modified_base (308)..(308): a, c, t, g, unknown or other
  misc_feature (308)..(308): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagactggcttgcactcatttattggaatgatgataagcgctacngccatctctgaagagcagactcaacatcaacaaggacacctacaaaaacgcaagtggtaccttacaatacgaaccaacacgtacggaaccctttggaacacaacgccaacaattacttactgtacgactaccaaccacgacgggtctactactgacttcggtccttacgacgttaacaacgttcggttaccggaacccgttcgggggacccgtaacgggtaacccgtggtacctacggccttcgtaccctcaccgtccctaaccccgg

SEQ ID NO: 27601 - DNA, 520 bp, Homo sapiens
  misc_feature: GYAE6OF01CJYLN.22.5.A05.1.454.CMB.1.raw
  modified_base (506)..(506): a, c, t, g, unknown or other
  misc_feature (506)..(506): n is a, c, g, or t
  modified_base (510)..(510): a, c, t, g, unknown or other
  misc_feature (510)..(510): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagactggcttgcactcatttattggaatgatgataagcgctacagcccatctctgaagagcagactcaacatacacaagacacctacaaaagcaagtggtacctacaatcgaaccaacatacggtaaccctttggaactacacgaccacatattactgtgcacaccacgacggtctctactgctgtctttcagtacacgtggtacgaacccgtcggggaccacgggaccctggtcacgctcnctcncgcctacccg

SEQ ID NO: 27602 - DNA, 520 bp, Homo sapiens
  misc_feature: GYAE6OF01BL9LK.22.5.A05.1.454.CMB.1.raw
  modified_base (196)..(196): a, c, t, g, unknown or other
  misc_feature (196)..(196): n is a, c, g, or t
  modified_base (492)..(492): a, c, t, g, unknown or other
  misc_feature (492)..(492): n is a, c, g, or t
  modified_base (516)..(516): a, c, t, g, unknown or other
  misc_feature (516)..(516): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcaggggccagtcagagtgttaactactacttagcctggtaccaacagaaacctggccaggctcccaggctcctcatctatgatgcatctacagggccactggcatcccagccaggttcagtggcagtgggtctgggacagacttcactctcacatcagcagcctagcgtctgaagtattttgctaagtttatactgtcagtcagtcgtagctaactccctcgacgttcggcggacgggtaccgaagggtggagactacgaaacgacgtggtggctgacacntctgtcttcacttccttcccgctntacg

SEQ ID NO: 27603 - DNA, 650 bp, Homo sapiens
  misc_feature: GYAE6OF01EJA7Q.22.5.A05.1.454.CMB.1.raw
tcagacatacgcgtcacgaccggtgctcgatttagatagatagacgagggggactcctgtcgccccaccatggacactactttgctccacgctcctgctgctgaccacttcccttcagtgggttcttcgtcccagatcaccttggaaggagtcgtcggtcctacgcgtggtacgaaacccacacacgaccctcacgctcgacctgcctaccttctcgttcggttctcacctccacctacttagtgggtaggttggggtggtgggtcgtggacgttccgtacaccgggggggggaccccaagggaaacggccctaagacgtggtcttgctactactatttagttaggaatgatgataagcgactacacgccctatctacgtagaagacgacagactacaaacactaccaacgaacgaaccaacctaacgaaaaaagctaaaggtcgtaccttaacaatacgaacaacacgtacgtaccgttggaacacacgaccaatatacttacgtgtacgacaaccacacgtacggtactactactgtcgtcgtcttacgtacgtactacgttacggtaccgtaaccggtcggggaccgtaaccgggtaaccctcgggtaccacggtccgttcctccgtaccgcgtcccgtaaccccgg

SEQ ID NO: 27604 - DNA, 582 bp, Homo sapiens
  misc_feature: GYAE6OF01C9A5B.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcacacttatggagtgggtgtgggctggatccgtcacgccccaggaaaggccctagactggcttgcactcatttattggaatgatgataagcgctacacgcccatctctgaagagcagactacaacatacaaccaaggaccaacctaccaaaaagcaaagtcggtaccttacaactacgaaccaaacactacggtaacccctttaggaaccaacacggaccaacaattaacttactcgtagacacaaccacgacgggtacctctactcgctcggtctttcaacgtacaacgtcggtaccgtaacccggtcggggacccacgggaccctcgggtacgaacggtccgtacgttccctcgacgtccctaacccccg

SEQ ID NO: 27605 - DNA, 548 bp, Homo sapiens
  misc_feature: GYAE6OF01DAE3F.22.5.A05.1.454.CMB.1.raw
  modified_base (197)..(197): a, c, t, g, unknown or other
  misc_feature (197)..(197): n is a, c, g, or t
  modified_base (365)..(365): a, c, t, g, unknown or other
  misc_feature (365)..(365): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagngccaccctctcctgcagggccagtcagagtgttaactactacttagcctggtaccaacagaaacctggccaggctcccaggctcctcatctatgatgcatcttacagggccatggcactcccagccaggttcagtggcaggtgggtctggggacagtacttcacttcncaccatcagcagcctagacgcctgaagtattttgcttagtttattactgtcagcagcgtancaacctccctnacgttcggacggagggccaagggtgagacgtacaaaacgtaactgggtacgcgtcggacaccctattccgttgttcctttcctaccttccgtttcccccgctcgttaccgg

SEQ ID NO: 27606 - DNA, 559 bp, Homo sapiens
  misc_feature: GYAE6OF01C0F2Z.22.5.A05.1.454.CMB.1.raw
  modified_base (482)..(482): a, c, t, g, unknown or other
  misc_feature (482)..(482): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccacggagaagttgtgttgacacagtctccagccaccctgtctttgctccaggagagcgggccacccgtctcctgcagggccgaatgagagtatagcgactactagcctggaccaacagagcctggccaggctccaggctcctcatgtatgatgcttacaaaggccactggcactccagccaggttcagtggcaggtggtctgggacaggtacgttcactctacaccatcagcagcctagcagtctagaaacgtattttgactaagttttattacgtgtacagtactaactaataatactcggtacctacgtacgtaggtttcggaccgtagggaccagcgtagganacgtacgaaaacgtacgtaggtacggtccgtaggacctaaccgtacgttacttacggttccttcgtaccgttccccg

SEQ ID NO: 27607 - DNA, 683 bp, Homo sapiens
  misc_feature: GYAE6OF01DDCZ8.22.5.A05.1.454.CMB.1.raw
  modified_base (197)..(197): a, c, t, g, unknown or other
  misc_feature (197)..(197): n is a, c, g, or t
tcagacatacgcgtcacgaccggtgctcgatttagatagatagacagggggaggaactgctcagttaggacccagacggaaccatggaagccccagcgcagcttctcttcctcctgctactctggctcccaggtgccagtgcagaagtagtgatgacgcagtctccaggccacctgtctgtgtctccgaggggaaancgccacctctcctgcagggccagtcagagtatacgacaactaacttgcctaggtaccagcaggacgacctggccacggtcctacccgaggtccttcctacatttacctagttgttcgactactcccgaagccggaacgggtcccctaacggttcccggaaccccaggtacccgtaggtttaccaggtcgggctagggtcggggtaccgtggggaactagggtacgtttcccaacgttcctaccgaacctagtaccgacgaccacgtccctggaccctagttccgtaaggtaacgttattttcgacttaagttttactacgttgtacagtacgtaagttaattaacgttcgtacggtacccgttaggtaccggttaccggaaccggtaacgggtaccgtaaagggtacggtaaaccgtaacggaaaacgtacggttgggaccgtacgtacgtaaccgtaactacgttccgttacgttccgttaaccg

SEQ ID NO: 27608 - DNA, 503 bp, Homo sapiens
  misc_feature: GYAE6OF01EVM2V.22.5.A05.1.454.CMB.1.raw
  modified_base (308)..(308): a, c, t, g, unknown or other
  misc_feature (308)..(308): n is a, c, g, or t
  modified_base (403)..(403): a, c, t, g, unknown or other
  misc_feature (403)..(403): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacngcccatctctgaagagcagactcaacatacaccaaggacacctaccaaaaagcaagtgtccttacaatgaccaacatgacccttgacacagccanatattactgtgcacaccacaggtctctactgctgcttcatacactgtacgaacccgtgggaccacgggacccnggtcacgtcgtctcctcngcctacccg

SEQ ID NO: 27609 - DNA, 614 bp, Homo sapiens
  misc_feature: GYAE6OF01ETX8R.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaacgccctagactggcttgcactcatttattggaatgatgataagcgactacacgccatctctagaagagcagactacaacataccaaccaaggaaccaaccaacaaaaagactaaggtcggtaccttacaactacgaacctaacacgtacggtaccctttggaacacacgacctaacattaattactgtacgacaacctacacgtacgggtctacgttactcggtccttcggtacctttacgtaacgttaacctaacgtttcgggttacccggtaacccggttcggggaccccggtaaccgggtaaccccgtgggtaccaccggtccgttacctccctacgtacgcccctaacccgg

SEQ ID NO: 27610 - DNA, 613 bp, Homo sapiens
  misc_feature: GYAE6OF01B0S0J.22.5.A05.1.454.CMB.1.raw
  modified_base (586)..(586): a, c, t, g, unknown or other
  misc_feature (586)..(586): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggactccgtcgaccgcccgaaggaacggccctagactggtcttcgctactactatttagttggtaatgtatagtataagcgtactacacgacccattcctactagaagacgacaacgactacaacactaacaccgaaacgaaccaaccctaacgaaaacgacgtaacgtacggttacctaactaacgttacgaacctaaactacgtaccggttacccgttaggaacctaaccgacgacctaactattaacttacgtgtaccgacacaacccgacgtacggtcctacgtactgtaccgtgtcttacgagtaactacgtcggttaccgaaccggtcgggaccgacggtccgngtcacgtctccncncgcgccgtacccg

SEQ ID NO: 27611 - DNA, 540 bp, Homo sapiens
  misc_feature: GYAE6OF01CFIE1.22.5.A05.1.454.CMB.1.raw
  modified_base (528)..(528): a, c, t, g, unknown or other
  misc_feature (528)..(528): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagactggcttgcactcatttattggaatgatgataagcgctacagcccatctctgaagagcagactacaacactacaccaaaggaccaacctaccaaaaagcaaagtcggtaccttacaatacgaaccaacatacggtaccctttaggacacacgcccactattattactgtcgacaccaaccacgaggtctctactgctggctttcagtacactcggtacgacccgtggggaccagggaccctggtcacggtcgtcctcctcncgccgtaccccg

SEQ ID NO: 27612 - DNA, 519 bp, Homo sapiens
  misc_feature: GYAE6OF01BVQ5D.22.5.A05.1.454.CMB.1.raw
  modified_base (417)..(417): a, c, t, g, unknown or other
  misc_feature (417)..(417): n is a, c, g, or t
  modified_base (507)..(507): a, c, t, g, unknown or other
  misc_feature (507)..(507): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgcccccaggaaaggccctagactggcttgcactcatttattggaatgatgatagcgctacagcccatctctgaagagcagactcaacatcacaaggacacctacaaaaagcaagtggtaccttacaatgaccaacataggtaccctttgacacagccacatactactgtncacaccacacgggtctctactgctgcttacagtacaacgttcgttacgaacccgtcgggaccacgggtaccctggtacacgtcgtctccnctgccctacccg

SEQ ID NO: 27613 - DNA, 518 bp, Homo sapiens
  misc_feature: GYAE6OF01BONWV.22.5.A05.1.454.CMB.1.raw
  modified_base (194)..(194): a, c, t, g, unknown or other
  misc_feature (194)..(194): n is a, c, g, or t
  modified_base (298)..(298): a, c, t, g, unknown or other
  misc_feature (298)..(298): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (406)..(406): a, c, t, g, unknown or other
  misc_feature (406)..(406): n is a, c, g, or t
  modified_base (475)..(475): a, c, t, g, unknown or other
  misc_feature (475)..(475): n is a, c, g, or t
  modified_base (487)..(487): a, c, t, g, unknown or other
  misc_feature (487)..(487): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccaggggaangccaccctctcctgcagggccagtcagagtgttaactactacttagcctggtaccaacagaacctggccaggctccaggctcctcatctatgatgcatcttacngggccacgtggcatcccagccaggttcagtgcagtggctgggacagacttcactcncaccatccagcagcctagcnctagaatatttgactagtttatactgtctagnagcgtagacaactcccgtcgtaccggttcggcggacgggtaccagggtcgagactacgaaacgtatggngcgtgacacctntcgtcgttcttcacttcctccgctgttaccg

SEQ ID NO: 27614 - DNA, 513 bp, Homo sapiens
  misc_feature: GYAE6OF01AE9Y6.22.5.A05.1.454.CMB.1.raw
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatacaccaagaccacctacaaaagcaagtgtaccttacaatgaccaacatcgaccttggacacacgccactatattactgtacgcacaccaacacgggtctctactgctgctttcagtacacgtgtaccgacccgtgggaccagggaccctggtcagtccgtctccncncgcctacccg

SEQ ID NO: 27615 - DNA, 549 bp, Homo sapiens
  misc_feature: GYAE6OF01B5UMO.22.5.A05.1.454.CMB.1.raw
  modified_base (536)..(536): a, c, t, g, unknown or other
  misc_feature (536)..(536): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgcccccgaggaaaggccctagactggcttgcactcatttattggatgatgataagcgctacagcccatctctgaagagcaagactcaacatcaacaacggacaacctaccaaaaagcaagtggtaccttacaatcgaaccaacagtcggtacccgtttggaaccacacgaccacattacttactgtgcacaccacgacggtctctactgtctggtctttcgagtaccacgttggtacccgaacccgtcgggacccgacggggaccctggtacacgtccgttctccctcncgcctaaccccgg

SEQ ID NO: 27616 - DNA, 559 bp, Homo sapiens
  misc_feature: GYAE6OF01DKQ39.22.5.A05.1.454.CMB.1.raw
  modified_base (196)..(196): a, c, t, g, unknown or other
  misc_feature (196)..(196): n is a, c, g, or t
  modified_base (257)..(257): a, c, t, g, unknown or other
  misc_feature (257)..(257): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccaccctctcctgcagggccagtcagagtgttaaactactacttagcctaggtacccaanagaaacctggccaggctccaggctcctcatctatgatgcatcttacagggccactggcatcccagccaggttcagtgcaggtggtctgggacagacttcactctcacatcagcagcctagagtcctagaagtattttgctagtttattactgtcagcagcgtagcaactccctcgacgttcgggacggtacgggaccaagggtgagtatacgaaaacgtactggtacggccttaggaccaccgtaattccgttcggtttacctttacctaacttcccgtttcccccggacctagtttacccg
